United States Patent 7,868,149 (PLANT GENOME SEQUENCE AND USES THEREOF) - sequence listing, part 45

SEQ ID NO: 23766 - DNA, 15020 bp, Oryza sativa
  unsure (1)..(15020): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcatgcatgcaactaatcaagcgaatcactaattaaacatctttttttcccaaagaaattaaatcgatccataaacagagataattaaccttgtgcaggaactcatcctgggcgccgatggcgtagaggatgccgacgacggcggtctggttctgggtgttgagatgcaccatgtgcagctccatgtcgtacctccggccatcgacggcgtgctccgacggcgcgtgccagtgcacctgccggagccggtacgccgtgccgttaatcaccagcccgccggcggcggcggcgtcatcgccgccgtcgaacctgaccatgatgtcgtggccacggttgacgacggtggcgttggcgtttcggtaggtgtagttgaggtcgccgaggccgggggccagggtgaggtcgaggaggccgaggttgatcggcgactgcatctcgccgctgctgcaggtggcccattccggcttcaggctgccccagttctccggccccctcggtgtgccggggatgtagccgaactgatcgtcttcctcggctccggcggccggcgccaggagcaggagggtgacgacggcggtgacgacgacgacgaggaggcgtgcgcgatgcatgtttgcgtttcgttgtgtgctgtgcagagtgctggctagctagctagctgatctctctggggttggccatggcagcttaggcttgtaggggtatttatccagtggagagtttaaggtagagtatagggctagctacgtggaggatgcatgcatggatgacaagttggaattttggttgcgttgtctctctgatcgactctgatcagctgatagaagtaggtgtacagagtacagagtacagactacttcatccgtttttaaaaaaattagatgtgatatatccatactaagtttatttattttggaacgaaaaagctagacacatgtacttatagcacactactacaaaatcaaaattctcagacaagacccctttaaggtgtaggcaagccaaaattgctctcacttgaaaaatcactttcccgaacgcggttcaagaattgcattgtaggtctcttaagatgacttcttagtaagaggtccatatgccaccggcccacaagatcaagcccatccttaaattatcaagtctcccctctctctcctcattctctccatcctccacttactctccacctctcctctcctcctcctctccgccggtggcacgcgagtgcgatcaatgctggagggatccggcagtggacgggagcagccgatgaccacttcatctgacagtaggcaggaacaggaaggggcatgagcttggtggcggaggatctgacaaaaggttgctcggagatgggggatccagtggtggggagcacagcggcaacggatccggcagtagggagcggcggctgccgcggtggatccaacggtgggtaggggtggacgaaaaactcgtggcttgttagctcactcgactcgtgaccaacttgacttggcttgactcgtgaccaactcgactaggctcgacttggctcgttgcgtttttctaacaagccgagctggtgttttagcttgttcgaaataacaagctagcttaagctggctcacgtgcaaaatgagctgaggcctggagtatacatccaacacatcaaaccagagctcaccaccaacgagccccgatgggaagcacatcagcagtggatccggtgatgcggagctcagtggaggtggatccgatgggctctccccctcccatacgcatggatcagaggcggcgatgggagtgggggagggcatttgcgacagcgaggacaaaccctgagcacgagagcggtgacagccaccggcacgggagctgctaggattttggattattttttgtgggaatttttttttgcagtcagacggcttaagcacccacatgaagtttcgcatgcgtttgttctacccacatgtagaagtactgattttagaagacacttgggtacagacagaccatccaagtgctcgtgaaaatcggttttgaccgtataaatgaaaaaattgtttctctagtagtgacagtggtgcaaaggtacgatacagctagccttctccagttgtgtgcatcagtgcatggatgcgtacgttccggcaactacgtactgatcgaacgctggcaagtcatgtggcaatgacatgcatgtcactccaaagcactggtacggaactacgactcaaggcggatcggagctggagcgagatggagggagggtgccacttgcttaatttactctgatttatatcaaatttaagctaatgcgggtgtctaaatttgtattgtgggggatgcacacatggtgaaaatatgtcaggtatagctacaattttttctttactgggttcctgggcacccctcaatactctagctctgcccctgatgacccgtgaccgcacatatgccttgggtaaatgtgtaccattattgatgactttctgatatcaaaagtaagatgatccatgattatagatggcaaaacgggtcgtttggccacgcacggctcaggcatgactgggcttggcccaacctacatgccgggccgggccgagctcacccacttgctggaccaatggtccaggcacggcctaataagacttgggctgtgccgagctggctcgaggaacaaaagcctattgtgctccttcttggaaaaagtctattttgcctccctcatctttgggccgtctcgaaatggctgtaataagtctattttgcatcattcatctctttgggtcatacctttatatggatggaataagtctagtttggctccttcagctatttggctccctaatctttggaccgtgccgaggcagagtcctaggcacgggcccacggtcgtgctgtgctgtgcctaggccgggccaaaatctcgtgctatagaccgggccagcgggccttgggccttttggccaactttattcatcatgtgtacctatctggtcacgtctattccctagttcagatatatggacatatataacacgatagaggtgtgggtacttacgtacaacagtacgtagtttgcatggtacgtgctagccttctccagttgtttgcatggatgtgtttttcagtcaccggtggaaagccgcaactattggtgatcaataccaagttggcttgtatataatcattcatttctgatcttaggatttattctcagtgtgtttatcattttcgagttgaagccgtgattatttatagacttatcggtctataaatatcgcgatggcaagtcgccaagtcggctattcatctatcctcacaaaatatatcattaatatagtgatagagttgtggctacatacacaacctaatttaacattctcgagttgtcctataaccatgatgagctccagccatcggttaaagccacaattttttcaacgatccatggcaagtaatcaattatgcattaatttccccttagaaaatatccccattgtggtggtacaattgtggttatacatagctaagtataatttcactcccaaggttcaaatatgaatatctatcgtgttcacatggttgactttcagtaagaattttgtacgagtctaaaaaaaaacaattttgtaagggtcattcaactagggtgtgtttagttcacgttaaaattgaaagtttggttgaaattaaaacgatatgacggaaaagttgaaagtttgtgtgtgtaagaaaattttgatgtgatggaaaagttgaaagtttgaaaaaaaaagtttggaactaaactcggcctagaattttaagggtactactgcttacatgattttttttttatttagagtagctactgcttctgcgttcatctcatacatatgatctctgaccacctccatattccatagcctggttgcaacatgggtaagatccgagacaaacataggtggatcattggactgcgggcacagcggcatcattttaaagtgcctgtcaagtagtcgagagcacagacccaaatttgtaaaaaaaaaacaaacaaaggtatagttggttcacattataaaccagctacaatttaatgataatttgtatatcagtgttggttcatgttatgaacaggccctacgccagatccttacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgttatgcgtgttggaactcatgaagcttaaggctagtaatggctggtcggacaagagttttacagaactccttgagttgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactacttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgcgtggactacatgtcagaaacatcttcaattggattaccacgatctcatcacgaagggaggcttgacggtgttggtactgttggaagaaagactattaggttggatcgtaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaagctttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccatggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctaatatgttcggaatgatcaatagtatattgcttatgaaatagtcaaataaaataattaagtgaaacacccactagaagtgaaataaaataattaagcaagtattagcattggaaataatataattaaagtagtataataatgaagtgcaattactactgttaatgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgctgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgccctcctctccaccgccgcctcgacctctccaccgacgccggcctgcaccaccgccgccgcactcactctctcgaccgccgccatccatatccaccgccatctccgccgccatccagaccctcctcgccgccgccctctctgccgccatctccgccctctccgccgccctcgccgcctccttctccaccgccgcctcctcactcactctctcgaccgccgccgtcctctccaccgccatctccaccgtcgccgcctcaacctctcctccgccctctccgccgccatctctgccgtcctctccaccgccatctccgccgccgcctccaccgccgccctcgccgccggtcgtcctctccgccgtccgtccatcgacttccccgacctccccgaccctgacctccccgacgccgggatccccgaccaccgccgaccgcctcgacctcttcgccactgcctctccgccgccgccaccaggatccaggacgactacggcctgcgccgccgtctccaagtacgccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctagattttatatacatgattttggtgcagtgaatcttagcatcaatagaggatcttagcatgaatttttaatgcattttgttttctataattctttgataattaaggacctttattaggtgtagggtttgaaatctagttacaagggaagaattgatagattggccgcagatttaatgtagttccgaggttatcaaaccatcacagaatacaaaatgcatggggaattttggtggataggccagtgtagtccatggacggaaccgacctagacaccaaaattctccatgcattttgttttctgtcataatttgatgattaaggaggctttgcagattatctaaacttgttgatttatataccctttttgtctatgaataggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctacacccctgctactgcccctacacttgttcacttgttccttattaaatggccagtgtagagtggttatatacctctacacttgttctttttttatgcataagaacagattttgtgcacttgctctttttttatgcataagaacagattttctgcacttgctcttttcttctggattgataaatggccagtgatgaattgctcaataagaacagattatctacacttgttcatttttttatctattcttctttttgcccctgttgtggctcaataagtaatgaattgctcaataagaatagtttatctgtacccttattgtgggctgttttttaaatttgcatgattgactcagtggttatatacctctacacttgttctttatggataagaacagagtatctacacttgttctttttttatgcataagaacagatttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgattcagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctactgttgctgtttatgtgaatctccccttgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttattgataagaacagatgaactacacttgttctattttctttgggttgcttttttctcctagtagctgatttcctctttttatcccttcatgcaaatgattgtaattgatgcatatttctcagcaaaactgaggccatatcttttatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggcagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttactgacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcctaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccatcccaatttgagctaggcatgccattggtggaggacaatgtgttagctgtgatgggtattgcttgccgagagctacataagcaatacatggagctaagcaatgccaagcggaaaatgagagagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgtgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatattgtactattcatctgttttctccttttttttc

SEQ ID NO: 23767 - DNA, 15907 bp, Oryza sativa
ttgtaaattgttgctttgtaaaggatctgtgatatgtgatgcatctgtgatgttgggcagttggggaatatgtgatatggagggggggtgactggcacctgtgatgtttctgtttttcagagggcatggctagcaattcctgaggctagccaatatttagcatttattttttttctggaattaactcatcagtgacggttcggaagaaacatccgtcacaggtaacctcacctgtgacggactcgcaaacgtcggaccgtcacaggtgacccacctgtgacgggcttttactttcgggcccgtcacaggtgggtcaccctgtgacggctactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcattgaccaagcccaaaaccgtcaaaggtgagggtttgggcccgtcacaggtgaccttgaccagtgtagtgaggtagttataaccatacactaatacagtgttatacgaaggtaatatgtattggcactattcttaaacatctgcatttacgataaattatatttatttattatgatagctttaaaaaatgacatatttacgacttttcaataatgtacatagtctttactttcaaaaaaaggcgacgacttacctcacaccaccacttcaaaagtaccatatatatatagaaaatattggcctatccatcgcgagcaatttggactaagccatgtactttgcaatacaataagttttaactgatcattattgcacgatcgttaatgaagttgcataaacgtgagctagctattcaacaagagtacttagcggtttttagccgcatgcatcctattgatagaaaaaaggttatggatcatgcatgctaatgcacacaggaagagacgagagatcagaccatgcatacatgcttggtacattcgtatgtcggtcttcttactacccttttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggctctgacattgtgccaccgtggcggccgggccgatccccagctgacgtggcagctgcctcagcgccaaccggactggcgctgaggtgggacttggccgcaaccccaaggcccagaccagcaagccttctggatggcttgcgggctgggacctcagcgccagccataatggcgctgaccgtgggacactcagcgccagcccacctggcgctgaggtgggacttggccgtttcggccttggcccagcccagcaagccttctggatggctgggctgggacctcagcgccaggtgcactggcgctgagtttggacatgtcagcgccatttagcatggcgctgacgtcccagccctgctaaactttagcaaaactttgcacacaacacaggcaaacatcaaatcacaaaaatttacaggcagtaatatatccagagaaccatacaatacatacatccatccatcaatcccaacatcattccatacatccatagaatccatcaatacatccatatatgaagtccatacatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggatgaggcatgtcgggggtgtacctccagtcctgcgaaggagcccgccggcgtcgtggtcgagacgggccgggctgcgagatatccggctgtgacgactctggtgcgtcctctagctgcgagggaccgagctcaaccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccattcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcatgtgggaccgtcggttggctgagcctttgtatgctttgtccatatcgttcttcaaccttcttgtccttcttcttcctcgtgtgttgttctgtaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgccctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgtttgatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaagaccttcatagcaacttgcttagcacgccatgctttgccatacgtaggccgatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatttcctccacttttccttgcattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtggatccccatcagcaattgctagcccagatctggtaagatcctcgaattatgttatttccgggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatccttaacatctccttcctctcttaccggcacattctcctccacattaacttcctcccttaacggcacattgtcctctgcatgtacttcttcccttaacggcacattctcctctgcatgtacttcctcctttaccgggtcattctcttccctgacctccacatccgccatatcatttactccctcgcccccctccacgtcttcctcaatcaattcttccttcctactacacctctccgacagttcgtgacagctaatggatgattctatgagtggactttcattaaggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtgaaatgtatcaataacaaccaaatggataaagatatgccacctccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaatggaggaagaactagctggggcggcctcggccgggctctaagtagccaaggtcagcgccaacttacttggctctgaggttgggcacctcagcgccgaagcagttggcgctgagtagctgccacgtcagctaggggatcggtgtcacaccccgaagttttcctcccaagccaaaattgtaattttcaaatgaccccaagaaaatgcaggtaaaatcaggagaaaaccctaagaaagtaatgcaaataataatcggacttgacatgtggaatttttcttgagttctacatgtcaaaattcattaacaggatttttagtggaattttcagagctctagaaataattttaaccaattaaaattgagcaagcaatattttattccagggaaaatcctttttcctttttctttttctttttcctctctttttcctcctttttgtcaaatgggccgtcggcccatttctccttttcttccccccccctctctgttgggccggccgcaggccgaggcccagcccggcagccggccgcccgcctccctccctcccggggtcgccgacaggtgggacccacctgtcagacccgtctcccacctcccgccgatcccggcgcgccgccgcgcccgcaaccgtcgccgcgcccacgcctccgccttccccgggccacgtcggccacgtccgcgcgtgcgccgcgctctccgcgcccattcccctctctctcccgctcgcgcccgctcccgagatggccgggattcgaaaaccgaatcccgcctctctctcctccccactcccccgcgtcggcggcgattcccgccgctcccggccacgtccggttccctctccccctatttaagcatcgccggcaccccctctcgctttttccccatttcgccgacctctcccgagctccccatcgctcccgcgccgtgcaaacacccgccgccgccgtttttgctacttcggccgccgctagccgccgctaggctcgccgccgtcttgcgccgtcgtcgccgttagcttcgcgcggccgaggtccacctcgtccacccctcctccgtcgaggttcgtcgccggagccctcatccccacgcgcacgggtgagcaccatctctaccgccgctttcggcctcggatgccggtcgccgttgtccatctccctctctctaatccctctcttctccttccttagggcacgccgaagctcgtccgccggtcgccgtcgcctcccgtggcctgccgtcgccgttcgccatcgtcttcctccgcgccggccaccctcggtgaggcatctcctctcctctccttccccgtttccccgtgcgtcgccgccacccgcgctcgccgtcgctttgggtcgttgccgccgtccgctgccgccgcttttgcgtcgcctccgccgccgggtgccgtcgccggcaacccgttcgcgcgcgcgccgtcgccgtcgccgcggccggtcggccggtcttgagccgggtcgcgccgagtgccgccgccccttcctttccctctcccgcgccactgacctgtgggtcccgcgtgccaacgcctcctctctcctccccgtgtcgctgaccggtgggccccgcatgtcggcgccgcgccacctgtgctgacgtcagccctggttaatattgcgcaataaattatttaaggatttttggttatagtaataaacacagtgaatcttctaaaattcataactaattcatccgagctccgtttaatcccattcaagtctcagtaaatcaaggaaaatgtgtagaatccattaaaaatggttttgttctctgtttcagtagtcttatagcctgtttgcaatgtttgctttgtatgtcgttagattccgatccctccgacgctccggtgtacttcgagatagtcgccgaggtccctccagcagcagagcaaggcaagtcatgcttgtcacttgatcatattgatcctatattgcaaatgtcctaatgttttctttcaaataccgcatttgttttgcaatattactatgggatggttacctattgttacagccatgctattttgataccatgctcctttgttagcttgggtcataacatgattagagttaggactagggtttgcttagccatgcttagttcaactagcacacaatggggagatctcatttaaaacctagactataggtttatatgataatgttggattagtaccaccgctctggtgttggttaattaaaatgaatcacatggtgggctgtgggtgcatggttttgctggtcgcacccatgacagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccggtatgtcgtggtggcatgtcggcgcacggaaacgtgtcgtggggctgtgtcttgtgggtacagttgtacacctctgatcagagtaaaactattcgaatagccgcgcccgcggttatgggcggtcaaccagattcaccgtgattagtctcaccctagtgtaatctgatgaatttggatagtttaggtggatggttgggcctgtcgcaacgtgggttagcgttggacagcggatgtttaatactgcttaattattacaaccgttttcgcattcaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttcctcgaggagtaggcttcgtccgtgccgtcgaggatgcctgtggagtggtgttcccgctgcagtttagtcagggcttagctccagttaccttttgttttccgctgcatttttgtaagacttttatgacgtttgtaagacgtggatctgaatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcgagggaaaaatcttgtcgcttgtttaagtgagattttttcaaaacaagtcagtttagggttttagtaaaattattgggatttattcgtcagtcagttggggtttgatgggtgaaatgcattaggtcctagctctataacatgggttgcaaggtatttatgctttgtttgttattattaaatatgtatctaatttcccattattttgtcgttatgtgagtatgtcttatttattcgctctcatgcaaaatgatctatgcataaaattccgctcttattcgattctcttatttgagtctttaattgctttatttaaatttggatttgagcatgcattgatcctactcctttgtcttctctagatggccggtcacccacccaaccaccgcggagaaggcatgatcgactttgtggcagagctggcacgcatgacactggtggtgggctaccccaacgcgccggagtacacgaccattccgccgctcagtggcgagcttcctcaccgtgtccgcttggaggtccatggctacgtggggacttgccttgctaacatggcggttgaggcgtcagggggcacagcagatcacgcttgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccacctttggtcacatgtgtgctgtgatgaggggattggacaggatgcactcggacctgcacaaggcgaccaaggccttgaacgatgggaagctcatgaggatcgtcgctctgaaggacgagatagcgcgcctgaagaaggagaacgctcagctaaagggtcttccagcgccaggaggagtccggatccgcaccacgccccgcaagacgacgactgcacctgtgcgcatccagcttgcgcccaggaacccacctccaccagcagctcccgcagcaccttcagttccgcccgcagttcctgcagctccagttccagctcccgcgttcactctctccttcgctccagcatcagccgccagaggttcagccagtggtaccggaggttggctgtctgctactcccagtggcagcggcgagactgatctgtcaggctccaggagtcgctcagagggaccgggtgacgagcaggaggacgctttcgactccaccgaccgcaggagccgttccgagcattaggctcgtttttcccactagtttatcgatggtctagcttctggttgttagtttgcgtgtttaggctgcttgtttggggtcagttgacggttgatatcatgtgcctatgatatggctgtcttaataaggatgtttgcttgctcttttaagtgtttttaattcagatcagaacaattgcagttttaattcctttgtaataaagcttagttcttgagcatctgtttttcttcttttcccccatctgcttttccctccagatggtctacaccaggactggcaaccgcacgacaggcgagggcagcaacggcgaagaacgcgtggatggtgtgcaccccaacagtgattctggcaatggtccgccaccacttcccgagaatccgacgcttgcccaagttatggcacatcagactcagatgatggcagccatgatgcagcagatgcagcagcagcaccagcagatgcaccaaaggatgatgcagcacgccgaacagcagcaccagcagtttggtccccctccccctcagtccaagttgccagagtttctacgcgtcaggccacccaccttctccagcaccaccaaccccatggaggcgaacgactggctccatgccatagagaagaagctgaatctcctgcagtgcaatgatcaggagaaggtcgctttcgccacacaccagcttcagggtcccgcgtcagcttggtgggacaaccacatggccacccgcccaccgggtactgaagtcacatgggcagagttctgccgtagcttcaggaaggcacaggtgccagatggggtcgtggcacaaaagaagagggaattccgggcgctccatcagggcaaccggactgtgacagagtacctccacgagttcaatcgcctcgcgcgatatgcaccagaggatgtccgcaccgacgccgagaagcaggagaagttcatggcgggtttggatgatgagctgaccaaccaactgatatctggggactacgctgactttgagaggctggtcgacaaggcaatccgccaggaggatcaacgcaacaagatggacaggaagaggaaggccgctcagttcagggcacctcagggaagtcaccagaggccgcgcttcactcccgggcagcagggtggacctaccaccatgatcgtccgtcagcaccgcccgttcaaccctagcaacttccaccagggcactagtggcagtcagaaccaccatggaagtcagcccaaccgcggtacagctccacgcccaccaatggcaccggcacagtcaggccagcccgcgcaagccaagaaggagactggagcaaaaccagggtcctgcttcaactgtggcgagcttggtcacttcgctgacaaatgcccgaagcccaggcgtgccgggccaaggtttatccaggctcgtgtcaaccacgcgtctgcagaggaggcacaaacagcaccggaggtcgtactgggtacgttccctgttaacttaatccctgcaacagtacttttcgattctggtgcaacgcattctttcatttcaaagaaatttgtggggaggtatgggttaaggaaagaagagcttagcacaccaatgagggttcataccccgggaaatagttcaacctcagtcagttttagcccctcagtgctaatagaaatccaaagatcaccatttctagccaacctcattcttcttgaatccaaagacctagatgtcattcttgggatggattggctgactaagttcaagggagtcattgattgtgcgaatcgcacagtcaccttgaccaacgagaagggagaaacagtggtgtacaaatctctagtctcaccaaagcaaggggtctccttgaaccaggtcgagatggaagttccagtggacaccgtagagaagaacttgaggaaattggaagatatacccatagtctgcgagtatccagaagtgttccccgaagacctcactaccatgccacccaagagagagattgaattccggattgacttggcaccgggaaccgctccaatctataagagaccatacagaatggcggccaacgaattagcagaggtcaagaagcaagttgatgagcagctgcagaaagggtacatacgaccaagcacttcaccttggggcgctccggtcatttttgtggagaaaaaggataagacgaagaggatgtgcgttgattatcgcgcactcaacgaggtcacaatcaagaataaatatcctttgccgcgaatcgacgatttatttgatcaactgaaaggagctaaagtattttctaagatagacctgcgatcaggctaccaccagctgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtattcatcgacgacatacttatctactcaaaatccgaggaagaacatgagcaacatctccgtctggtactcgaaaagttgaaggagcaccagctatacgccaagttcagcaagtgtgacttctggttgacggaagtcaaatttctgggtcatgtcattacagctcagggtgtggcagtcgacccatcgaacgtggagtcagttaccaaatggaccccacctaagaccgtgtcgcagattcggagttttcttggacttgcgggttattaccgccgattcatcgaaaatttctccaggatcgcccgacccatgactcagttgcttaagaaggatgagaagtttaaatggacagctgagtgcgataagagctttgaggagctcaagaagaaattagtatccgcaccggttttgatcctgcccgaccagatgaaagacttccaagtctattgtgatgcatcccgtcacggacttggatgtgtcctaatgcaagagggcagagtggttgcatatgcctcgcggcagttgcgtccacacgaaggaaattatccaactcatgacttggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgctttaagccggaaaagttactgcactgccctatgcatcgagggcatgtgtgaggaattgcggcaggagtttgaacatctcaacatgggaattgttgaacacgggtttgtagccgctctggaggcacggcccactctcgtggatcaagtcagagcagctcaagtaaatgattctgagatagcagagctgaaaaagaatatgagagtcggaaaagcccgggatttccacgaagatgagcatggcacaatctggatgggagaaagattgtgtgtacctgacgacaaggaactgaaggatctgatactcaccgaggctcatcagacccagtactccattcatccaggcagcactaaaatgtatcaagacctcaaagaaaaattttggtgggtcagcatgaggagagaaatagctgaattcgtcgcactctgcgatgtttgccaacgagtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcaccaaggtggctcactttataccagtacataccacctatacgggaaagagattggcagaattgtacctcgcaaagatcatgtgtttgcatggggtacccaggaagatagtatccgaccgaggtagtcagttcacctcaaagttttggcagaaactgcaggaagaattggggacccgtttaaacttcagcacggcttatcacccgcaaactgatggtcagaccgagcgagtcaatcaaatcttggaagatatgttgagagcttgcgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgaacgtcaactgttcggaacagaagtattagcggaagcagaagagaaagtcaaatcatcagggaaaggttgaggattgctcagtctcgacagaagagctacgcggataaccgtcgaagggagctcacttttgaggcaggagattacgtgtatcttcgtgtcactccgctccggggagtacaccgttttcagacgaaaggcaagttggcaccacgcttcgtgggaccatacaaaatcttggaacgaaggggagaagttgcttatcagctagaacttccatccaacatgatcggcatccatgacgtgttccacgtgtctcaattaaagaagtgtttaagggtacctgaagaacaggctgattcggaacacattgatatccaggaggacctaacttatgtggagaagccggttcgcatacttgataccagcgaaaggagaaccagaaacaaggttacccggttttgccgagttcagtggagtcatcattcggaagaggaagcaacctgggaaagggaagatgagttgaaagccgcccatccgcacctcttcaccagctcctctgaatctcggggccgagattccgtttaaggggggtaggtttgtcacaccccgaagttttcctcccaagccaaaattgtaattttcaaatgaccccaagaaaatgcaggtaaaatcaggagaaaaccctaagaaagtaatgcaaataataatcggacttgacatgtagaatttttcttgagttctacatgtcaaaattcattaacaggatttttagtggaattttcagagctctagaaataattttaaccaattaaaattgagcaagcaatattttattccagggaaaatcctttttcctttttctttttctttttcctctctttttcctcctttttgtcaaatgggccgtcggcccatttctccttttcttcccccccctctctgttgggccggccgcaggccgaggcccagcccggcagccggccgcccgcctccctccctcccggggtcgccgacaggtgggacccacctgtcagacccgtttcccacctcccgccgatcccggcgcgccgccgcgcccgcaaccgtcgccgcgcccacg

SEQ ID NO: 23768 - DNA, 835 bp, Oryza sativa
gttgccaagattacacgcggtggacaagaatgaccgatttgtgaccggtctgacactgatcatatcgtcagcgcacagccatgctcccacgacgcgctcacccccggcggaagtggaggtaggcgtgggctgtcccatcggagcgtcattcggacagcaaccgtgctgatctccgcccgttcaagagaaaaagaacagtccagtttggaaagagaagggtgcatgtggtatccccttgaagtataaaaggaggaccttgcccatagagaaggggctttttgattcttttccagattgtgagcttagaacgggggagaagtcagctcacacttgtagcccattcatacacagatccaccaaaacacaggagtagggtattacgcttctcagcggcccgaacctgtatagatcgccggtgtctcgtgtttctggctggcagacgatctttccacatacagagagagagcgagagcttgagatttcaccctaagcccccggccgaactggcaaaggggggcctgcgcggtctcccggtgaggagccaccagctccgtcaccattcaagatgggcattcgaatgtgccatagtacagcatgaatggatggaatcaatttctgatacttcttccgttccaatataagtatgcaacctagtacggatgaaacatactacctccatattttaatgtatgacgccgtttgtcggtgacacagggccgggggtatcgtgactagaggattgggttgccgcggtcgcccacgtggcctgaccccctcgggggggtcgggcccgagggtaacgtggccacccctccctctgtctccccgaggggtc

SEQ ID NO: 23769 - DNA, 656 bp, Oryza sativa
acagtagtccatcaatcctttaacaactcaaggagttctgtaaaactctggtccgaccagccattactagccttaagcttcatgagttccaacacgcataacaacttgctgtgcttcgacttgcatccatcatacaacggcatctggcaatcttccaccaacttactaaacttctcataatctctgcgttgtcctctgcgtcttcaatgtcatgcaacattgtagatagacattgagtgtccaaatctatggtctctccacctaaaggagaaatgacattggccatcttcgcacacctgtgcgagatgttcattggggtgcgcccctctcttcagctgttccggtggttcttcaccgtgcagtcggtgtcaccgccatcggtggttggcggctgctacttccagccgcgggggccggtgttgaaccgctacatcccctgcgtcctccgcaagaagtgggacgactggaagagcgactggttctacaccccccctcgccgacaagcgcgcctccgccttccaagccagcccccggcgcaggtctccagctggcgggcgcccggcagatctgggggaggagtacgacgccggcctctaccgcctggcgggcctgcgatcccaggggctcaccggggccctggtgtacggcgattacct

SEQ ID NO: 23770 - DNA, 356 bp, Oryza sativa
ccggcctgcctccgtcgccgccgattggtgcctccgcctacacggctggcctattatgccgccgctgtgggcgtctacgacttcaccgccggcctgcctccgtcgccgccgattggtgcctccgcctacacggctggcctattatgccgccgctgttgggcgtctacaacttaccgccggcctgcctccgtcgccgccgagtggtgcctccgcctacacggctggcatattatgccgccgctgttgggcgtctacgacttcaccgccggcctgcctccgtcgccgccgagtggtgcctccgcctacacgggtggcctattatgccgccgctgttgggcgtctacgacttcaccgcc

SEQ ID NO: 23771 - DNA, 24044 bp, Oryza sativa
  unsure (1)..(24044): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatggaattcaatgtgataagctatgggttgagatccacctaaatttcagaaatttttattgataagtcaggccacatcttgatagccactagtgatggtacgtagtagagagactacggacatgaaatggagcacatacaaaaaggtcatcgatccccctttttttttctgttttcaaatgatgcataagagttgctttacttatcacaaatgccaaaaaaagtgcttctttttgtgaaaaatgcttcagtacggctcgacttggtcggttcattaaaaaaaagtcagagagtggaaagatgtagcttgcttaatttatttacaggccatgagtcagctaagtataaagccgcacccatatatttgtaaggcaaaggacaagttgcattctacctcaaccaacaacaatgtttccaagtgaatgtacaagtcataaaggtgcacaattacaactgatgtgttgagagctactgtactatagcaaatgttaattatgagattatatataccacaaataaaacaaaccaacaattgttgatttgtacccagtgatacaaggctaattaaacttaacccggccaaaatagtctagtaggagtacttcacatttcctcggaccagtgacatgatcatgagctggcaataccgatggcatatcaacgacaacgagagcaactaaacgaagacgagtcgaaacgagaaacaacaaacgtagcacaatatatatctcagttctcgataataaatactccctccgttttaggttataagacgttttaactttggttaaaattaaactactctaaatttaaataattttgtagagaaaagtagtaatatttttaaccaagacaaatatattatgaaaatttattcaattatagatttaataaaactatggtgatgttgtagatattactacttttttctataaagttcgtcaaacttaaaatagattgactttgaccaaagtcaaaacgtcatgtaaactgaaacggatggagtaaaataaaatgaaacagcagcaacaacaacaatatcccaagtcattctccgaaaaagttgttgatcctgtctgcaaaaaggcgccgcgcgcgctcatgcatgtatgcagctggcccgcgcgttctctgcaccggagcgcgcgagcacgtctatataagcgtcccctctcccctgcacccagccatcgtctcccgtgcttcacttgtagctatctactccatctatcaagcccccagctcaaagacgtacgtacgcggcgctagctatatatactaattagctacatcgatcactagctatagctagctcgatcgataacttatcatcgtacttcaaggcgatcatgcaatctgctgccgtggagacgacgccggcggcggcggcggcggcggagaacggcggccaagtggtcgtcgtcgtcggcggggggtgggtggatggatgctgggcgcgggtgcgagcggcggtggaggtggccgggaggtgggtgggcgggctggcgaggaaggtgggcgggatcgcggcggacgacccgaggagggtggcgcactcgctcaaggtcgggctggcgctgacgctggtgtccgtgctctactacgtgacgccgcttttcaaggggttcggggtctccacgctctgggccgtgctcaccgtcgtcgtcgtcatggagtacaccgtcggtatgtaattttctctgtgtaccaagctagctagcgctaatgcatgccaagtacgtcggggtctcacgggggaaagtattctcgttgaggccttattcggttaatccctttgagggaggagttgaaggagatttattctacacctatgatggtgtggaattattcccctcaatcctctctaattcccttcaatcctctctaaaccgagcaaggccttattgagtttcttactcattgagtttcttactgatcatcatcacttgaatagttacaaaacattcttgagaaaatgtgataagttgatccttagtatatgatacataagttataaacacgcttaaatttgatttatacaaattgtaaaaaaagaattacaaatgtatgtatactgattagagtttaatttacttttataatttgtagaaatcgaatttaatcttatatgtttgtgaagtaatatatactatatcaatctatttgtcaaaataaaaaaaaatagtagctttggataaatgaggttgagggacaaaattccatccccagaaagtcgtcgttgccgcagatgacgatacgtatatgtatacacgcgggcgtacgtatcgtcgtagctaggcgacgatatatatacgctagctatatatccttggtacctaccacgctctacgtacgtaactacgtacgcagtacgctattagtacatatctcagtgacgtgtttgtgttttggacgtacgtacgtacgtacgcgacaggtggcacgctgagcaaagggttgaacagggccttcgcgacgctggtggctgggttcatcgccgtcggggcgcatcaggtggctaaccggtgcggcgcacagggagagcccatactcctcgccgtcttcgtcttcctactaggtatgtgtgtatgcatgcatgcatgtgtgtttgttgttcttcattgactattcaatgtttagggtcttatcttttcgtttatgtttatacttatcagctaaaatttaaattttcaacattaaatttgtactgattttaaagttttttcattgtagtttatttttcagcatttgctcttagatcaccaaaaatacttatataaaagttttattcataaattacttttcttttataaatataccggcgaaacgatggctataatagttcatatgttgtcatgcactaacttttttagacgaggagagaagcagtaggtagctagtagcatgtacttaccagtggcattcatgttaatttgttgatggcagcgtcggcggcgacgttctcgcggttcataccggagataaaggcgaggtacgactacggggtgaccatcttcatcctgaccttcagcctggtggccgtgtcgagctaccgggtagaggagctcatccagctcgcgcaccagcgcttctccaccatcgtcgtcggcgtcgccacctgcctctgcaccaccatcttcgtcatgcccgtctgggccggcgaggacctccacaagctcgccgccggcaacctcgacaagctggccgacttccttgaaggtgcgtacgcactgctgcaagctgaaatggcagcttgtggccgatatgtcacagaagaatagtgtgccctttcatgttattctggtttcacttatgtttctaattaactatgccctgcttgtgcacaatacaactgaaggcagaattacaactatatcatgtattaaattactaatagtaaacttgttactcacatagagctatagaagtaatatgctacaggcagattaattccagagtggggcctaaacttttatacatgaatgcaggaatggaaaccgaatgctttggagaaagcgctacgagtgagagtttggagggcaaagcctttctccaagcgtacaagagcatacttaattcgaaggccactgaagactctctggtaagcatactatgcagttatatatatacataccccgtgccgagaggcgaagtcctacagacatcttcaagcaaggtggtgaaaatgatgcaatgtgacattattcccaaaactgcagtgcaactttgccagatgggagcctggtcatggaaaattcagtttcaaacacccatggagccaataccagaagattggagctctttctcgccagtgcgcttcttccatggaggctatggcttcctatgtcatcacactcacaaaatctcaggtacttacaacctacaaatcataataattttcatgatctagacactggaacccagtttattgaccaatagctcgtacctttccctgatgacagtatcctgaagccaatcctgagctgtccttcaaagtacgaacagcatgcagtgagatgagctcacactctgctcaggcactcagagagctctcggcagcacttcgaacaatgaccgtaccatctacaacctccatgtctgcagccatcaaagctgccaaaacactcaggagcgagctatcagaggataaagctctgctgcaagtgatgcatgtggcagttactgcatcacttctttcagacttggttacacaagtaaagaaaattgcagaatctgtcgataacctggcacgacttgcctgcttcaaagtccctgaaaaatctcagaaagaagtggctatcaacatcatgagttgacaaactgactacgtcgagagcatcaacaccaaatgggacaaactagtacggcctgcaattttattgtgtaggagtattagcaagtgactaattcttcgatgctagaagtaattatgatgctgaactgtaaaaataaaacgttgcagccttccgtacaacaaagactacttataagcagctaaatataaatgaacagttttcttcttatttttggggaatgagtgaaccgctccctatgtgttgctgcgccaaagaaaataactggacgacaattatggtttcacaatatccattcagatcatttcaaaatttgtgatggtaaagtaacagattttttttcagaaactattgaagcagaaaaaatgtgatattgatataacaaacatattttaatggtgatatttatctagtaaaataagactgtcctttctttaatcatttttgccaaatattacagcacaggcccgtgagctcatacagttttcagattcatacacgtcacatattcaaatccaaaactaaataaaaccataccaaccagctatctacgtatgtatacgtatacggtgcagttattttaaaacatcctacagatggcatacacctctatacatagatgaacacagaagatgagcataaagcctgctataatcaccaccaacacctgtttttaagtaggacaaattgcatagtgtccacgcattgtgacaaatgcaaataaatgtaacatagatttacatggcatgtaaaaaataattatctttaaattacaaaattgtatatacaatactacatgagatcaataaacagcctatatatatgcaagtacatcaataaactcatatatgtggccacaaaagccttgtggagtgtggaatggggtagagcacattctcacctccaactccttttaatatagtaaagatattcttgtagaagtaagataaacagctgaattggaagatgatccgcttataggtgataaagttgacccgactccatagatgcaaatcatcatcaaccacaagttattggataacagtgattggtgatagatggagcgattagttagttgatcttttgcactgtcaaccactactgggaaccaagttgcatgggaaaaggtacggacttacctttgaggacagaattttgaaatggagataacaagtcataactaatatgttccaactgtgtgctactttagggatcaagaagaggtaatataacaagcaaggttctttatccttcccatgttaccattttgttaccatgaatatagcagaaatacaacaatttgaactacacataattggaataatacctactaatcaacaatcatcaccaaaccgactgcagtgaagcaaagcatcccagccccttatgcaaagtaaattactataataaacctccttatgaacagtgaaggattaatggattacaaaaaaacaaaaacaaaacattgccaattggagaccaagcacttattttaatggtgccggagttggtggcttattcttaatcccatgttagttctacttttagatgttgccatctattattctttttcgtagtgtcataattaagcttttcttttatgtccttggtgctcatccagtatgaagtatataaatatgagaaaccattgacattaaaactattaaaaggaaccaagtctacatgtctttgagaaactaatgacatttttgttatctataatctgagacatttaaggattagaaaccatattaagacaatttgtaagctgggtgcgacttcctagcacaaaatgaaattgcctgttcaattttttttatcacagataggataggcaaaaacaaaaggcacacaaaaagaatttaaactccaggacttaactttcattaaattcgtttatgtcagaaaaaaggaaacatcatacacgcatactgccattaatacacctaacctatttgggtaacaaaaatggatgtagtatttacaagcaaagagtctaaacaaaattaattccatacagaccctaaaaggacactgcagaagtacaggatctagtcagtgtgtgaactgcataacacttaataggcacatacctaatgagaacatccttcaactatatatatattagtttaataaaagcgtcttgacatcaccagccatatacagggtgttgaacttggggaggcaataaattcaaatccatgcattgctgtttatcatagtcacgtgtaccgggaattgctcctgtcgccaatctgaggatctcattgccagttaagcagtgatgagcaaaggccagtcccccatccacaacttctgaaagtctaggaagtaaaggtatctttctcactttacttctcttcccatcttgtccagaataaccaattttgttattcagaactttgtcaagctctgagtactccatgaatctttcagttgctgcctcccatgacaaactgtacctttgctcaggggtcaaaggtgaaggttcactagccatggcctctttcactcgggcaacaaattcttcggaagttttgtatgttaagcagttggggaatgacttgaaaaattcgtttgatggatgatctgcacagataacaaatttccccattgcaagagcctcagctgtcgctgtgcatagaacatcactgacacttggattaatgaaaaccttatacctaaaattaagaaaagaaaaaaggccattgtcaataaatagtaaatgataagccagagaatgagggttcattttagcagcttgctaaaatgatactcacccatgaagcgaagaatctgcatggtcccttcctttgaaaaaattgaggctcaaattcaatttcctagcagccatctgcactgcttgtgagtcctcaccattcccatatacatctacattaaagccctccaagtcacttttgtgtttggataacaaatctataagttctctatatcctttagcccaaaccatcttcccaaggaaatatgctccctttgtaaagctctgctgcccatgctccttatcagctgctattttttcaccaaccttgaggaactttggatttacaccatgaacgttgcagacaacagacctaggtagatcttgagttgctgcagaaagacgtaaaacctgcatgcacccattataagtttcaccctagcaatcagggcttttacacgagacaagcaaacacaataccttatgacagtatgctctagtcacccagttgttgatatgcttaacaaggaaagcttgaagagctccattcttctctctcttgatatactctaggtaatttgtgtgaactacaccaatgacatgtttaaacttgtcggtccaacgctttccatgatgataccagttgagatgctctggttcttccaaaattgctatatcagcttcactcgaggaaatgaattgtgaagtatctccagcaggaataatactacgtcgctccttcgaaaactgtatagcatgaaattttaaataaagaaattaaatcattggggaagaataatgtatggttgaatacatcaaaatcagatgataattggatttttaccttgccaggataaaatgatatcttaaaatttgcttcaaagccaagtctttcctgtagccagttccttatgtaattttcttgttcttctggtgaactgaaggtgatattattggggtaaactagctcttgatctgacttacagagccaaggaaccaccagtgtcaccttctgttttgtacttcttgctagatacgcagcacggaataatggattgattgctgtcccagtcatccatggaagacttgctgttgtgacaattgcaacatgccgccggttgtccgagagcttgtactttgcatgatccttccaaaaactttcctctgtgtgatgcccagtactttctagcacccttgctattctcagatcaagctcatcagtcatgttctcatttccaattaaagatctatcagctgaaagagaatgataaatgagccggccattgtgtttactgtacaatgtctccacaattttgtcacataaatctgcataatatagaaagatttaacgatggtcagcaccaaagtgacaagagttgggaaagtgcaggcaaataaaacacgccgtacctcttctaataccaagttggtccagaaatggtccagattgccgcacaagatatgccagaatttcagtaagatccagtgggagaacctcctggattgtatgcaaatattcagtttagaaaacacgcactctgtgaaattaataagatgacataacaatgaagattgcattatcattataatcaactgctttcggaaaaatgctttattaaaagatatgatttagttatactcaataatgcagtgtctaagaatcttaaaacttggacttaaagaaattcaaccgccatataactcaagtagtcattgttacaatttcagtatttcactatgccattacaaagcgataagcatctaattctgacctacaactggctataacgaaaaatgttctgaaacaactgaaagtttaaaggttaatctaatatgttgcattttgcaaaatagtagagcataaatgttctgagaatctagctggactgaactaggcagcgaaaaaataaaatcaagtaaaccaaattcaagttaattaggaaagtgatccagaagcatttcttcatctgaagttactaactatttgccctaaatagcagaagatttccaacagttatgcttagtttgttctgacattaccttggattcttgtgactctttgttcagagatttctgcaacaaaatgagaaacatgaatcagtgctccacttaacacacaaaaattgatgatcatataatacacttagtgttctcaaaagcataattctgcaaaaaatgcatcaggccgtcagttgtcacctgatgtaaatgatatggctttatgagcaactggaattgctactttttggcagtccttaaaagtactttatttcagggaagcatttcaatatttttaaatgatggattagtcatatagagttagacaaaatattaaacaatatatgaacaaaaatggagcaatgccatgttacttattttttgcaaatacacaatccttctatttgatgaagcattggaacatgtatcaatcaatatgtaactcccttagattccttttcatggatgccaaagttctactaatgtgtaagactcaattgctccattcatttatcagtaacttacagaaaatgtacctaagcaagtggaaaggtttatcgtcctaaccaagtaggagcatatcatgatttaagatggaactttcgaattaccaagctcaacttgaatttctccacgaactcgccgcggccacgaaatccaccaaacacctcactcgacaagctccggcgctcgaactccttcagcccgctgcgtatcatcctcaccacctcccactccttcctcccctcgtcgtccgcgtggcccttccaccgcacgagcccccacctcccgccgccgccgccgccgccgcccccctcggccacaatggcgttgcggatcgccgtaatccccgagaggtcgacgcggaggctggccccggcggccttgggggcccaccccgcgtcgcgcaccgtcgacgagtactgcctccgcagctccatgatcttgggctggatccgcttccgcacgaactccacctccgcgatgggcgcccccgccgcgaccggcggcagcggcgggcccgcgagcgccgacgccgacgcgaggaggtgctccagctcccggtcggcgcgcgcccgcatctgcctcaggtcggcactcgccgagtcccgcacctcgcgccaccccttggagatgaacgcgaaggcgccgccgccgctgatcggcggcggcctctctccgcccatgacctggttggctagggtttgaattctagagacgcgtagaggaggcgagtggaggcgggagatggtggtggggaagaggaagacgaggacgacgacgacgacgacggtgtgagaggcttggggggaaagagaaggtgggaagcgtgtgatactgacaggtgggaccgaggtgtcagaggagtgggatgctgccacgtgggatgtggtccctgtcaatcttgacctgtggtgggggtggtgacttggcacggggcggtttgaactttgaaatgatgtggggcccgcgtatccgagtgggaatatgcttgcgtggatgcccagtggacgtacggcctagcttcgcggttcgccgcttgtgcttttgcagtttgcgtctgcagatggttctggatttaacgagtacgagtacccttcttcttcacacatttgacaggaagtgaccttttttttctttttcccattacacgcgcgtacacgtatatgcaacactatactcacacatccacaaatgtttttacaaaatacaatggcacgcttatacaccactatacgcgtgacactaaacttacatactaatggttgtatcttctaacacacgattaaagagacataagccaacgacgtatctatctcggtgggccccacttccttcagttcagtactcaccctctttgctttcaattgcttctgattctcgtccagtcggtaactagcgggagaggagttgcgcggcggtcggccgccagtaggagaggatttgggtggtggcggcatcacgagcttgagcggtcacctagccgcacgatgccatgacgtcatgcaacaaccagtcctaggacaggatgttcatctcggcgaagaatacggagagcggtgggagggcgcggacgacactggagaaggggtggaagagggatgacgtgtcgatgtcctagttgaggtcgaggagggcctcgtggaagccctggtgggcgacaatgaggaggaggaaggcgtcgacgatggcgtggtagagcgtgtcctgcaggacgaggaggaggaggaggtcggcgaggatggagaaggcgtcatggacaagctaggaggcttaggagcaaatggcagcaaatgtggctcgggaggtgggagaggagcaggtgggagtagcgtggtaggctaatggagcgcgtgtggcacgccaccgccgccctaggcttgaacgaccttgtcgggctgagaaggaatgaaatggagcggccaaagttggggagagtccttcttcccacaccatgcatccgacctcgtcttcgttgatgacggcaatggccacctcccccacctccgtgagcttcgctcgtctctctcctctaccggcggtggcgcctcatccctagccgtcgtcgtgccagtgtaccagttcatggcgtcggcgatgtaactccagcaagcgatatggtggacaggcaacaaaagaggtgtggagatgagagaggagaaggacttttcacatatttggtgacttggcggtgggatccatgcggccgtggaggaggaggcgacggggagattcgaggggaagaaaggggacccatcccccacgctccttagcgacgacgccgtgctcgaaccataagagagatagaggaggaagggagagaagatgagaaacatatgggtgatgacgtgggtccaactataattttttatttttaaccggtcagttactgacatgtgagtcctatggtttcttttaacttgaagtgtcacgtcaacaccactcgtagatgccacgcagccgaaaccaccatccaaactactttagaaccttctttgcactgattttggaagtcgagggatacatcatattagtattgttatacagtaatgaatttaaaacttggcgacaaattaagggacataagtgaacttattacaatcccagaagctcggctgtgaacgggctgcgggccggccaaaccggccgctagtccagcgtgagtcggcccaataacacatgggcttcgctcgggtatctgagttacggcccaatagcacctcaacgccaaggttacggcccaattaagttgcgtaggactcctgtacaggaaccatgggctttcttaaactgtccctttattcataactgtcactaaaaatctaaaaaaaaaagacccccacttttactattttttccatcgaatgatccgcgcagattgcgcagttagtatcattatatttttctcatataatagcatatatatatacatatatatatatatacatatatatatatatattcccaatttattattaaaaatattaaaatgacaacataatttcaaattttgtactaaatttaccaaactaccaatgtgatagtcattaattatttttaatatcaaattttagttatttctaaattgtattcctatatggactctagacttgtttttcaatattcattattttttaatttcaaatcttcgttatttgtaaaatttatttctatatagactctaggcacttcttctaatattatttatttttaattttgaatttttattatttctaattgtatttctatgtggactctaaactcatctttcaatgttttttatttttttatttcgaattttagttccttctagattgtattcgtatatagactctaggctattcttcccatatttttttaattttgaattttagttatttgtaaattatatttttatatggaatctaaactctacttttaatttttattatttttattcctgattttagttaattctaaattcctatagggactctatatcttcttataatattcctttttttaattctaaatttctattatttattaattatatttctatatggactctacacttttcttctaatattatttatttttaattctgaatttcagttatttttcttaattgtgtttctatatggaccttatactttttgtcgacgtttgatgtcgcgattccggtatttgcatagtatggggatcgttggtactagtatatgcgcgagactgaggtaaaagagatagagacgaggatttttatacaggttcgggcccctgaattgttaggtaataaccctatatcctgttggccgaagccggtattgctcttattcaccataatcacaccagtacaatatttggggtagtctatctaactgttgtcgacttggcggtatgaaagtctactcgtagtcaacaacagggtagtcttcctcctcgaatccgtgcccggcgagatcagagatagcgctttcgtctctcctgacagtatccggagacaccgtaggggactagccgtgcttatccatgaagtcgatatccagcattttttcttggcgtatgttgtcttgtggcttctgttgttccgtctatgttgagtgtgtcccctctcctcctagggggccttgtatttatacccataggtgtctccttgtccaagtagaactagggaaaccattatggatacaatccgagtagtccttgtcgtttccatgtagaactctggttgtatttccttatccgaaactcctcctatatccacatgttgtttccgtataagacatggtatgtggtgggtcctgccgagatttagtcgactactattaggtatgtggtatccataacgctgacacttttctgctaatattatttattttttaactcaaaatttcagttatttctaaattgtatttctatatgaactctgtactctatattattttaattccgaattttagttattccaaattttatttctatattaattctaaacaaattttagttttcttatttaattctgaatttccattagttctaaattgtataacaacatgggctctggtctcctcttccaatatctcttattttttaattctgaatttcaactattcatagattatatttctatatagactctgttttttttctctgattaatatgagaatttctaggccgtgagagcgaacgtgaaggctattttttctatttctttaataagttataatagaatttgaaactttctaggacatgtttcgaccaaaatagagtaaccgatcatctcacgtcacagaagtccaccgcgacagacgctcctcacttatatactaatacagcatttctcacttcagttactagcactacttggaacgattagttatagcacatatggtgacccaaccctaccttttcccgagcaaaatagcggagaaaaacagggacacgtcaataattctccttaggtatatagtactactactactttacacaccaaccgtgaatcgcatgcgtgcttcacttgcctccaatttgctactgctaccggatgcaccaaacggaacaaagaagatcggatggtaggtgacatgtccaagaacgggcaggatggtgcacttgcctccattttttctgatataagcacagcagggtattaggtcgaccgtcttctagctaagctctgtacttcgaagtcccaatggtccctggccgtatgtactacttacatcctgtatgcttgtatttttgcatggtgcctgcatctgtggatctgttctgcaatgtgtgcgtgtgaattattgtgtgccgaacccgttgcaaaattgctaatagaaacaaagttcttttatatgacctggcaattgctatatctgaagtgtctgattgattactctagagtgatttgggtgcatgtgtgcatcactagttccaaaccttagtaggttcgacgtgtctgcgtagaacagtcatatttttcattttacttccaggctaagtttgtgtgaataaccatcctttttgcagcccccttttagagtctctttccccatcctttatggaagagatgaaagtaaattaccctcacttcttttgcaatgcgcatgtttaactattgagattgattacatgctaaattccccccttttttgtcaaaagagacgacctcgatcgcactatgctagccatcctgactcagaacactacatggaaatggatcaaatgacacaaaagctcttcaagcccttccacaacttttctcgtcggcgctttttatccgaaagcctgatttgaatatactgtaagacagcgatcctgctactctgctacataaaagcaaatattccacaaatttatccaacagcaacagaaagaaaaatgtctacagttttttttccggtctagtagtattcattttttttagaataatggatagaaatggtatatagtagtatgcatatccggtgtatgatgattgatgaccagatcaagccactgtatgtattggaaaaaaaagcttcttttttgggcgaggcagtggcgtgtgcaagatcgttctggacgctgataattcacgggaggaggcaaatgatcgttgatgattagttaagagacagggtcgtagcaggtagcatggtgcttctggaacagatgctgccatagggcacagggcaccgcagtcggtggaggagggggataaggaatgaagggcaccggcacgatgccggatggacgcacacgcctctgcacgcggcgggcgcgtcatgcgcgcgtccgcttgtgcagctgatctgctgatgatggctgccatattttctttattttgggtggggttttctttggccctgttcgcctgaggcgacgccggaacggccggcctgcctctcgcgtgctacgctccaccaaccggcgtactatctcgcgtgcgtgaggcgatcgatcgatggacggcgcggcgcacgggcgatgtgatgtagtggccgtgcaccgatcgacgctctcctcggccctcgggtgatggtcgcggaggccgccgttcgaggccgctcagatcgacatgggtgagatcgcgcgcgtaatccctagccagattggcagtttggcccgtctccggcgccagccacgcgcgcgcgcgccaccgaccacgccatgtgtatggagtgccattgatgattgatcgcccgcacacgtacacgtaacgctgctgattgttgttatatatgttgtgaatcgtttatcatctggatatcctatcctgatcagtaatactagtgtaggagaatgtactgcgtacatgaaggagattaatattagttcagtggacaggggtaaaatggtgggcactactactgggttgtgggtaccatagccgcaggtcaactcagcctcaacgtgcacatgcaaaacaccaaccgcaatggtaatcatctcctgttgaccatctggagatggagtgatcctcaagcagcagagctccagagggacaccagtctgcctggctcatgtgtgctcgacaaaccaatctcaatttaagctaagttgatggagttatgtacttaattactagtggtacactaatacacagggcagcctcctgtgcaacagtgcaagggggtccaggggaaagaagaagcagaagaatctcggtgagttgagctgtagctttcgtcacctccctacacccaaaagaaattaaaatcccctttgaaacacgcaccaccacacttacctgtcctcctatcaagcttaggagttaggaccttttaataaaaggccacccccactcctcgcagcacactttccttctactcacacgcacacagtcctcagtatcacacacacactcacgctcacgctccactacaacgcactgtacacagttgattattagctagttgggtttctggcccggccgccggcgagatgggcaaggacaagcaccaccgcgactggatcctccggcggtgctgcggctccatcgccgcctgcatcctcacgctcgccgtcctcgtcggcttcatcgtgctcgtcatctacctcgcgattcacccctccaagccttctttctacctccaggacgtccagctccgcaacatcgacctctccgaccctgccatctccctcaacctccaggttaatcaaattctggctaaaaattgtacagtttgttcttgttcttggggggactgaaaaatcgtttgcttctgtgtgtgcgtgtaggtgacgatcgcgtcgaggaacccgaacgacagggtgggggtgtactacaagacgctgcacgtgttcacgacgtacagggaggagccgatcacggtgccggtggagctgccggcgatctaccaggggcacaaggacgtgtcggtgtggtcgccggtgatgtccggcgagtcggtgcccgtggggcagtacgtggcggacgccatgaggcaggacatcgcggcgggctacgtgctgctgcacgtcaaggtggacggccgcgtcaagtggaaggtcggcagctgggtctccggcggctaccacctcttcgtcacgtgcccggccctgctcgccgccagcggcggcaacgtcggcggcgccttcgccatgagcgccacggcgggcggcggcgccggcggcaacgccaccgtctcgctcaagttcgcgcaggcggcggactgcaccgtcgacgtgtgacgcgaaatcaccgtgcaacccccagtgagcgtgtacgctagcttgtcgcgggagaacgcacgcacggcggcgccatgagagctacagacgcaacggcaacggcgcacctcgccgaagtaattagtatcggattagcaattgtaacagtgtaagcttatcgagtcagcgcgttttccccccctccccccccccccccaattctgaatctgtgcagaataaaaggccacttttatatgtatacatccgcttagtatcatttgtcattgtcgaaacaacatttatgcatcaaagctttacaatacagtcgatcgatcgtttttgcatgccttttgaagaatcaacaatgtataaaaaaacagagtatttgccctgcctgccttccatccccacaacgacactagcgtacctgttcgcgtttcaacggagacacatgccgttcattcaaactttgtgcgagtaccataaattacgagagcaagagtcttcatgagatacaggtacgtacgtgggcaattttctcacgccgtacagtatagtacagacgagatgatccaacgaaagcgaagagaaggcagaggaaatgaaatgaaatgaagtgcgctagggcggatggagagtgacccaccaacgtacctagctagcgggagttgggagtggcattcggcagcgcgtcacggtcgtccccgagtacgtacttacacttacatcaaacgggcaggaggagaggagagctgacgagtgatgacactgcagagtcgatgggagaactatagctgaggctgatcaatcgtgacacccgacatcaatcatcgcctcggcgacgacgacgtagctgatagccaaccccggggttttatgagccggaaaaatccggccgcgcaccgacacaccggccggccgcggcgcgcgcggcgacaccgcggctgaaaccgacgcccgcgcgcagccgcgcagcggacaaaaagcctttcgcttcatcgcgagacggcgagacgtctcgacgacaatcgctggaggcgcgggcgagcgagcgagcgaggccatgctttgctttgcgagggctcgcggtgcgccgtgcgcgcgggccgccagtgtgtttatgtgggccgaagaacggagaagcgcgggggaaaatgggccatagattttcatggcccatgcatgatggtccatggatgtggtaccagtggcctcgtggtagacggtagagccaatacagcccaccactttattaaatttggtggatccactgacaaaccaaacacactggtcccgatccaatcttattactccctcttcccaaattgatcatcatataatgaaatttaaaatttctcaaatttatcatcatataaccgcgtggacatagatttcatcagaatataattaatacagtatgggagaatgtacgcatgctaaggtatactccctccgtcccaaaaaaaaatacattcctagcatcccgaggtgaaattagtggatatggagaataactaaaatgcccttcattattgaaaaaagtagtaagagtgatatgtagttaaagggtattgaagggataaaacttctcattttacgtgctgagggtaggtagtatggtagaagttgtttttttatgggacaaaattcaaactctagaagttagttttttgggacagagggagtaattggcatggcgttttaatcgatgtattaattgtgggagaatatgtgcatggtgtcatgattgatgtgattgaaattattcttagtcttggtgcataaacatatatgatgctcaatttaggaaggagagagtatttagttttgttgctataaaacttttgactcatcgtaaaattatactccctccatttcaaaatgtttgacaccgttgactttttagcacatgtttgaccgttcgtcttattcaaaaaagtttgtgaaatatgtaaaactatatgtgtacatgaaagtatatttaacaatgaatcaaatgatatgaaaagaataaataattacttaaaatttaaataagacgaatggtcaaacacgtactgaaaagtcaacagtgtcaaatattttgaaacggagggagtaccaaaatttgagaaggcgtgaaaccaatataccacctaactttagaggagactaccgcccagacatcccatgcaatgtaaaatatgggatgctaccaatgtactacatcagcaagctaatcacataatgcaaaatattggacgctaccagtgtactacatcaacaagctaatcacataattgctacgtgatgatactatatgatgtgcttgcattgattaatacgatactagtaacctttgagatgatttattttccaaaccatttatccatttgtcattctgattatatcgttgtattcgctataattaaatttttacaacaaaatctcgcacgattatatcataattgaaaaatgatatatgtttcaatcattaaaatttaatgtttcacgtgtaagaagtaaatatttcagttagaatttgactatgttgcgtaatttatgtttttaataaaatagatgttgttttaatgttacacgcgaaatcaataaatatgttatgatatttcattactttatttgcgaatgttttacatgttgtatttgaatgtttcaacaagtatattgtgtgcaacagttataaagaattagtgaaacaccagaaaatatctattgaaacatctaaataatgctatgagcctctttcaaaaaacattgatactatgagtaaaatgttgcaagaaaaaacttaaaattagttacaaagtgaaatttcatttgaaatgtttttttcttacacgtgaaacatccaattgcacctgcttaaatacacgcacgcacgcgcacacacactgcacacacacagtgtgtgtgcgcgcgcgcgtgtatataaaaacttttttttatctaaaatataatcatatgagatcttgctagaacatagaaaaacaccacgtacaacattgcaaataactatgtgaaatatgaaccaatatttgttgaaacatcacaataacactgagtgcaacacaaaaaaagacgttaaaaaaagtcatcagcacagagtgatgtgagatcgtgttacgaagatttagttgtagcgaatcaaatgataaaatttattcgtagtttggataaatagtcagagagaaaaaacatttgaattttcaatcaatatggacatctttcctaaatctgattgcatgcacctacacccatatccctactgttctcttagcctaagaagcgttcgattttttccttccgcccggacggttgattagaagcattctccaactctatcttatcattttatatatcaaagttctttttaaccaagtgagaacacatgaaatactccaacacccacatatatagttcttttccaaaataaaacaatttttacatatacacctggagaagttgaaatatatcacatatgtctaaaaagaatacatttagtttaggctatgcgataaatatttgtccaagtgtgcagctataaataattatattttagaacagagaaagtagtatatcactatagtatcatagatacggtagttctctacctaagaaaagatcccagtcttctagcaaccatgtactcaaacgatgctagtacccgcaaaacaacttgaggcctgatcttataaaaaatagataataagccgtaaaacgacatataagaaaaaaatagtttgagtgttttttttatatccatgttatttatagtttaagagcaaatattgaaaaataagctatgatgaaaaaaaacaactctaaagctagattcattagagttcatcttgtaaaaataatctttaaacgaattttcttctaaaacatttttttttgatttaccatccgattacattgttgtatttcttacaattaaatatttataacaagatctcacacgattatattttgatgaaaaaatcaaatgttttttggccagttttaaaaattgttttaattcactatataatatacatgtcatagatgcaacattcaaaatatactaactacaacaccgtcaaccacaaatgaaacaaaaaaaatgtaactagttcatttcaaatattgcatgttatattctttgaatgtttcagcagttaccagtaaatgtttcatatataatataaaaatatctcaattagaaaaataataatatattatattattttaaagatttaattacaatggatatgatggtgtaatcggatcatatattagataagtaatttaggagaaaagttgtttaaaaataatttgaaacttgtcaaaaagttgtttatacgtgcatgtaagagacttacatatgcaaattatgagagagaaaaaatcgtgtgtgtgtgtgtgtgctgtgtagtactacactacaggcccatctaagagaaaggtagagagagcacaactagagaggcgggagcacaaattttacatactcactcgagagaattgcatatgtgttgtgaagtagtacatgaggagagggcaatcgagtcaaaaataattcaggtgcccgatttgtaattgcttcaaaataaagttggtgagaattttcacccaagttgtgaagaagtatggaaacaaaacagccatatgcataatgcattcgtagttgggcaaagtcatccttcaagtctagaattatgcaagaccctgctgatcttcccggtatctagctaggcttgcctcgggattgtcaaataacatttcttctgggtcatacaaataaagctcagacgtagcatgctatcatgctcttctgttcttacaacgtgaaacaaagctatatcactgcctccatcttttttgaccagtccacattcttagttccatgcaaaaacaacttgataaaatgatttgtttccccctttttttttcatgtttctaccgaagaaagacgttccaaaagaagggtgaaaaaaagagagagttaaaagagagcaaatgcatgccatgatatatgtgggttgatccagacctttttctgccatgtacgtagctagtcatatatacctccgatagtagaacatgatgcgcctagattgtaaaagagatcaaaggctcaaagctctctctgtatgactgtatccttggatccccaactagtacttgagctacatatgtaggttaagtaattactaaacacatctttttgtgtatatgtaggttaagtaattacttaatttgccgtgcatgcaccatagcaactgtagcaagtagtagctgagctgcaagtaggctttaatttgaaggatccaagaactgcttgtactaagtcccacacgagctagacacgtacaactgatgaatacacaggtacgtagtaggcagtacgtacatacataagcatcagtgctgtttaatttcttctcaaagttcatatatatgagacacgacgaggaaaagagggaacttgtcttccaggccttcagtattacaatccattcaaaatattataaggaaaaagtccatataaccccctaaactttggatgaaagtccgtctagcatcctgaactttgaaaccggacattctcacattgaactccctaaattggtacaataccatttatacaaccctctaagatggttttacatattggttttttttttatctaatttgtatataagttggatgagtttgatcacatgtcatacactttgaacatatatgtatatattaaaattttgacttaaatctttcttttttctccttattagctctcacttacaaataagtaccaacatagtaatagtatgatatcattgtataggaataaattgatgatttataactgatgatatgcaaatatgttatattagttattcggaattgttcatttaagctttcaaaatatgcaaaaccatcatctgaaaccaccttaattagggggtaatatagatggtatggcaaagttcaggggattagatgtccggttttaaagtttaaggtgctagatggatttctatctaaatttaggagagtatttggactttttccttattataattattagttgatcaacatcaaggatggtccatgtcaaatctggactggataccatcatcggtagctacttcatttcaaatattacatattactccctccgttccataatataataatgtaagattttctagcattgtccacacacatataaatgttaat

SEQ ID NO: 23772 - DNA, 13418 bp, Oryza sativa
  unsure (1)..(13418): unsure at all n locations
gtagttgtttttcaaaaaaaatagttccgtcaataaagttctagaccgaaatctagatcacatgggaacaatagcggaggaaattggtcggatatactaaaattaacggggagttgccctttataattaatcttgcttttagtgagaacagtggtggagcttgcatgttatcgctaagcggatcactagatgatggtgtgtggtccaatggaacactttatgtgatgaagttatgctgacataagcgtagtgccttaggtatcagatctaatactaaggatatctcagatacgatactcataaaaaaagggtttcgtacatatatagataccacgccgacgttaatacattatcttatatactagatttgatactggaaggatactagacgcaatacccgtaaggtactatgctaataacataatgatgttagaatacataaactatttcattgaaacggcacattgttcttctatattatttctatatcgcaaaaggaaccatggtaggaatttgtgatttttggaccgtgagatttgtgctggctgggaaaaaaattgcttatgagcgcgggggagaggttggaacccacaatctgtaggtttgctgctgcgctagcacagtttttctgacatatttacgtacgtaatttaaaaataaattacattgtagatacaatcaagttacaacgaaactaattagttatatttaaaagttttcttccaaaaaaaatagaatgttatatacctatttccataaataatatattggggaagtagttttgagagtaatgtctatgtgacatggcttggtatagacaccgttaagtgatgtagtttagacacaatatcactttgtgttggaagacatgcagttcttccctcttcagttcgttaaaaaaaaaactcccaattggcaagtataatgatcgatcacaaaacccttttttgcgtgtttgtgtttttcctctagcttctactccctccatccaaataaaaggcaagccctgggtttccgtgtccaactttgactgtccgtcttatatgaaatttttttataattcgtattttcattgtggttagatgataaaacatggttaatattttacgcgtgacttgtctttttaatttttttataattttttcaaataagacggacggtcaaacgttggacacggaaaccagggtttgtctttttttaggacggagggagtatgttatactccaagtaggttaaaaaagtttgcagaaatggcatgcctttgtgacaatacatgtgggcccaacgatcctattgggtagcacaaacctgtggagatgattggacgatatgaaatgttgggtccaaattatttttctattatgaaaaaaggttcacatgtaaacaatctgatgtattaattcacaggaaatcatcagtaccctagctagccaccgcttgaggtgcttttagtagctgtagctacttcaaaatctccaatggccccgaagagttcaaattcacacttgattgtgaaactcagcaggggagtggattttcatccctcgaggggatatcccctcnnngnntgcntgtcncccnnctnnttctgaactncttcttccctcttttgcaaaatctcttaacatgtgatatatcactccacaaatatgtaagttcaagttcaacttctacatctcgtaacgaaaaaaacaaattaaactacaactagttaacatatattcacagtcaaatttgtttttttcgttgcggggtgtaatagttgaatttaaacttgtatgtttgtagagtgatatatcacatttaatacatcttctcaaattttttcgatttttttcataactatttgggtgatatgcaaacaacgaggggatatcccctcgggggatgaaaatagtttcccaactcagcagctgcaaaatccaaaatatgaaagctccaagttcgatatataacttctagcgtcttcatattaattctcactagttgaatattcacaagccttttcagttggatatgcttctcagaacctttgtcgcctcaaacagtgaattcagcacacatgttcaaaatatagttatacccattatccaaaccgctgtgtagatgaaaatatatttgatcaccaccaccacaaatatataacagagctccatcttaacgaagctcataatatgccattgtccaaccgcaccaatgccatgatcctctaaagccaaagttaatactagaaacaaaaaaaaccatcaaaacaaatgaaaggaaaatctaattagacgagcaatgagctagctaccctagctgataaacatggatccttcatgtacactagtgttacatttcatcctgccttctgaagagcagcacccggtcgaccgccgtgagcagacagacatcaccggagctgagctcatctgctgcttgatcgctctccatgtcaaggttcaaatcgaagcaagaagagggggcgcctgattcgatttctaatttgtgatcatgatcacttgtgttggcttcctctttctccaccttcatcttcttgttcatcagcggcgagccagctctagacctcgcctcgaagctctcgcagctcaggatgatgatggcgtcgcccacgccgacctcgtcgccggcctggctccggagaacccctctgtcgatggcctccttgacgcccacctgccagcgatggtcgccctgctcgacgtcctcgatgaggatgacgcggtgcgggttctccgagacggcgtcgtagagccgctcgaggtaggcctcgctcgccgacgacgtcgtcgtcgtccgcggccgcttgctccggtggtgatcctcggtggagcccgacgcggacggcgaggaggaggaggcgccgagcttgacggagaggaagctcttgcgtgacccgaagacgaggccggcgagctccctcgccaccctctccttgccgtgcccgtcgcctccgaggaagaagagccacgtctcctccttcgcctccgtcgacctcgacctgtcccgccgcttggcgatcccggacctgcactggaggacggcgctcgccacctccgggacgatctccttctgccacggcacctccttctccagcgcggcgcacaggagcttcaggttctcggcgttgagctccttgaacctggaacggcactccacctccaccgagccattggaggcgccggagcagtcgtcgtgcgacttggccttctcgtcgtcgtcgtcctcgcgcttgggcttccatgggtgcttggcgtcgaggtcggcgagaagccacgagtggtgaggctggtgctgctgctgctggtggccgtggccgtgctcgtaggaggagatggaggacgccggcgacaccggcgccgagaaatgcagcgtcatccgctgagacggcttgccgcagatggatccccatgtcttgccaagatccgcgaaatgtgtcgactcctatcacgagaagacaaaaaaaaaatcagcaatgattgaccgattaattaagataaaaagattagcattcgatcgagtggcacctgcagctgctggtcgcggcaatgctggagccaagaagggaggctcgacgacgacacgaaggagcggggcaacgacgccttggtgtcgtgctcgtgcgtcgtcgtcgcggcggagcagtcgccgccgcagcatctggagaggaggtggctgccgcccaaaagcggcccgcaagacggcgccgggcggttcccatcggtggtgtgagggctcgctttcatggactgattgactgcgcccagcgcgctgcagaaagaataacaaaacggaaattagattcctgcacacactgtcacctcaccgatcgacatgtctccacaagatcagctaaactgatcatctttgtcagccgctgtacctctgaaattgtattgtcgatatatcatgctctcgtgaatgttcaaataatgcgatattagaaaaagagaatgtgaagctgatgaggagctatagattgacctaaagcttttgcccagaaagcacgcaaaagatgcaaaagctttcacccgcatggtactgaactactgatgcttactgattgctcagtaacgaaggggtcagatcacagagaccagaggcatttcgtttctgcaaggccggcgcgggtgcatgattcgttcacctgacgtgacacgctgcgccgcgagaacttaacaaactttttttagatcgatcggatgattttttacctgtcgtcgaaggcgcaggtgaggctcagcgcgaggctgccggcggggacggcgagcgtctggagcccccacatgctctccagcgacggatgccccgccctgcacttcatgtacgtctggtacgtcccgaacccgacgagccagatgccgccgtcgcacgacgccagggcgcgcacctcggtgacgacgtgctcgacagagcagtagtagccgccgccgccgccgctgccgaccctcctggcgccggcgtgcgcggcggcccagaagtcggccgcccacttgaggtcctcgacgacgaggagcacccgcgcgccgcggctcttcacgaggcaccggagctcggcgagccgccgctccgcctcctccctcggcatgtcgcggaacgacgacacgcggaggctgaccacctgcgcgccacgcagcgcgtcgtgctgcttcgcctcccctctcctgaccctgtccacggcggcgcgcgccgtggcctccgcggcggccgtgctctcggcgacgacgacgaccctcctcctgctgccgccgccgccccggccgccagccgctgccggggcaaggcagtcgagcaccgcggcgatgtcctcgtcgcgcgccagcatgtcgagcagtggcagtttggctttgatctccggaggatgagccgggctggtggtggcggtggcggtggctgcggcgccggtgcagctagggttagggttttggttcggtggcgcgctggtggccgtggtggtgctgcacgcctgctccacgttggccttgacctgggtgctggagaagccggcctcccgcatgacgcggctgacgctggggtcgtcgaggatggagacgacgagctgctccagctcgatcttcacggcgagcaccggctgctgctgggtctccacggacccgcgccgctggtgcgcctgcgcccgcttgaacgccgcgacgagcgcgttggagagcgacggcgggtagtagtggccgtggtggccgtgcccgtggccgccgagcagcggcgacgaggcgacggcggcggaggccgggaggcggttgagcgccacgttgaagcagagctccagggccttgcactgcagcgggtgggagtgcgaccggaggcacgccgcgcggaggagcccccccggcggcgccagcatcgcgctcgccacgtgcagcggcgtcacctgcgcgttgcccctccgccgcgcaagggtcaccgcctgcttcaccacggcggccgcctccgccgtcagcgcctgctgcaccgtgcaccccccggccctcatctctcacacgtacaccacaccacctagctagctacgtatactacaagaacctagctaatctagtaatctatcgatttgatgtggcaacggtagtgtgtgaggagaagaaaaaggagaaggaatgagatgtgcagatatagaagggggacggaggtcactgctgcttcagctgcaacctgcaagtggtgggaggatgcagtgctgctttatatgttggtgaatgttcatcttttgagtagctagagggggggtgagaaggtacagaggttgaaggaaggaggagattatggtgtgtggatttgtgcttttcttgttagggagggctgcatagttgttttttctttctctttgggctataatttttagggtccaaagtggattttgtggtgggaaagaaaaagttggctaggtagaatgcatgtgctgacaaagcagatacaaaggccccccagctttcccctctatctctctcaagtctcaagtttcaagcaaggcgttctcacattctcatgcagagggtagctagctaggagatcatatggattgtgcacagtatctttgtgactagtcttctgtatatgatcagctgcctctaaagaatgacctgagctaaattctatgcgttcctgcatcaaagtgcgcaaagccgggcgaccataaaatttagaacctgatctagaaggatttggtgaaatgacaagtgtgcattggtcattggagcagacaaggtgccttagtaatgatatttttcaagaataattgttccatgtaacaaagtaagcgcagtaaagtgtgaatataaggtaaacataatgtcataacccctgaaatttttttcattatttcagagggtctccattttctcagggaaaaatatcatgacatgcagcacaattaactcacaaccatgtttggtgagttgtcactataatatatagttgtggaatcttcctttctaatctttatgcaactagatagtaaaatggcaaattgaagaatccatatatactttgggatactatatttagtaataagagacaaacctttgctgcaactcttacctgatagaatttatgccttccctacctctccatggctccatgcatgtcaccatatgtaaacaccaatacatctcccaccaaacctattagtgcaaaaataaaacaaaacgaaaggaacgatccatagcaaaactacaagtaacagcttttgccacttatcttttgcaggttatttctccttttctcatacattgttcaggtgggacaggttacctatctcagtgtattctcttcccttacccatcagtataatatctaaatttatacttcataccacaacttcattattccccgattggacatatgtgacaagtggtattcatgataaaatgataaggatacatgcacaagaaattcatgagaaaatgatgagaatgaaagaaacaatggtatgggataattgttggtaaaccgaattattggcgtaggtatctagatgagaactaaatttaccccaagcaacataatgaattgagtacatatgtacagttttgttctatcacacatgtacatatatagaagcacgtctgtctaggacccatgcatctaactaaacagccactagctgaaaatacatcaaattgaaaagatgcatataatgtagcacaggtatagtacgtccgcatagcctttgttttaagagagggcaatcaatatattcatcatgaaggaagtacatacatacttttatacctgttcactgctcgtcgtatactgatacgattgatcacattactaacagggaaatggggctgatgttgcaatgatgacgatacaacatatgatgctttatgtgatcgatacgatctgatgtggcctgcagtgacctctcatcttttaagagggcccatttaaattggttttcttttctgagagagagagatctttgtgccctaaaagaatcgggaactgtgtacggcctctttctctctagactcaaagtatatggaataaagcgtccccttattgcccatatgctctctgtagactgtatgtgtgtatgcatggaaagattagaatcgctcacaattactaggagcagtaatgcataaaacagccacatgctgttcagcaaagccggggcttttcagcattcttgttccctaaaaagcagactacattactagacacaaaaattgaaacattcactaattaagtttaggcaactgctgaaggttcagtgccaatgtgccgaatctacgagtgaacagaacaaatgtttactactaatatatggcaaagatagcactgatcaagatcaacatgaatatatttgcatcattattaattgcatgattattgacatatataagcgccgctcaaatattctgttgtactgcagtgttactacaagcagaattaactgtcaggcaaaagccaaagtatgtagttaaaagcacgtttacagcatcattgaccggtcattactgcgtgcatttgcatcaaaagtcgtgcaagaacatagttctttatggggatacgaacagggaaaaggggtcgattaaacagccagcaaaaacaaagtatcaaaaatgacttccccctcaagccttcccaacagatccccattcatttctcaatcatcttgtacgagctagtgaagtgcaatggtgtatgtgcctcttcacaacaatcagaactgggcctcgcattgatgtcgttgagttttcacaaaaccaatatatagcgactagtagtgattactgactacttcgaaactcttatatagtttctgcacagataaactttcaccttctttataggattctggtatcaatgtgttacacgctacatatgcaaagcatggtctgttcaaactaatccgaggcagtggtaagtggtcagtcaaataaagctttggtcacatatggcccaaaaggggaggaaaaggccaagccctaatcatcacaaagccattgccccaaaaggagcgcttcaaggaggaaagtatatacacagtttgaggatcgaccccggaacagagaggagcaaaataccgcaaaagaaaacacaaagaggaaagcagaaaagaaaccgtaatcactgcatactcttcttttgatcctttctttccttttctttttctttctctagttacataaggcagttaggctgctgtattagatctgtacatggcaaaggagttgtggtatgcccaggaattaaactaaccctaagcattgtgttgctgcaagcagctttttaaagtggagcaagaggggatgctaaaaagtgcatgagtggcattatctgcagaaaagcttcccaattttaatatccctggcgcactggtaatgggtgcagcacagaagctgcggcaggagcactacactaccactccaggggcctccaaggtgaagaaaaagtgcttgtggttctgccagtgtaattataagcgtggcttaggatatgcagtactagtgctactattatcttgatttattctttttatatgagattaaatatgtgccacagtgccattgatcagcttattgagataagaacaggaggaatatcatgtttattattaagaaaaaaaaagaagtcattcataaagttaggggaaaggagtactcttaaaccatattcagatggtttggagcggcagaaatccggtgaagatgattgcttccagccctgtgctgtccactctgtgctggggttccattttgttaatttacctaactttgttttctcatgacttcctgctaaaaagaagcaattgcgcatgagcaaaagtttattttgaaaagttagaacatagatcagacatatgtattcaacatgcaaaagatacaataacagtgggaagggaaaaaaaagtaggtgatacttacagtaagagttaagacacatatgggccagggtgttcatgccttcctaggctggcatactgggccgtcctcaagagcgcaaaatggaggacttcttgttccactttataagcaatgtgcttgccatttagattgaaacgcttccaggtacaaaagagccaataacattttattaaacattacacagcttcaagtaacttcttgcataaaaccttaactagcatttcttaaaaaaggtgactagaatcaaataagattatttttcaatggttgaattttcctttttaaatgggagcagaacaaatccaaaatgaaacacaacaaaactttatttgcagaaagtcaatgtgtccacataactgcaatttcgatcataagagcaatgtgtgacccaacaaaggctatggcaaaacttgaccatgaatgtaaataaaatgtctaaatagaagcaaagtactccttgctgtccttggggtcaggcttcattgacttctccccaggtttccatccagctgggcaaacctcatccgggttttcttggacatactgtagggcctgtcaccataggaaaacaaattacgaacttgcatatttgcaaaaaattttcctatctgactttgtcactcacagttataactagttgagcaatttttgatgttatagacactagactatggtaaattcaagacgaaaaaactgccaagatgccatgtatattgaaaagaaatgcatgtttgcagatgcaattttattatcttgctattctacctgaagggtcctaagcgtctcatccacgctacggccaatagcaaggttgttaatggtagaatgctgaatcacaccctccttgtcaatgatgaataatcctctcagagcaatcccctgacagcagaaagtatgagctcttatgagattaagaacaaggaatacatgacaaaagactttgaatacaaacaagtaaatatccagaagaaagacatatattgtatatatagccaacaggcagtcataactgaagtatacctgatcagggattagtacaccaaaagactttgaaatctattatattattaaaggaatagaaaaagaagcctccacgttcgctctcatggtctagaaattctcacattaatctaagaaaaagaaaaaacagagtccatatagaaatacaattttaataatagctgaaattcggaattaaaaataaggaatataggaaggtaagactagagtccatgtcggtatacaatagaactaatggaaattcggaattaaaaaataagaaaaattaaatatagaggttagagtccatctagaaatacaatttagaaataaaaaaattcgaaataaaaaaatatatattggatgaagaatatagagtccatatagaaatataatttaaaaataattaaaattcagaattaaaaaatattgaaagataagtttagaatccatatatagaaatacaatttagaaataatagaaattaggggcaatagaactaatgaaaattcggaattaaaaaataagaaaaattaaatatagaggttagagtccatctagaaatacaatttagaaataaaaaattcgaaattaaaaaaatatattggatgaagaatatagagtccatatagaaatataatttaaaaataattaaaattaagaattaaaaaatattgaaagataagtttagaatccatatatagaaataaaatttacaaataatataaattaggaattaaaataaggaatattagaagaagagtatagaatccatataagaatttaaaattcagaataaaactaataaaattaaagtagaatttagagtacatatagaaatacaatttacaaataactaaaattcaaaggaatattggaagttcgctctcatgaacacacacaaaattatgttgttattttaatatattttaataatacattgagaaaacatatatgctattataagagaaaaaaatataatgatgctagccgcgcaatctgcgcgggccactatgctagttgatttggtgacatcggaaatcagttggtatttagatcaccaagaccaccggatttcctatctgtctgaatccatgcaagatgggaaaactgcaaacaaaagatatttcaaagccaaattagtatgcgacacttatgaagcataggttgtggccacttattaaatatttatagtcgacagagtaacagtgaatgatacctataagataaaaaaaatgaaatgcttaatgcagaagcagaaagagaggatagtaaaaaataaattacagtaccactactgcctacaaactactcactgtaatagtagcaaaatcaatacttttactggatataatttgtgataattatttgagtatgcaatgaatctccttggcagaagcaaaccagagtattaagacgttacatcagtctcatttctcaaagttgtttcaaaataactgaattgaatgtttataacgctattgtctaaatattagagagcatcggtttttacttccattcaatatttccataaggcataacaaacaccacacatttcattataatacagaatgaaagttcaacacgtggcaatcttatgttaaaacttatggcctaatgcaagggttcatctaatgctctatattcagacgttaagaacaaatagaatattgatcacataaagaggaaagctaaaatattgatcacaaccttaaggcattcaagaaaccacaaatattgtcaagagaaaagctacatgtccagatggaatggaaatacgaaattctcaatagagcaacagaccaggtaacgacaccgtaacaacatctaaagtcatgcgggtaaaagttagcataccacactgtcaatcgaaacaccgagaacttcagtatttatcttctcaaactcctcatatctgtcgctgaaagcagtgatctctgcagagcttacaaacatgcatttagactttaggaatgaaaaaaaactgaaaaaaaaggcatttccatgacagagcacgacaaggtcaacgcatctgttggacagacgaacgtgaagtccagggggtagaagaacagaaccacatattttttccccaatatactcagacagcttgacctgacctgcatatacagaaggagtgaaggacacgaccaacgaagatatcaattggaagcacgatcaaccatacagcttctacattaaacagccgtggatatggacttaacatctaatctagactaccaatcgaatagaccactttttttttcttttggcctggcccaagccaattaatcccctatgatgaatgtaaaaaaaatttgataatttcacacttttttcgttgcccaattactttaattgacatttgtgaggatgacatgtgggaccatatgagtgaatgaaagtgggctaggatgtcaatttatcgaaacccattgaaaagagtgttaaattatcaaatctcacggtgaattacactgccaatcaaataggccccattttttcctgggccaattaatcccctatgtcgaataacactgccgcgcgtgcgtgcgtggcgcaatgtagctgtgcatgtggttaccggattaccgccataccttgatgaacccctggtcgaacatggcctccgcctcgaagtccggcgccttgttcccgaccaacggcaggtccccctgcgcacgcacacacgcggccgcgcgtcaatcccaactctcacagaggcaccaataccaccccaaaaaaatcaaacatcaaatcgcgccgaacctcgcctccggcccgggcgacgaagctgcgggccctagccgatctcgaggcggcggcggcggagaggcgcagggacttcccggcggagaagggagcgggggaacggcagggacggctgcgacggcgcggagacgggcaccttcggggaggcgagaggcgccgcggcagaggagacggagaaggcgcacgccatggccgtggcttgtcgaggtcgaggcgggcgggggtttgggccttgggggggggggggggggggga

SEQ ID NO: 23773 - DNA, 18376 bp, Oryza sativa
cggtggggtgggcgcgggcgggcgctgatttggtgccgcaatctgtttcagccctcgtcgttcggcctagagacgaggtccagactgctcctttcagcccatttgcagaagactgcgtttgttctcttgagtacggaacatattttctccgcacggaaaatagagcgaggcattatgttccctccgcacgaaaaatagagtgaaacattttcttatgattaatttaatatttactaatttaagtagcttttgtatataaaccttgtgaaaaaaacacaccgtttaacagtttaggaagcgtgcgtgtggaaatcagggtggagggagttgggaactagctactcgagtgaaggtggaagagaaacgctgtcgctcgtcggccatggccatcgacctgaccgcacgccgctctcgtcatctccccaggcgcgggatggcgggagcgggtggaaccgtagcgtaggttggatatccatctgaacgttattgattccgtcccctcctccactgcagttcctcatgcttttttctgacctctgctctttttgttcattctcgcatcgccgacgacagagtcgattagctattgcggtgttgtttttctccttggtatactaatgggccgaatggagcgggttagacatcacctccagatcaaacaacgaaggctggaacagatgctgccttaggatgcaagacgaacgggaatctagtctcagactttcctctgacgtagaaccattctacgtcagaggatctggtaacgtttgcgaaatggaggaagatgtttaaacgggtgacgtgccgccctctcagtggccacagccagtgccacgtggattgggtggttcggtccagctcggcttttttttgttggggattctgatgctttgacgatccatggattcgagaggtttggatcctactacttcttggccccaacagaagctcaacctaggttgcattttataggacgtgaggataaatgataggaataagttcacttgtcatccctcaactttacatcgaggctacatccccaatccccaatactagatatgttaacccctcaactgttcaataccatgcaaagtaaatccctcgacagtacgaatgcctgatttagttgacgtggcatcctatttagcaacaaaaattaaaagaaatacgttaggcctacatgtcagccccatcatccttcttctctttttttccccaacctaggagatagggggaggtagcccaacgccggcgggagaagaggtggccaacatgactggggggagaggggggagaggcaaaagaaagtgaaataggcgaccaaaagccgccacggcgccccacctacaaggactgattgaccgagacggcgtgcgcgaccaacggtagcatctccctatcgcggcgggcgcttgtcattgcggtgtcgccttgactcaatactaccgcatatcttgccgactcctctaacgagcaccgcaagccgagcagcaaccctcccgccgccggtgatggccatggccggtgggacggtggctgctcccactgacgaggccggccgcctctcccccctctcccgtcggccgctcccgccgccccctcccattcccacgccggccgcctcttcccccaccggcgtcgggctgccttcccctctctcccaggctagaaaaaaaagagaataaggatgatagggctgacatgtggcccccacttatttttaaactttttttctgactaggatgccgcgtcaacaaaaccagacatccatactgtcgagagacttacttagtatgattttgaacagatgaggggttagacatttctggtattggagattagagacatcatacacactcaatgtaaagttgagggacgatagtgaacttattcctcatttgattgatgtcagccggagctgtgctgcggcgtaaatgcggcccattcaagtcctccttgcatgtacggccgatggagtcggtgaattggttcgggcaggacttgacgctcgccgtcggccggaatccggattgctctctctaacgccggtggcggcgccatcgatatctttgcttcgcctggtcctagactcctaggtgccctcgacgaagacgaagatgggtgttctctgaatgctgaacctagcgggggcagcgatgagtcggtgaaacaagtttaattggaggcagcggtcggagcgtcctatgcacgtcacctacgggcggtggcgcactggtgtcctataaaccggaggcggtgtttaaaccccccccccccccccaacctctgttggggactctacgggatgctcgattctgttgtttgaccagatcgattgtatcaactaattgtcgcatgtctgtccggtactcattgtcacgtaaaaaaacaaatctacaacggtatatgatatatattaaggctattctcaacccaaaatactagacgtagttttcataaactccacatcattaagaaattagtactagacactactcttccaatgcaaacaccactatttcatacttaaatttaatgctacttatctcacataatgtcttggatgtttgtgtaaaaaccatgtctcatgcaagacatagtttccttctctttcctcatttatttacttaccacatcatttttcatcctatgtgacagcttatttaatgctatggacatcatcctagtcattgggttggaaatggcctaatactacaagtctaaacagaaatcaatcctggatgaatctaatttaggaattcaaggtgccatctacgagacgttggaacccacttacagcttagtgaacagtggtgtgtagtgtggaactgtggatgcgtgatcggcatcatgcatgataaaatgatgaacctatagagatcatcttttgtttgcactattatgcagaattgcacataaatttgatatttgcagtcaccttttttataattattgaaattgtacaataatttgctgtgacactaatatatacacaaaataattatttttgtggcgaagtgaacgtagctcaattagttaggtttcttgtggttgaaataattcacacgggttcaaattatagattttatacgagtgcttatatgataggtatatacgtatccgtcgatagcgagatgcttgtgatgacttcatcaatttcaagatatgtcggtctagttttctaatgacttcactaatctcaaaatatacctggccaatttttccaaagatactaaggacctatttggggaagcttctagctgttgcagtttctcccaaaatcagaagccccctaaacaatacaacttttggtacaaattctgagaagatgtagttgtagaatccaaaataaactagaggccagaagctgggaagcctgactttttcagattctcaaaagctgactacataccagccgcttcttataatcgatggtgtttggttgcaaggacgggatgtgatgaacccactttttaggagtgtttggttgaggttcgagtgggttgggttgatccatatagatgaatattcctctcaaatttgggaccaagccatccggcaaaatcggccggacgaactcatcccacttggatgtagcacacggcgtcaacttgcctctgcatccgccatcgttgttcacacctgctgccacctccgcgaccgccggcactccgccatgaccagacgccgccacctccacgacccgttgccgctcctccgtctcctacgcgagcggctaccgcctctcctctgcgagcgacagccgcaacctcgcctccgtcgcctctcctctgtgagcagcagctgcctctcctccgtgagcggcgaccgcagcctcggcttctccatctccttcgcgagcagcggccgcagctgtgcctcatcggtctcctccacgtgcggcgaccacccctctgcgacccaccgcctctcctccacgagcggctggcgtcctccgcgatccgccaccacctctgctccgcgagaagcggctgccgcctcgcctccgccgccttctcgctcgtctgtccgcctgttggtcgccgctgctcctccttctgcctgctcgctcgttcgcttgtcgagtcgtcggccgcgccgtccctactccgcttgctcgctcgccgagttgctaggccgcgcctattgggatcggacgtgggttgacggtagccacaaatagcgtccatcccatcactccctcatcttttcaaccaaacaaagaatgatcctatcctatgaaccaaacatacgtgtgaaaaatcatcccatcccatctagttttagaaccaaatacatctaattctagaaccaaatatttcctccgtttcataatgcaagtcattttagtatttttcatatttatattgatgttaatgaatttttttatgggaatactagaatgacttagtgaaacagatggagtacatgtttaagctcccaaaacagcacttagatgtgcgtgtgtatgtttatacggaatcgttttattttacatgggggatggtgaaatttcctcctaacgcagcctagaccgccaacaacaaagccgcgggcgtaggataacaccaactaccacgcccgcgatattttgcacgcagcccctccatgaagaagccgtgtctcaaacccgcgcccctccccgctgccttcccttccagttccggtcttccagtccacatccacatccatccacatcttcccccctacacgtccgcgactcgactcgcgaacgcggctaaaaatttccctcccttccccccaccctcgtttcctcctcgcattctcgctcgcacaacctcgcgcttttcgccttaaccccgccgccccactccccccacctccccgcctcgtcgccgcccgccttgccgggaccctagctccgtcggacgcgtccgggggtggtgatcgcggcgcgcccgcccgattgggcgcttctcgcggatcggaggcatgtcgtcgggaggaggccgtccgccggcggcgcagcacatcgtgcggtcggtgcggcagcggttcgtgccgctgccgccgccgctggcgcgggcgcccttcgcggcggcccccggcgattaccaccgcttcgcggcggcgtcccggggcggcgagatcgaggaggggattgtcatcaggaggacacccgtgagttgccgtttttgagcttattaccgaagaggtttttttactgtgtgcaccaattgattggctagtttttgttttttttccttctcggggatggtttctgtgcgggtttctgaggttttgtgcggcagctatttggcggtacaaggtgacatggcggttcaattaaacggcatttccagttattttatttgggggtgttggtgtagattaacatgtggatttgggtgaattcgtgggcggcttgttacagtcgccaaatactttgggggaagattagaattactactgtctatgaatctatctattcagtcatgtggtattgacgccaaagtggaaggctttgtgaaatgtctgtcttctggtatatttttgttttgggttactgggtaatagctcttcacttatccaagccacccacttgaaacttgaaaattgcattccgtcggcttggatagtatgatggtactataataggatttggtactttctaggacatgtagatgtgtccactgctgttttaccttagtcgctagcagcttggaagataatgtcagcaattcggaaagatgcttctgtcatgattctaaattggaggacaatgtatctgaatgacgtctgaaatgcgtattctgctagaagttgtgttcatctagtcatcttcagtgcatttgctaggaagcagttttatttactcgtgattgagagtatgttagttattgggggtcctcatggatcacattggggaaatactctcctccatgtggaaatgcacaaggcggttgtagcggcaaacaggtgtgctggtgcagaaacacatatcatttcacaggattatgaaatggatattgctgatagttatcttccaaattcaatgaccaccaatcatttcaccaaagcagttatacacctatgcctgccattgcttgtacccttgcaagtgttttcttggatcatgagattgtaatgtaggtgttgctatttatttttatctagcttattatgattcatgtgttaacttgttaagttttcaattcgcttgagttgaccactacataatactattgcccattttacgaatgcatgatccccctttatgtgcatagctgaaaagaaaaactccatgtggagaaagtgaggctgctgagtcaagtgaacgtatgatgactagccctgggtttactgaaggagttggcagcccacttatgaccccagtttctggaaaaacttctaggacaaccaaatcaatggctaaattcaataaagctggacctcagacgcctatatccaatgctggcaagtagaaacttcctcatcagtgacattaattaagttaacagtatttgtttatcacagctttgttctgttttctttatacttgtttcctgtgactaatgcaatgcacacacatttgtatctgcaggttcacctggaaatccatccactcctgccagttctcgctatgacaattcattaggtgatcatagcagtccctcacctagaactttcaattgtggaaatctaaatgttaaatgtaccattatgaatttttggtgctttataaatgtagtcacatcatctcatttgatacagtttactctctttttaactgacagctattcatgtgatgtttgttcaggactattgaccagaaaattcattaatttgctcaagcagactcaagatggcattctagatttgaatgatgctgcaaagatattagatgtatgggtaaaccccccccctctctctcattttaacagtcatttcttttcgttagttttgctacaggtttatatatggtttccaacaaaaacaggttcggaaacggcgcatatatgacataacaaatgtactggaaggaacaggtttgatagaaaagaagcttaagaacagaatccgttggaggtaatctttatcttctgtttcccttgtatgcttgtatttatggtgtgagatgctaacctcatggcatcacaggggttcggatgactcaggaactaaccttgatagtgatatttcatgtctcaaggtacctgccggtctacttttctcatttacgcaatcatgttaaaatctatatactcatggcaaatttatctgaatgtttgtaaaagaagttctgagtctaagctgccttcagtgttcttgcagaccgaagttgaaaacctttacatccaggagcaagctttagatagaagtataaggttggtagcttttggaggttccaaaatctgaaaattatcgacagtaatttcttatgttcctgattatttgttgcagtgaaatacgggaaaagatggaggagttaactgaagacgaaagcaaccataggtagtgatgttcctgtttgttgggcatgctagcatgccatttttttttaataattttcactttgcaccgagtgaattgacccaagtttcactttgcactgggttttgtgaatcctttcaccatatcccattacaccttacaaccatcatcctccctgcttgcttctacttgatctagatcaaccaccagtcaaccatctgacatcatagacttatcatgcacaaatttccaccattcgtcaagactgcagcgtcaaagctggtgttttctgcaacatatcttctctagaaccggtgcaaaatggaagtattggcaaagcctggtggaaagttaaactcgtgacaatttacctgttgcaaattgtaatatgcttatactgtgcaatcatgtactgagctatattttttgttcctgtttttaggtggctatttgttactgaagatgacatcaagggactgccctgctttcaggtttgtctatgttattaaggaaggcaatattgttattgatctaattttgtttaacataaaattatgggggctgtgctgaattaaaattttgatgtaacttatttggcttttctcattctgcagaatgaagcattaatcgcaataaaaggacctcgtggtactacagttgaagttccagatcctgacgaggtaataaacactaaatgacttctccatataaacaatacttgatgatcaactgctactccctccatttcatattgtaagtcactttgggtttgtcctaagtcaaacattttcaagtttgcgtaagttaggataaactcaaagtgacttataatatgaaatggagggagtattaattatttcattttttttctttccataagcaggctggtgattatctccaacggagatatagaatattattaaggagtacaatgggcccaatagatatttacttggttaggtaacacttcattcttctcttgaagcttttgcctcaaaagaaattatctgatgaacacccttactatattatcagtcaatataagaaaatggaggagctaggtgaaactgcaacacctccaaggcatgcaagtgttgtagagcctccctccatagcaacagaagctggacatagcagcaagcagaccatgccgttgaatgttcagcaggatatccaggaaactccggagcttaatgcttcacgtgcttttggaaggatgaagaagattactccttcagatgttgatgtaagttatgttctaaaacatttttatgcaatttaaattagaattatatggattttgcgttttataaaaataaattcctgtgcagggtggcagaactcatgatcatgtcattgagctaaaaacagcatcccaattcacacatttgaaaattttgatgctgcactagctgcataattttgaactcccctagtatcttgatttttagtcagcagctttagttgaaagctcaatgttacagaacttcacatatggacgatttagtatagcagaagtgcaaaaatatcttaaattgctgatcatgtgcttgacataattcttgtttaaaataataaacagctaaatttctggaaccaataacaaaaaattacaagctcattcttatagttcagttatcttacactgctatagcactcaataatagacaaattacttatgtggtagactctaacccatgatatccttctacacctttgcagactgatgctgattactggcttctcaccgatgatgatatcagcattactcatatgtggacaacagcatgtatccttgatgaaatatagtcattgggttttttttttctcatatactataagagcttacaagttgcactgtgcattgaactttgaagtactttaacatgataaccagcagaaatgcagtgggatcagattgacaccaacgacttcttagctgaagaaataagtgacaccccatgtgcactcaaccagccgtctgctgcagccagtgaacctacaggcgtgggcttcaaccatggataaccagtaaggtttactgctagaccagatctactggtgtcgattgaggttattcggtatgacttaattcctccggtggtttccatgggagtctgcatcctttcccagagaacaggaagtgcaggcgcagcgtgaagatgtacatactgagatagtcagatagccatttttttctggattggcggtatggatctgaaaacatatttgcttatcactccacttatgatttgattaccctcctgttccaatggtgatcgatatgattgtacatagaggcgttgcttcgttgtgttatttttatagctcactcaggttctttctcccagcttaagctacttggtagggtcagtctgtaaatagttcgactagggtgtacagcatatgagcaaccattgttctatgcaagtttcatgcagaaaatgttttaaaaaaaggcttctgaatgttctggctgtgtacctatgattaataacttaatgagtgtttgaatctgcacaacacccatttctgctagtagtagtttaattcgggatacactagatcattatactgttttagcatgtgtttgtacaaaagtagcagcagatttactgggtagccctctacttgaacatctaagcttacatacatgattcacataccactagtatatatacttgtcatgattcagtacgaacgagccaagatcaaaacgaattcacgcattcaaagatcaaagtatacttgatggatcagtcgccccccttcttgatcctcccaatccagctggccaccaccggcgtcagcgccaccgtcggcgggaacctgatcggcgacgccgccttgtgcgccgcgtaggccagcgcgaacgtccccaccttccctcccgtctcccccgtcgcgatcccaacctgcggcaaaaagcaggggagccacgtgagccaccgccgccggccggtgagccgccgcagcccgtgcgagcagagcaggaagacagctcaccttgccgaggaggtcctgcacgtcgacgccggcgctgacgaggaggtagcagagcgtgaaggagatgagcgagagcgtgatcgaggtcgccaggtacgcgccgccgtacttggccaggagctccttcgcctgctccgtcctcgacttcctcgtcttcccctcctcctcctccccttccttggagctgaacacctgcggcaaattcgattgcgctcacgatcgatttgctctccaactcgacaaatatagctgcctgcgccgcgtgcttactttccagaggccgaactcgaggccgtacttctcggtgatctcctcggccgtctgggcctccccctccttggtctcctgcacggcggagagccgccaccggggaggccgagaggaggcgaggagccgcggctgcctccgctgctgcagcaaccggtgctggtgcctcgccgtgggcgcggcggggttggcgaggaggagagccccggccgccatggaaggaccacgcgcgcggatggtttacgagggaagcgagcgagcgcgaggtagaagaagaggaggaggagaggtgaatggggacgcagaggctggaggggaatcaggggatagggagatcgagccgcctggtttgctggtggtggtggtattcacgggcgatatgctcgtgatggacggctgagattgagcgtttgccacggcgttggtgagtttctgggcttggttgcgggaggaagcccagcccatgaggtggcaaacgtgaggcgggagcacgtgacaagtagcccgttgcggcgccacggagcagggagcaccggcgtctgatgggaaaatatacggcagaaactagagaactaccgttgaattgaaaaatgaatgtttgagattcgtacacatcatcacgagtaagaatttcactcgtagatttactcatgagtaaaacttttattgagagaaaatttcactctatggtgacgtaataaatcttggacttttagttttcaattagtaatttttaggttttcactatgtattttcctgcatctgacacacgcaacagtgtgacaacaacacagacaacatgccatgccatgccagtctatagttttgtgtggcgtatctgcatacgctcattgctacgtaaatgttcggtatacgtatcagtcgggcggatagtaaactttgtccattctcattacaacctcaagcagcatatgcggacaggattacactagcagaccatttgcagcgcacgagattaaccagtgttgacgtcccaaccatgtagagttgctttgctagctcgatcatacttattcatcagcagtgcagggtatagctagcacacttaagcaacagtattataggagtagtatgctgtaagcgatctgtaggtagcttttagtggcgccagagcctaaacaaggccgtcgtacgtcgtcatcagccctgcaggctgggcagcgtgtaagctacaaaaggcagagaaccatcacacttgtcatatacttggttttaaaatataatcatttctatgtgtttcttgaactgtatccggatatatagatgtccaaatatgtttcgaaaaatacgcaaaaatgtttatattctacgacagagatattatatactacatctgttatcactttgatttttttaaaaatcaaatttatttagcttcgatcgagtttataaaaaatatagtaatatttttaatataaaatgaataaattatcaaaacatattcaatattagatttaataaaactaatttaatgatataattgtaatctttctataaatttaatcaaacttttaaaaagtctgacttgtaatatgaaacggtataatatgaagctaaccaaagctcttcgcacgcaatacgtacgtaccgccgcacttgtagccgacggggcggttggcgagtttgcagcgcttggggatggtgatggccacctccggcttgacgccggagcgcctcacggtgctggacagcagcacggcgcacaggcacgcgtggctctggtgcgtgccgatgtcgcgcacggccgcgcagcacgcggccggcggccgggccccggggtcctgcgccgccttcgcgcacggcgccagcttcagcgccaccttctccgccggcgtcttgccgcacttgcccgcggcgtgcgcaacctgccacggagcggcgatggcggcggcggcggccaggagcaggaagatgatcggggacgacctcattgtttgttcctactgctagctagcgtttctgatttctgatagcttcttgtacttgtgttctataagctcgttggctactactcccggctcgcttgggagctggttatatagtgctgggcgtgcgtgaagccgatcgatcaggagcggaaacgttatgacggttatgacacaaaaacgagatgaacatatatggataccggggacacttggcaatcccggtcaattaatggaataggctagcaaagtagcactacgtacgtgcagaaatatcaggacgatacatgtatagagatgattcttaaaacgatgtgtaaatatattatctcagaagtcattctgcaaactcaacctgacaatagatgatactctctgcatagtgtcagatgtgcttacgattataacatgtttggtttagtggatagaatggttacacgaattgtctcgctatcccactatgtaaagttactaaaacactgtttcaagaaactcctatctaagatccctaaatttaggggctccctactctagtctccatattctctaaagtcatagcactcctatccgacttgttagtgattgtgtcatttatcctcccacatattatctactgtctatttttttgtcactaggatttgtgaacttcaaaaatcaaactttattatattttgtgttttagctttcacaattcgtctaatcacacgttttttagttcagtccctaatactcgagagtttaacagtaaacacaacattaatttgacttaaaattaggacaagccatttatgtgcacaaaataagtgtggcaggtcgtggcgtgtgctatgtttaacacaaggaacgtgtgagggtgtgacacaccttcgcttaattagtagcgtgtgtactgtgcaccctaacaagtatgccttatgtgatgacctgcaggccaaatggctaatgcacatgatactttgttgcatgcgagtcgaacgttctcataatttaaccacatataaggtacggagatattagttagcaatgttagtacaaaatggcctccggaattggggaaaagaataatcataaggcctattcggttaatccctatgaggaaagaatttgaggggatttgaaattattccccctccaatcctctttaaacctctctaaaccgaacaaggtctaagagtggtatacgtacaccacacaacaagtttgcgattttgtaggagtatcgccctatatttcgtttgaagccaaagcagcgaaattttgtgaacaatgcgccccattttagtttgttttcacggtgtttttcagcggaagcagcaaacgcggggcctggtggatccatcattttgctctgcacctcctatatgtgatagagaaatttgtgccctctgcgatgaacgatacatctactagaagatggtgcaccagtgtccacgtgtagcaacatcgtcattgtaatacatcaagcaaaagatgtcttattatggagagcacaacttaaaaatattatatctgtttttttaatagataacattgttaattttttatcacacgtttgatcgttcatcttattaaaaaaattacgtaattatactttattttgttgtgagttgttttatcactcaaagtattttaagtatgatatatatcttatatatttgtataaatttttgaataaaacgagtggtcatgttcaaaatttaacggtgtcatctattaaaaacggagaaagtagaatataacttacctaaaagactagtcaatcttattaagttgtggctccgattagatttaaaacgatctcctatatcgatatcatatgggcgcgtggggcacaaccgatattgtgaggattagttgaaatcccctaatagtttctgcaagactgtctggagttggtaatgatataggtcctggtttgcggaatgaattcaattcttggaatggtgtcaactcagtagcagtcttcgatattcatgaggttctttcacgtgtggacctaaatatgcttttatgaaacctaaaaaaaagtgtgcgttccggaaaaagtagcctacttgacagaaagggcgggcactctcggctcggaggtaggcactctcggctccgataaaaacctttgaaaaaaaaacgatttttgataagaaacactcaatttctcgtgctctaatagagtgaaaatcgttggctcacatggatgcgtctaacgcacatccgatgttgtgtatgttcaatattgtgattcgggtaaaatcattggctcattgtgcatgtggcgcacatccgacgttgtcaattggagcgatcgttggctcataacaaggatcacacgtgtgaacgtacctagtaggctagtaccgtggctgcgccccttgctaagcttgcaagcactagtatcagcctgcaggcgagcagcatgcacaaccgtcgatgatgctcctctaatatagtcagagagagaagtgcgcctcttacatgtgagagtgcgcctcttacatgtgggtctatggagagatcttctgacgttaaatcagagaggcatggtggctgatatatgggtccataaatgatgagtctcatatatcagtgaccatgtgcgcgctgtacactaatgtgagaggatttggtttcgtttaagcagagcacacaacctctgaatttcttcactgttactagttgcatgtttcctctgtttctcctctgcgggcataaggcataagcgagcatacaagatgtaaaaatgtatagcaagttttttgaactaaaagtgtgaatcgatgaacaaaccaagttgtactattattcagagaattcaggggagcgtctctgcatccctccgagataatatgatcaagtacacactatcctggacttggagaaacaactctacggactgaaatcacgaagtcccacggaagatggaacccttttatttggtgtttgacactgacactaaactgcacgaacgcacaacagcatacagctttagtaagtaacacgacataaactcgataaattaagcggatgacagacacggcaccggcactgcatgcagtactctttgttgctcatggcagagtgtaatctgtgaaagagaattgagaaggaatcgatcatgttagattgttagcgccaaccaactgaaaatgatgaaataatcatagattgttcgtggcaagagttgacagtttgacatgttgattaggctgtcttcttcccttttttttttcaactctattcctccttttcaaattattaaatgatgtgattttttataaaaactgttactattttttaagtttttttaattaatacttaattaccatgcgttaatgactaacaccgttttctttgctgctcccgatctcagcttacctccgcacttgtagccgacggggcggtcggcgatgttgcagcgcttggggatggtgatggcgacctcgggcttgatcccggcgttcctggtcgtgctggacagcatgacggcgcagaggcacttggggctctgcttcccgatggtgtgcaccgccgtgcagcacccgctcgacggcgtcgacttggggtccttggccgccgacgcgcacggcgccagcttcagcgccatcttgtccggcggcgtcgccccgcactcccctgcaccgtccgccgccgccgccgccaccaccaccagcgcgagcaccaccaccacgacacccctgatcaccgccatgtcgatctcgatcaatcgatcgctcacacacacacacgcacgcactgcgaataactagtaattaactaccccctgtgtcacgctgtcacgtagtttttcgttgatgggcttcatggctgctggtgctttatatatatacaggcgtagcaggtgaggtgacacccccatgatggtcggggagagtggtggagcgagcactatcgcctcaccggctcgcgtcggccaatggcgccgtgcaagctcggccacgcgcgcgcgcggcgatcgaccgagaccgagcggagagatagctcgctcggtgcgcgcgctagtgggtgggtggttgtctcggcctctcgtcgacgcgcgccgcgtttgtgacgacctacctgatcaagttcgcatacgtgccgtgctctcaagtctcaacaacgcaagcatccaagcatggctgcatgagcctgagaaaaagcatcgtaagatggttcaatcaaatgttgttgcgcagcggtagagaaaaagagatctcgactagtttagcgagtactagttttgaacgtccactccttacttccactccttacttgcatactactcaaatagttataaaaagcttttaaaaaatatattaacatgtgatatatcactctacaaacatacaacttaaaatttaacttctgtatatgacaacaaaaaataaattaaacttacaagtagaaattaaatgttaagttacgtgtttatgaagtgatatatcacatattaatatatcttctagtttttattaatttatttgtaactatttaaatgatatgcaaacaacagaaaaacatccatacaagagttttggtggtgtgtcggtggtgttggtcatcatttcgttcatcggctaagcacttagtactaattataacctactaggattgtcaaaagcacaaatgtaaacgtgtaagtattctgatgactgatgagaaaaaagagtgtaggcgtgttaggtgtagccgtgtaagcgcgcccggccggcacctgtgcacagcaacggtgcattgccatttgccacaatcccaaattcgatgctccgttcataagggagtgtctctagaaggagagtgccctcaaaattgaaaaagaaattcagatcgacgcttcatcctggccgtgttgggcagtattattacaaacttaaaaattaaaaaatagagttggacgaagattaagatagtctacctaaaataaaaaagccattaacatataattaaaatagagttggatatagattaagttagcatacgtaaaatgaaaaagtcacatgattaattaagttttaattgttacaaacttaaaaataaatttatttgatattttaaaattatttttatataattttttgaaaaacatattgtttagcggtttagaaaacatactaataaaatccttggtaaaatccacgtcttaataaaaaaaacaacataagatatgtaagcgagaatgctgggctaagtcatgtgcccatcagcccatgtgtgtctagtgcccctgtgcagcgggcggtaggcgattcgcgccgccgccggccgtggggcgtcgcgtcgcgtgatggtagtatcaggtgggtgggacaattgggatggaaaaatatactttgactccctcaactatagctccgagtatgattcatatcctttaaccacaaaaccaggtaaattgactcctccaactatcaaaaccggtgcaaattatatccctcggtgattttagctgacgtggcgcctacgtggcggtattgaccaagtctttgttctacgtggcgcttatgtggcattagaataaaaataaaaaaaaggtaggacctacatgtcactcacacaaaaaattatattgtgggatccattgatatgtgagacccacatgtcatcctccctctagctccttcccggcttcccttcttcctcctccctccttccctctctcccccagcgtttctcttcaccccggccggagcggcggtggggagtgg

SEQ ID NO: 23774 - DNA, 61158 bp, Oryza sativa
  unsure (1)..(61158): unsure at all n locations
ggatggctggcgagcctctccccagttcgtggacggccggcgagcctatctcccgtgcgtggacggttggcgagcccctccccatgcgcggacggccagcgagcgccttccccatgcgccaacggccggagagcacctcccctgcgcgcggacggccggcgagccactcccccgcgcgcggacggccggtgagttcctcccccgtgcgctatcgttgtcgccgccgccacgacgcctcagcgcatctcccattacctcgcgcaccatccgagagcgacatgggaggcgctctccaccgccttccccactgccgaccaagtcgacgtcgtcctcctctcccttgccaagcaccgccactcctcctcctccccggagctcgttgctaggaatgcgctcaccttcttctactgggccgcctcctcgtcgccgtcgtcgtcgatcccccactccctccgcgcctactacctcctcgtccacctcctctcccgcgccgccctcgttcgccgccgctccccaccgcctctccacaccgtcgtcttcccgaggagagaaaggccggggaggagagagagacaagggagagaggggcaggaagagggaagaagagggaggatgacaggtgggtcccacatatcagtgggtcctataattgttttttaatgacatatggatcccacatattttttatttttgtttttattttaatgccacgtaagcgccacgtaggagaaagacttagtcaataccaccacatcagccaaacccacctccaaaactaccgagggatattgtttgcaccggttttaatagttagagaagtcgatataccggttttgtggttggaggaaataaatcatactcgggcgatagtggaagcagtcaaagactttttccactggggatcggtccgtcaaccgggagagattggattttatgtgcgtcgactgggctttgggccttgggccatgattcaatcgagttctcttgaagtacgtattttagttctttctttgagagaggttctgttcagagtctcaatactgcaaagccacctcatatttacgtcataggattttctataggcatagtcatatcagggattttcaaaaaaaaaaaatagtgctgtaatttgtagtcttgtatatggggttttcacatttggttcagttcatcaatcttcacgcataagtttacgaatagacaacatgataaacggttttaattttatgctttgctattctgaatccactaatggatgtcattggatcaaaatccatggcctgccaagaggtggaggcgtcaatgagggagatggcgaggacttcgatgagagcaggtttagagggatggaggaatagcaatgagtggcagagacggtgggccggtgagggaaagacagaagcgttagcaccagaggcttagggatgaacgagagtagtgcataggatcaaccgcggaaacaaagaaggtcatgttgttaggaagcaggcggcaatggcatgaaccatcggagacgaaggagaagggggattgtgtcgtacttggagacaattggagaagatgcatcaatagcgacatactcatcagagatggagaagggagcggtcggtggggctcttaagaatggtaaatgagaagcaagtttgcgaccaatacatagccaataatctgctcagttcaactaaaactgtagtattttttttttcaattgctaatctacaaactatatgaaaaaaatcaaattaattttttttcttgttccctttttgccactggggatgaaaacagtcacggaaattccgggtcgaccgagcaccatttccatatgagtggtattattttttaccgtttctggttctacctatttataaatttttaattttctatttaacatcatattgctatttttactaaatagctaaattgataaatatggtcctgacaatccgtcgtttcagaagagatgaaagatgctactgtttcttgtaagcatccctttttcatccctgctgccactgctaataggcctgataagcttttttttttaaccctctgtttcgtcccctttttttaataagaggttctggacgctcgatttttagatggtgttttttttcttctgaagataaaaataaaaataaaaattaagttttatatgcaaaataaggtggtattaacgtatgattgagttttaattattacaaacttgaaaactagatttatatgatattttaaaacaactttcatatataaaatttttgtacgaagtatacggtttaactttcatataaaaagcgtgccacgaaaatcttttcaacttttgcttagagaaaagaacgggacccaatgatcttgcaagattcttcctgctgcctttccaaatcttcgccaccacacagagtcagagagatgcacagcacaggtagttgccgctgccacagtgctacctccacacatgccacggtgccaccctgcaaggtcgttttcatattttcagacctccacatggttgatgcccggttgaatagaccttagcggtatttctttacatgatttttacatgaaagattaatgatccgaagcttcttttctgacccgaaaaacaatttgagcaagtttaatagtatagcacactactaactccaaatcatatatagtcaatataagagcaggtacaataacaaactattagccagctacaaacatattttaatgagataaaagatgagagagatgtagccagctgcagcacggactccaagacgcaatgtgtgtatgacaagtaggaccatatactaatagtatagtaagcaactattgtataaattagctattagattggctatagatgaatttgagctagtagttggctatactattaaccttgctctaatagccaatcatacaatagttgcttaccgaaagggccttgatgtcgcctagaggggaggtgaataggcgcacctaaaatttacttcaaatcgtagcggttaaaatcagggcccagaacttcttggcaaaaggtccggaacttcctggcagctttttctcacaagcagagaaagctgcccggaacttccggggttcttcctaggaacttccgggcagttgtaaattgctatttcaaacacctcacaacaagtaaattaaatcacaaggaagcctaaactatagagaggtacaacatgtctcaaacaagagtaatacacatgaagatacacaagatagcacaagtgatcatacaatgggagacatgatagaacaactaggcaaataaagagataagcatcacaatcacaaagataaagagagtgagaggagacaaacgatttgtttcccgaagttcggattctccaccgagaatcctatatctccgttgaggagctccaaagagccgggtcttgattaacaccttgcctcaccaaataatgttgggtccatggaagttagtcacaagagatttcggcacccaaatggcctttgtgctagcatgtagcgaactaatcaccctagtggcacaagtgccatttttggccttcctaagcaaattgtgatgaaatgagaggtttggcttaggaatgttaccaatgggacaatttttaccaatatgtctctttacccggcaattgtaggaaagttgagttttgcttttatcttgcttcttgacttgcttgttaccggtttgcctcttgcttgattgattgcaatgatcatccttcttgtgcggacaaaatccgatttcatgccccttctcattgcaaccgtagcacttccttttgttgattcttgatgtctttcttggaagtgtggcttcatcatcaatcttgcaaggacaacttgaggcaaagtgtccctctttggtggatttgaagaacttatgagcaagatcctcattcttgctcaacttcctctctttcttccaaggaacttccgggcagttgtgaattgctatttcaagcacctcacaacaagtaaattaaatcacaaggaagcctaaaccatagagaggtacaacatgtctcaaacaagagtaatacacatgaaaatacacaagatatcacaagtgatcatacaatgggagacatgatagcacaactaggcaaataaggagataagcatcacaatcacaaagataaagagagtgagaggagacaaatgatttgtttcccgaagttcggattctccaccgagaatcctatgtctctgttgaggagctccaaagagccgggtcttgattaacaccttgcctcgccaagaaaaggcctaggaagaggtctccggtcttcaagccaacacccctaggtacttctctttggtttcaagtgaccactaagatccccaacttaaacaccaaaagaacaccacaagtgaggcttgctctaccaagacgacctcctaaacctcacctctgttttctttcggaggtggaataacgctctcacaaacttgcccgggtcaatccacaaccttgttggaaacttgcgggcgacacctaaccgtctaggaggtcaccctccaagagtaacaagcttcaagtgatagcccaacgagatacaccaagtgctcaagtcatcctagccttcaaaaccttctccaatcctcaccaccaccctcaaattcactctctcactcaataagtgcacaagatttgggtggaggaagcaaaatcacattgggagaggctagaacaagctagggaacacaagaactaaagtggaatggccaaagaatgagctggggtcgagttggctatatataacggttaggtgacgtcatctagccgttactcacatatttgaactggagggttgccaggaggttccggacctgggtgccaggaacttccgggcaacacttaggaaaattttcaacctcacctcggcgccaggaagttccggacagaacctccgggtgggactctctgtcccgagtagagtcattttcaaaaacagctcctaaaaatatttcaacacttggacaccactaagagcacttgtgttatcttagaaccatacttggaaccccttttaatagtacggtttttcctaaactcaaagcgaaaaagtaaactagtctaactcggctccgagtcttctcgccactttgattttgatgttttgggggatctccaagcatcctagcccactcctaagcaacctgggactaatacaccactaggaacatcttcttgcttcaccttgagggttgtctatgtcaacaccatttcactattgggactattctcacctacactcattaagcatattagtcccaaatcaattatacctttgccttgatcaatgcccactttggattttgacttgatgttcatcgaagaaccacatcctcttgatcctcggcattccatcttgcggtcttcttataattgatacggattactcatagcttcaaatggcctcatacggtccatcatgaccatcatgacaaagccttcactcgcccttcaccaccggattcagtccatcggcgccaagcctcttgcttgcccttcaccccccacatggtccattgtagccgagccttgcttgcccttcaccgttttgccataaatagccacttcataccccgcatcatcaatgtcttcacttgctcctcatcaaggtataatgtccatcttctagccgagccttgctttctcttcaccggtttgccatagatagccatttcataccccgcatcatcaatgccttcacttgctcctcatcaaggtataatgtccatcttctagcttcaatcttttaacttgatgctgaaacttaacctaatctcaccaactcatggaaatagttagttccaacaatgggttgtcattaatcaccaaaacaatcaccgcgctcttaggatcatagatattccaatctccccttacaaggcaattctagtgcatagatctttcaatctccccctttttggtgattgatgacaacactatcacaaaataggaatttaaaaagaataccctagtatatgttaccatgagcatgaaacatatactagagggttggtttcatcaacatatgaaacgaatataagacacagctacatttaatcgaaagaacaaaaacaattattatcatctttatcactctaataaatacaatatatgcacccaatacaattagaaatcttaagggtgaaggatttaaataataataatttaagtggagataaggtgtaacaaagatcaattagtgtatgcatgtacgcagccaatgaatattaagatgactcatcgggttccgattaatcatttaatttatctattcatttaagttttaaatacatgaaaactacaaatgtagctaattcaaaatatgaaataaatctaatatttttggaaggattccatttaaaaaaaggatatttttggaaggagagtactaacaaatcattggttcatctaaagttagcatagtagagaactcacatcaatactagctagtagtagtatcattccatcttgaaacataggagtacaaacgaaaaacgactagagaagactgcacgggaacagatatcaagcaagtcgacaaaatacaattattttagcgagatatccaaggtaaattttcacattggatccgatacagtgcatagtgtctactggctaaggcgcttggacatactcgtttaacggaatcgatggggactaagtcttggatccatccgcgggagggaggccaccgtgctcacaggccacgccgccgccgccgtcacgggcggccggccgcaccctgctccgcgcgaggaggaacccgagggcgtggccggcgacagcggcgaggagcaccccgacgttgaacgacatgacggccagcatcaccaggtacgccatccccatcctggccgcgtgcaccgcggtcagcagcgccgcggacgacgccggcgccggcgccgggcggccgccatccgaggaggcggcgccgccgccgcggcgggcgaggcggcgcgagagcacggagagcccctcggtgagcgcggcgagcgcgagcacgaagaggaggcagagggcgtacatcccggcgccgcgctccccgggccagccccggatcaggaccaccgcgcggtcgctccagaagaaggtcatgtgcatcatcatcgccatcttgtgctgcggcggcggcggtgccgccgccgtggcgtggccggaacgcggcggcgccatcgccatcggccccatcccgtcgtcgcccatccccctcatctctgctgctggggtgtgtgtgcgcgcgcgcgcgcaaggtggcgtggcgtggcgtggcgcggggcgcggcgaaatatattgcagcggcaggtgggcgcgcgcgggtgaaacgttaatgggatcagggggatcgcggtgggcgcgcgcgcacacagcgtggcgagttttttgggggcgtccgcgctcgtgactgcactgaacctgaagcgaaaacaaccgagcaggaggggaggatggatggggaccccatcgcgtcgtggctatggctatcagggagtatcagcatctgaggacagttgctaccgcagcacagctaggattccagatagacagtcgtgtcaacttctaatccccgttgctggtgtgtgtgtgtcgtgtgcccccgttgctggtgtgtgtgtcgtgtgcagtgtgctagtataaatctaaatatatatctttgttcatatttattgtacagaatgtgtcacatcccgttttagatttatttttttaacggagaaagtatcttctttcacatatcatcaataaaaaactaaaatacctttgttttatcaatgtcaatgcaactatttctcatttatctattttcaatataattattttctactttcatcaattttgatacaattattacttttaaaataaatttattttggaataaataaaaaaaataaaaaaaaattaacttactgagacgaaggaagtactgatacatatgcacacagccaggatttgcaaggaagctttctcgctttggccctatttagattctaacttttttcttcgaatttttaactttttcgtcacatcgaacttttctacacacaaacttccaacttttctgtcacatcgttctaattttttcaaacttttaattttgacatggaactaaatacagccttcgttgaaaacttagaatctcgcggttacggagggggtatttaattggtttgtccgttgcaagcaagctacaaacgctatcgtctatggtggtggttcagtggttcacagtttccactagaagctatgctatgttgggaatattttgataggaatgccaaacaaaaaaattgtcttgttgcgcgtgtgctccgctggcttattctcgtctcggtccgttttactctgtttatggttttgcaaaagttttcttttatttattttgggatggatggaagagtgcagatatgctaggacaacttgtaattcttacaatttctccgtttcaaaatataattgttcgattggatggaacacatcctattgtatataggttgtgttctatctcataaaaaaaatttgaacgtacggaggggagtacaagtaagcaaaaatacattatatctagcgagcatctaggcttagtgagagcaatacaacaatactaacaaaacatagataaacatgtagagggagaaaatgtcaatttatttttaaaaaaatgattaaaaacctatcctctacatccaaactatacgtacatagccaaacatacattgtcaatagtacttagcatcacaccttgcataagaacaacaccaccgaccaaataaaacaagggtacttagactacaacacctcacaacgaagtcgtctcgtgaatagaagccaactaacaaaagatgacaaaagtggatactaggtctccaaccgcttactcaagttccacgcaaatctggaaaagaaatcccaaactctagcctccggtaacttgtgcatgtgtttaaccacatcgctattctcctcgttaagcaacaatgaccactagcgcagtgggttcacctgaaaattacctacaaagaggggagttagtacttaagccattgaagattatatcattactacaaagtcttaccgtccaacacaaagctacggcacctataaaaagttaacatttattctacgttgtaaaccaccaagccaactatggaagatattagcaagggacgagtgtaaacccaccataacataagtaaaagtatttgacaaattaaatcctaaggtatattactaccagtttctaccgaacagagtaaaaatccaaaattcaccgtaaattgatccattacaccgaatctaaatactagtattgttatgcttggctttatttttcttttaaatccagttttaggtgttggccacttcgcccagtagcctgttcggcgcggtttccaggccgcaaacgaaccgaagcggaagcgcctccgctagctgctcagcccacaggttggttcggcctgcagcccatgtatctctcagccccaaagcccataacaattcattagttagatccggccatccgggctctccagccagcctctcaaactcccaatcctagcgcgacctcgtcaaccgcggcagcagcaaactgagcacctggacggctcgacggcggcgagctccgcacgagtcctcgatggagatcgatgcttcctcaaaccgtccgcggatgattggtgaaacctagctatttcgatttgacatctatttacaatcatcttttgggttgagttgagtgagttcaatcgattttgagtttcaatcttctctggacggcgcgcggcaaaccgggtgcgtataactgtatacactatttctacggcccctttaccgaatacgtttctacgcccccttcaccgaatacgagttgggtgtgatgctctctcataatcaaaccctaataccgccctccatcttttaaccactttctttcttataatctctccctcgatcggctactcgtaagtctcgtacgtcgccccagttttctccatgcgcgcatcctactcgcagcccctcctctcccaccactccaccagcgccgccgccaccagcgacagcaatggcagcgacaacttctcctcctccggggccgcgccggcgggggcggaggcgcggttgccgcccatctcgcggcggctgcactcctacgacgacctggtgcacgccgccgccgccgccgcgcacgacgcctacttcaagcggtgccacacgacgcccggctacgtgagcttcgaggacgtgatcggctcgcaggagttcgaggagagctcccgccggccgccgaaggccggcatcagcgacccgctcctgcgcgcgacgtcgcggctgtacgcgaggccccaccccgcgctccaccgccggcgatcgccggggccgctcgggacccggcgcggcggcgcggtataccgcttcgtcaagaggtacgtctgcccttgcctagggttcgtggccggcatcatcggcgtgaaacaggttgatcaggtcgaggaggaatatccagcgttaacttattaattagttagtcaaatattcctatgagttcttgcatagattcgcatgcgaaatctataaatagcactagttagttactgattctcataattcttgaatagatttgcatgcgaaatctattattcccataattctttcaaatagatttgcatgcgtattcttgatgaatagatttgcatgcgaaatctataaatagcagctggttgctccaactagttgtatgacctgtcactcgtggagagtcttattggatggcttgccacttgtgtggagtctcatgaaaaaaaaatcccctttttttatccatcgtcaagtatggtattgatttttttatccatcatcaacagtataatattctttggtttgtttccattatgtattcatcacaatgatcaaaaggtttgttagtgggggttgcatcgcatgaatcatgtagtctagtttgttagtggggtcctccgcgtcgctctcgcgcgtgcggctcgggggcaaaaccctagccgcccgcgccgccacccccgcccaccctaaccacctcgccgccaccggagctcgccgccggaaagccgtgcggccagtcgggaaggcggcggcggggccaagagaactggcaaagctcttcctcagcgcgggaggacggagcggcgcgcgacggtggggggctccggcggccggcgacggcaagggcgcggcggatccgacgcccctggaagcggatccggcgaggggacgcggcgatgcataggcggcggtggaggatggccgcgggagggaggtggtggcgacggtggcgatggggcggcgcgtcgtcttcggctaggacgcggcggcggcgactcatcccggcgtggaggcggcggatccggcgctgcccccgccggatccggccggagacggcagtcggaggggagaggagcggatgcggcgcgcgcaaggagcgcggaggggcggccggcggctgtggacgccggcgctcgcagaggcgcggccgcggcggtggaggccagcgctcgcggaggcacggctggcagcgggggaggccgcgttcccggaggtgtggccggcgacggcggaggctggctcgcgcgcgaggggcagccggcgacggcggagagcggtgcagcgcaacgaggagcagcggaggacaacactggtgaggtggcggctggcggcagggagaagtcggcgacggggctcgagatggcgacaggcaggggcggcgtcgcggtgggcgggcagcggcggctcgctcgcgcctgtcgcggcgttggcctcggcgtcgtccgcgcggggccacggcgctagcgctgcgcaggcagaggctgtggcggcgtggtggtcgcaacgacaacggtgctgcggcggcgcttacgtcgagccggcttgcgctgtcctagctggatctggccgtccgcggctggatccgtcccctccgcgtcggatgggcggcgatgtgcggatgtggagttggcgggacgatggcttatgctggcgtgaagcaggaattgggcttgacgtccgcggtggcgacttcctcgttgccgaccgagtcttctccctcatttcggtttccctcccttctttggccggaccttgttctggtcgtggggaacgctagggggagggcggaggcttcggcttgctgtaggagttggtggccaagggtccgtctttgccgttggttacggttgaggtatgggtgcttgtgagacgtcatggactattctgtggccgtcaatgtgggggtgcttgtgtgggtgatgtgaagatgctggcgaaagccttgccgtgcctttggccggttcgacgacggcggcgctcgtgggcgtcatttcccttcttggaggcattgtcatggcattctttcatatcccccacaatctccagatgaaaaccttgttccggctttcagacgagcgacggcggcgttacacgtcgtgtcctccttgggggcgtcgcttcggagaagttccaatgcatcgacgaccgttgatggtctttttcggttcaaaagctttcataccttgtgctcggtgaggcctttgtcttcttgggtccacttcgttccttctggtggggtgctggccgcgtgaaggaagtggcttctcgatggcttggctgatgtctattgttggatgtcggagctgcttttcgctttggcgactttcgtgtcttcagtgtcgctgcagttgtgaagtcggcgctgttgggtcgcttgggcggctagctcggcaacgataacacctcttctgcgatgtgggagctgttatatcgcttttgtgtttagcttggcggtgacatcctgcttttgggctccgccgtcgttgtcagttgtgtagcggtgggtttcagccggttttcctataattaaccgtgcaattgtgtggtttttgggcccggttttccttataaactgggttaattctcttcttctaaatataaaagtggaacaaagtttcgccttaggtttcaaaaaatgaatcatgtagtctatcgaagacgggtgcacaaatcacaacaggaaaaccaacaaactagccaacctgcaacgccaaattgtgaggagctatatataccagagtatggatcagtgatcacctgtctatatatatatacacatcatgtttttgagaagttttgctttgggccttttaaattttgtcactcctaatcaactagtttccaatcctgtgcacctctctctactgaatccctatggcgccggtccagcccgttagtaatcgtcgcggggtcgccggtgcctcgccgtgctcctccgatcgccaccgccggcgacataatcatcaacgtagctcgacctctctgcccggtcgcctccgaacgagaaccaccgctgcacagcagaaacaaaccattgccaacatagttacacacctgcactgttacatatcctgaattctttgactgcactgttacatttccggaatcctgtgatgaccatggttcccaacatgtgtactactacttcctctgttttcatattgtaaggtgttttacttttgtgctaggtaaacttttctaactttaccaagattgtaaaagaaaaagtgctaacatctacaatatcatattagtttcattaaaatacactatgaaatatgtcttgatagtgttctttggtagagtagatgttaatatattttcttatagatttgatcaaagttagagaattttaacttagaacaaaactaaaacaccttacgatatgggacagagagtaactggtaacataccctcgttcttgagcctcgtgacgtctgggaccggatgtactccatcccccggaggaagagatcgtagcccctatcggtgaagttcttgaggtagaagatgagaatgtcgccggcattggcacgcaggtagcgcagccgctcctcgatgttgggctggtactgcatcaccagcggccgcaggaaggtgtcgtacacgatgtcagttccctggttcagagtgacaaagcaaaatcttatttaattcagacgtggtcaggagatgcactttttgtgcagctgcagatttgttgctggactcagtgttgcaaattagattaaatctcgtttttagttcagaatttcagatatgattaggagatgcagttatgtgcagctgcagttttgtggcaaatcttgtttagttcagacaatgatcaggacatgcagttagctgcagctttgttgctggaccaagcgttgcagacatagcattacatacccttgtctgggggtaccacaggtagacgaggaaggcgagtctgagttcagagtacattggtatcctgtcattcaatgaaggggattgccaggttacagggagcagattacaggaacagctgatgagttgtggttgtgtgattattacttacttggaggtgaggacaccagcgatatcatcgaatatgacgaggattactagtatgatcctgcaagatttgctgaaattggtcaactcttgcaaggtgtttcagatctccaaacagtagatacggtgtttcagatccccaatattcaaagcacttcagaaaggtgaaagtgaggatttggtactgaattccacagcaatgcagtaacatattagcaccaattctaatgctctaatccagctaactgtacccagatagcagaaattaatccccgtatggtttacccaattcactcaattacgacgaattctaagcatcagcctatcacccagagatcaaattgaacacaccaaatgaactaattactccaagctaaggggtttctgagtcagtagtcagtaccaatattggcaccaaaaccggagatggtccgtccgaccaggccgctgctcgatcgccttgaagcactccaacgccggcatagcatacccgaacagcgccctgcacccacccaacaatcaagcagatgaatcaataatctccatagcacatgggccatggcgccggcgaggcggcaccggaaatccccaccagaattgggagaattggcgagcgggaagagggggggcacactcacgtgagcgctttcgtcaggaattccaccgacatcctgaaccagagcgtcgaattcttggagacgaagctggccaggatcttaatctcctgcccaatctactcgagttcttggagagaagaaggtaatggcgtgaagtgaccttgctctgttcggtggctttctgacttgctcgcttacttgcccaaggtggttagctgaggacaaggcaaatcaggtggttagggcaatcccaacccatagtatatataagtagtgtctatggtgccatgtcaataagacatcacaatagaaactacactctacaacccatggtttcttaaagtggaccattaataaatacatcatttctcttctctaccaatcatatttattcttcatctattatgaagacactattctcttctaatacaaaaattgatagtgtctagtgcatatattctcgtgttgaagctgtgtcttgcatgagacccagtttcttccttccttcactctctctcttaattaatatagtgccaaataagttaaaagtgacaatatagctaatgccatagacatcatcttcggtggagggttcagactgctatgctcggctgcttctccgccgctctctggcggtaggtatctcgcgtggcggttttgggagggggtaattacggctttgcccttgtccggttgcgtttgatggtcaatgacgagtggggcccaccgaattaaggactcgtgatgaactggatcgagcaagcgatttgcgaatatactagtagcaataaagcctaaaaaaaagtgagctttgttaggatcaataatttagggttagtttggttttatctgggaggagatgtgacactaaacctgctaaaaggtgacggtgagatgataattattgggctgatactccgaatgtcctctgttttggcttgttggttgtgcatctcaataattctacctagcttggattcaacaaaatactagtatcggaataagtttccaaaggaaaaaaaaagctagcataggatattttatttaaatagaagatgcataaactaatatacacaaatataaatatgcttacacctaaggtaataaatatagaatagcaaatggtcacggattaatgtatgagtagatggttgctgataaagggtgctattgtagccttctaggcgctaagttccaatagcggaattttaaaaattactatacatttagattatatattaatactagtgtcaaaattcacttaaaatttaaaaatttagcatatctagttacctatacatttcatagcataaaatttataaataacatattaatgaatatgataaaaaggcacatggcgttaaattctcttatccatagatagagaacgtagtttaagtacagtaacaacccaacaaagctaatagtttactgctataacagtcactaagctatagcgaccgctaagatctaatagactatctttgatcccctaccttatagtggtagtggtagaagtccgctatagctacaacaaacaattaatgctatttattttttttcgcttagatatcatttccctagattaatgccgttgcaaattacttgttcatcatctctaaaaatatgttttcttaaaacacaatcttctactgtattacttagatgatatgttctaagctatatatattaaatttatttttcaacatatttaatttattttataaccagaaaaaatgcttgtgcgttgcaatgggtaaagtctattttaatcttattattattatatggtttagttaagatgaaatttactgtgggagttcgcttggatatatatatatatatatatatataaaatcatgaactacagttaggagtccgataatgtcaagttagcatatgagttttttttaaacaaaattcttatgtgattccctctgtattaccgaaagtgaacgatcttaaaaaccggctgaaatacatatatgtatttccaaaagcaaacaaacttaaaaatcaattcatacacggatgacgtaccaaaataccggcaaaaatatcttcaatttttataatagtaaagaatagataaataaaataatccacagtaataatccggagacagagagcagcactaaaactgtcaaaaaaaaatctacggagttatcgatttgttgtagatttaaggagaaccggagtataatgcattgttttttctttcctcagatctctaacgattgcagagtttgcaagtatgtgctgcatcaggcgactaaattagcaaatccaaactactacttgctcctatcttcttaacttaaccctgtcaaagttgcagcaggaaccactagatatcttttagctctaaaaatcctgatgagagtttcaactatgctgtaacatcttgtgactcgtgtgttgcaatattgcagcttgcattgtgcattgggtttggcaagtctgaccgtctctgctaaggaagcaggggaaattaactagttagtcaatttgatctcggcgctgggctcgggaggcttagataattgccccctgtcactgaaacttccgtcaggttcgtgagaagcgaggctaatgaacaacgtgacaaatccggcacaattttcgttgatctgaaaataaaaacggtcaaaacattgttggaacgagcatgccttggcaatttggcctgaaatcgatgatgcactccttactccttagagcgatcttcagaaacctccgtcagaaatgcactacatgtttcagctccatctgtatatttactattagcacttcatatttaaggattgaattttactatggatagagaagaaggagcaagttcattttatctctccagctagtgaagaaatgatttattttcagtgttgaagatcgcactataggcaaaccaagaaagaacaaaccggtgagtcttcagttaaaaaagaaggtttgtcttcagtcaaacaaaaggaaagaaagaaagaaagaaagaaaacggtgagtcttaactttctttcactctgactctcttaaacaaaatctaaaagagaaataccagggagatcaactttccaataacaacacaactttcaaacaaaacacaaagcatatgattccacaagacaagactgatcatacaaatccacaacagagaagttccaatttatgccgtccacaaccacatgtatgtacatcacgcatcaccaacctgcaaatctgcaattcatagtcaaagatgttgtgcatcacaatcatcatccactccactagcgcaaaacatgcccggatctcttgaacaggaacacggcacatcctgtttactgtgcttatcatctctgaactacagaaaaaacggcacccactgaagatgctgcgaaaaaacagtcgaagcctgtgatcccaaagatacgcgaaccatgtaaatcatcagtgatcagatggattggcatgcatgcgatgcttgtagttgccggttggttgggctacgcctgatgtgtttgcatctgcatgttggcgagatgtgatgcatcagccgcatgcatgatcgatcgatcgatcgctgtcccggacgtaggagtagcagtgaagaggatgcagaattgcagaagtaattaataccctgttcgatcttaaatctgtctggactctggagtagtacgtctcatcgatcaagtgctctgcattgcacaatgtgttcctgtttggtggtatccatgcgttgcatgatccagcgttggatgtcaatctgacctaagaatagagacgcaaagatcgctcgttgtgagcctacagtttactgggattgaacgaacatgtctcagcgagcagtctagaagctgcaaacttgcagtgttgcagggtaaaagaacaacttggaatgcttgaacctttaagcatcataaattaagtttcacaaggtggttagggacaaagcttaagctagccttaggagctactactacgagtgttgtctaagctaagataagatatggcactcagttccactatgtttctgcttgatctaacctacaaatggcacaaatggcttctgaattctgcaaggttcataacccagttactactccattttacataaactttaccgaccaaatttgcagtctctactccaggcagtgaaaaactcttgtcccttgattagactgtcctggtaactcctgaagactgctgaacatgaggcttgattagagtaagtagtcatttagtagtagatttaaaaggactctgccggggcctagctgatattactagtctgtcctgttccgtaagagttaagcttcatgataagcactgataaattcatggacccactgtgttattactcgacgcattcaagtcgaaaacactgaaagggacttatgatcgtggaggactgtgggtaaggcttattcatggacaaaacttaaacagtcctagtagtgtttgtactgactatgctcgcgaaaatggaagtatcatgcttgcaatatgtgcgtggattaatgtgtggatatcctagataagaatccaaggccaaacatttctcatgaaacagacattttcttgtagaatttcgaggcaaatttcaacatgtttttactcaaactgaacagaaatccaactttcatcaactggtatttggaaggaacttccaactaaacaccaataatttcagccaaaataccagaatctttgaagcggtttctactatagcattttactaccagtataatcaccaataaaattatctcagtcgttgatatatgagttctagtagcagtaaaaaaaattctacatagagatggtagtataaatatatatgatctgttgaattagaaaaaaaataaacggtctaacttaattctactttcattaaaaaccattgtaaaacatctcgaaaattaaatgtggtttaacagctttttaggtttgaccatagtatataaaccgtgtctagcttggctgcacgacaatagcattcctacattcgttataaaattatgtagtgtgcgttttttaaaatctgatatttatcaacatattatgttattatgtagaaaatgggaattagtggtcaaatagtgccttcttgaccctagccgtgtttagttccctgtccaaatttttttaaaatatatagacacacatttgaagtattaaacgtagactaataacaaaataaattacagattccgtctgtaaactgcgagacaaatttattaagcctaattaattcgtcattagcaaatatttactgtaacatcacattgtcaaattatggcgtaattagactcaaaagattcgtctcgcaatttacatataaactgtgtaattggtttttttcgtttgcatttaatgttctatgcatgtgtccaaagacataaacatttgatgtaacagaatttttggaagtttgaaaagaactaaacacacagccccctgtcaatgtgaccaaaataattactaatacttgccgcagggtagagtacgtgacagcttgataacattgcaatctcttggattaaaatcatctggtaccgcattactccaaagaaaccaatggcatgaaggccacatatttatgagctgttggtgactcattaatatatcccagataacctgcattgccttcatggacctgcagaccaaggaacagggtttgacccatcattcctctgaatcttgtcatcaaaatcttcacaaaattgtgataaaaattgtcagccattgaaaatttgacatcttgacccacactacgctaggaagagagatcacagcagagcaaagtgatcaattagccatctcagcattaattaattaattaatctacactaatgatcagcatcaattagtttttagcaactgtacaataattccctcacttgccattccttcgtggaaacacaaaagaattagcacccaaaaaaagagaaaaagagattgtcatctcttgatgaggctaaagaaaaacaaaacgtggtcgtcgtcttcctcgagaacagcttaattagctctcctcctccatggtcgccgacgagtagtcctcgaaggtgatgcacgacgacgagggcgactgcgacgggatcggcgaggacgcgaggctcacgagcatgtcgatgaaggcccccacgatgacgccatggacgcccttggcgttcagcttgaggtaccacgccaggagctcctccaggccctcccagtcccgcagcccgtgcgccgccaccatgtccgccatcgacgacctgaagtcgccgtaggggtcctccgactccaccgtcagcaccaccgcgccgcccttcagcgcggcggcctccgccgcttccgcttcgttcttgccggtctgcggcgtggtcatcggcgtcgcctcgtcgacgtcgtcgttcttgcgagcgacgacgtccatggctgtcgcctcgtcgtcgttcttgcctcgcgccatttcctgaaatcctctctcgtgttataacaagatcgattgctctcgcgtcgtcgcgcgtcttaatcgtagtgcgcgacgtgcgccgcattacctgcttgggcaagaactccgcgccggcgggctcgaaaaagagccgctccgagcggacgccgcgcacgacggccgtctcacgcagctgcagctccttctccttctccttctcctcctccacctccacctccgactccacggcgaagaagctccggtcagcaatgcaggacgacgcctcgtccagggaggagcgccgcgggttgaagtgctccagcgacgacgtgtcgtagacagtgttcacggtgcggtacacggagccggcggcggcggcggcgtcgtcgtccgcctgcccctgctgcggcgccgtcggccacctgaacgagctggtgcgcgggtgccggcacgacggccacggccacgacgacggcgccggcgggtagcagagctgatgccggccgtggcagtgcggggacgacgacgacgagggcgacgtcggcgtcggcggcgcgcgatggtgcacgtcgcggagcttgtacaggataccaacgagccccttcttggccatggcagcagccggctggcgtccgccgccggcggccacggcgcgcgcccgcttcctgagctttccaaagtggaggtggggagggttcaggggaggcattgcgccgccgtgtttgacggaggcggtggcgtggcgtggcgtttattttcgcttgtgttttatagagagggagaagagaaagaggaggttgcagcacatttacgagagggttggagagggtttcagtagaggaattgaataccgccattgaatggtctattggccaatgactagcacaagatttgatgtggtgtgtctttgggtgtgtttagttcacgttaaaattagaagtttagttgaaattaaaacgatgtgacagaaaagttaaaagtttgtgtgtgtagaaaagtttggatacgatgaaaaagttgaaagtttgaagaaaaattttggaactaaacttggcctttcactcccccatccactatttgcttcattttctcagcatcaattttagttcttttttatttgactgaggagtgatggtccctgtacctgcttactgcaccttctgtgaaagttactttctccatccataaaagttacacatattttacatttaagtttttctaaataaattgttcctatttatagtctttatatattcaagatttaaatgaagagataaattacatgcttcattaaaactcaaggagtcatctaaatacttattagttgcatgtttatattcgctctttgattaacatccaatgtgatttaatttcttattggtcttggtgtcaaaagtaatatgtgtaacttttgtggatagagagagtagaaaaaaaatggtattatcatgaccattaaaaggctaaaaaatagtactgtaatatttacttgaaaggagtgtttctactcatcatcactgatgatactccttccatctacaaatataaggagtagactctagattggttagcaaagttaagtgttgaggtgaaattactttcgaagtaatttccatgtgagtttaattgaatggaaaggtcatgcctagtagcaataaatgcaatggttggatgaaatgggaaaatagtactccacttcaaaatgaaaccccgcgagttgctgtgggagttatatatgataatagtataaataacatgcatatagctacacgacatcactttatatactttatataattttcatctgtgatcaaccatggaagaaaaaaagttataaacaattaaaatgatatggtttataacaatgtaaatcatatataaatagattattcaaaagcaaaactaaggtgatatacctcaatgacggaatgaaaagaagggaaatgatatagaataatcatccaaagacaaaagaaagatgatatgatttcctagaagaaggaaaggagggacataatttgaaccatagatcaatcattcaagggttagaaataattaagatgatgtggctcaatgagaaaaaaatagcattaactacacttggtgaggatgaactttatagaaatataggatttgcagataaaattgaatccataattccttatatttgtagacgaaaggagtattaactacgtacacatcattgggatataagttaggaattttgtggccgctgctaaaaaaaaaagagatcagaacaccttgaactaatggtttttgaaacaagattttgatctagaaacatacccctcattccattaattgccgttgaaaataaaataggcgttttaggtactcctctcggatatttaggataaaattcaaaactttaaaaactgtaatcactacttttgttataataggtttacaaaatctaataatttattatattgagtgtacaaaatataaagaatttttgtcattatgatagtcgtacatttcaaatatacgtataccttttttttttcaaattaagcatttgggaagtcgttgatggtcaaagttccgtaaattgaactaaatcttatctatgaatgttaaatatttattatctgcagtgtccatttatgaagaaaacaaaatcgagttcagaaaacaacacatatgccgtctctgttcaaagtttgcatactgttatgcactgtaatactgtatcataaccttaaacagaagaaaattagagtttggtgctaacaacctgtgaaccaccgcaacatttgtatgctataacttgccaaaagcatggcttccacctaacgttgcaatttaatcttcagttatatatagaagattttaaaatttagaagtccttggaggaaagcttattaacaactgacattttttagatagccatgtctgctgcgaggattgtggtatgctcatcatgttccttgctctctggctggatcaacagctttcctgattattttttatgtcttgcaaagccactttctgatattttatctgatagctgtttctggctttgtgctataagcaaatacttgaaaagaaaacagcatcaaatctaatagctgtgcactgtgctggtgcagtgttgttatcataagtctaatgcacattgggttcattgtttatttttggattgcactccgtttcttattggagcacttacatttatatctcttccgaattttgctcgcagtatcctctcttttttttttaattggaaactgatcaaatcactttctgaacctcactttcattctgaacagtcactgttccctgccggatttttgaaaatagagataaaaaaaaagaaaatctatactagtagatgtgcctggcacaatctgcaagctattgaatgcgaggtagcaggttgtaagatgtcacatttatgtttttctgctctgctctgggagactgcaaagaccctggtatggccaagacttgcagccagaaaaacattcatctgaagaaagaagacgagctggaagtgcagcatggatgtatctttctgttgatcaaaactggatgggtttcaaatcacctggtgagtgagggaggagtgagaagggatcacagacaatcatgggttgggcaatgtgacaaatttgaaacatgtcatatgaaaaaacaagaatctctctctctctctctctctctctctgctgatttaaataaacaacgcatagttgccacactccctgtcctgtactatcattcgcaaataaccatgcgagtttcttgggttgctgcagtttttggtggcttaagcttagctcccctcgagacgagcttaacctccacgcgcgcgagcgtgtcaccgttctcaagaccgaacgcttaagcttgattgcttaattaagcatcgaccgttgcatcttttgagaaggaaaagcctttgtctgttcgtgccttggttagaacttaaaatacatggaagagtatttgttttcgattcggagtaagtttcgtgtcgtgtgaaagatggagaactgcacgtggagaagctagcttcatggggcgtagacgaccgtcagatcgtgcattcgatggtctagattgagagtccaacgtactacaatgaagcgcatatgttggcattattgttctaccattcggttgatctggatcatcctttttttctatcattgaatagtagattataaataaaacttgtagtttgccagttatccaacgcccacatgtggcaatgttaggttatgcaaatttaagattatcctttgacaagagaacaaaactttgagagataacttgtgtccaaacagaaacaaaatagaggggccaatggctatgaattccccctaatgtgacatgatgtcccctatcaggttctcctgtaccttaggacaagaaaaggttggaatatgcatcaacttgtttcaacaaaaagtggatcctaaaggctaataaaggttgacctaaagtgttagtgcttaaagggaggcagtgcctgcacttttcagggcctaatgatctgtccccttaaaaaaaagggggaaagaaaggctgaggcaaattataaaccgacaataaaaatggcctacatggccatcttgctttaatccttaatttcttccaggttcttggttgtgtttggaagccatcttcttgttctcttgtagcgactgctcttcttcttgattgtgtagttcttgttcatgttatggagggtcaggagcaaagagccttataatgcgtgtgttgttggatcgatggcatcttattaaaagagtaaaaaaaacagagctaataattgagacttttgttggcattttgatcattaacctctcatgtcgaagaagatgcatcaggcatcagcagaatgcctgaatttacttaacgcaaaaggacaaagagcaggtggttcccttttatgctgcacatagttatgggaagcagatttggagcatggggagcagaagattcagacatctcttgacatatgtaacagcaacttttggttctataccaaattaccatttctccactgcagctagaatttctacggaagaacagagtaaattagcaactgattcagtaattctccatcagcacatgcgaagttgactccttgcttgtttcttgcgtggacacttgacagcatactaattctagtagcatcaatgtatcaccctgggattcccattgatcatcaccttcgagaaatgtttaatcgctcaagacagtggctggaatttagagccaatccatgatcgaaacaggaggcatgcgtgcatgatcaccatcaaataactgcctaattatctactctttggcctggatgaacactgaacttgtcatacatatacatagggagctgcgtgattgatcaccgtgagaaatgtacacgaagaacttaacccgacaggtgtgacttaaacaaatcaacggtggttgtagctgtaggtttgtgagcgattgttttttttctctttcctgtcttttgcatgtcaatgatagcttgattgttttttcatggcgaaccttcacatgttgcagggagagtgagacgacctgcttgccctgtagctaactgatcctgtcgagaatcattttcttcactgtgagatattgtctatgattacattttgttattttccgggaacgatggtattgctgcgaagttgacgtgtcatttgatctgccacgtgtgaatgtgctacgagttgacaggtcgctgataggtgtgtggattggccggaagaggacaatactgccatacacactctctcctttcgactcctatatactccttcagtccctgtgactcctgcatatgcttcttttgaatataggctttcacacaaaaattagaagtttggttaaaattgaaatgatgtgacggaaaagttagaagtttgtgtgtgtagaaaagttttgatgtgatgaaaaagttggaagtttaaagaacaactttgaaacctaaacacggcgatagtacaaatatagaggaatggcagaggatttggtgattgttcaaaggattcaacagaaggccttgctgtacaagtgcaaggcgttttagcattctcaactctttcaagaatataagttagtttataacttcggtgcattttgatctttcgtttcgtttttcttaaaaaaacttcagtttatgtttgtccttggaaaataaatgaatatttgacatttaagacatgatctgatcaattttttttaaaaaataaccatcagttttatatcatagtaagtttctaaaatcttataagtttatatagtacttttcaagataaatctaaacaattttttgccttttcttttaaactaataatttgagaagttactaatggtcaaagtttaaaatgtaaccaagtttcatcctaaacttaaatatttatgaccagtgggaatatcgttcatataaaaatatttttgttcggacgtcatgttttggaatcacacgttcaacttaaaaatcttgaatcaccaatatatataggagcaataagattttatatgtgcaagcagcatcaatagacttgctaagaaaaatatttctacctagttatgttcagactacttttttttctcttaaaaaatttaacttgtttccaccgtccgtcaatataaaaaaaacagcgaaaaaacaacctaaaaaatccgattccctggcaaaaaatatagatccgattcccacctaaaacgggaaaaagcaaaaaaaaatccgataactggcgaaaaaaaagaaatgtagattaaaaaacagatccgattcccacctaaaacaggaaaaacaaaaaaaaggtccatttcctggcaaaaaaaaacaaaaaagaaacgtagatccgattcccacaacagggaaaaaagtctgattcctgtaaagtgaaaaacaaaaaaaatcggtaaaaaataaaaaaaaacccaaaaacacatctagaaaggtccgactctataagaaagtagcgaaaaaaacagttcgtaaaaaaacgcacgagaaaaaaaaaggacggaaaaagcgcggcaaaaaagtctaatttctattcgtcgttttagttttccatatatatatctcttctctatctcaaatctaatctaatctaatctaactaaaaagagaagtttccatcgtatattaaaaaagaaaaaatgcgcgagaaaacaaaaacagtttaaaaaaacgcatgaggaaaaaaatgtaaaaaaaaaagcgcaaaaagaaacgcgctagaaaaaaggttttagtagtttgtaaaaaaacatgcgagaaaaaaatatttccatcgtctataaaaaaaatcatacgaggaaaaaactgtcagaaaaaaaaatgctaaattgatgaacgcttggtcaaataggatccatcgattttttttccatctcctacacggcttttgttttgttatattatatggaaataatattagaaaataaacatattttaattgttatttagagaagagtgcacggtgactctattttgtgtagacttgaccatgtgaggcagtataggattttgattatttgcaataatgaaattaaaaaaatattttagattatatgaatgttgtcatatgaataatccaattatttttggtaaagcaaatatcgtaaagttgccatcatcgaggttgggctattatatttatgatattccaattttctaatattttgattgtcatcaacatggttatgcatgaaaaatgtatattatcattacattttttcacccgttgcaacgcacgggcatatttgctagtcataaaaaaatatggctatatgttcttagcagcgacaaaaagcaaaattaaacgcaggatcatttatcatattgacatagtacatattgcggaaaaacgtgatttattagctctattagttgggctattgctcacaaggcccggcccaatcaaaagcccatgatgagctctgcaaaacctgaaaggaaagccctagggcggaaaccgtaaaatcgactttattcctggggttttcgcttcgaaaatcaaaagacgaatcgaagcggaagtgctcgtcttctcggcttcttctaactaggtaattcgagcaagcaactccatctagtagccattcttctgcggatgggcttgctccaggagtcccgggcgattccggattagcgccgtgttatttggtctccgatccgaggcggtaatttagggcaggttttttttttcacctaaaattttgatttgggggtcaatgctgagttgcttttagttttagctttaggtagtagaaaagagggtgcccggtaatatctgggggttttgttggattcgacgttttggagtcgctttcgtatgcccgtttaaccaattttgatgcgttataccatagatcctgctggatggatggtggattgctgcaggtttcttcggtcatctgaaagattcattcttatccaaccaggaactgtaagttgtgaaacttgattttgttgtgtctagctttgagatgtttggagatggaatgtttatgctgtattgcatacagcgacacaacttcaatcattgatattcggactcttcatattcgtaatgtggtaatgttgagtctattcattcatccaattcaatgtatgggccttacgaatattcatgggcactcataatgtttttccccactttttcggttgtgtgcattgcacaagttgagcacaattggtggtgatgtcataactcacttttgctagctccatgattcagaagaattttccgccaatttacagtgttgaaggtgttgtcctgatgatgtcccacaataggaagctaataaagtttattagaacagagcaacagaatgaatgctcattggttcatttctggtcttctctatgcttatgtagcagtcatgctcatccctgttactggtattaggatggaatctatattctgcttgttcttccttttataagaatgcaccgaaagacaaaagtgcatcagcatgaaagaaaaaaaaagactttgttgagcttcgtaatttgcactcgatttagcatttttggatcaatataccagttcttgcgttttctgcatactgaatgctgattttctatggagttcaggagatccatgaactcaacacaagtgtacaaatgcagtttatctctgtttttagtgaccccctcaagcctcatttgtcttcgatctcatgtttctcttgcctactctatttttggaccatgaacttagttccacaaaagtggagaaccatgggtaatgctttctttgtctgttttgcattgttgggttcctgactggtattgcaattctttgcaattagctatgtccttatgttgcaggagtatttatgtttaaatgatgtgtcctctagttgttcaggacaaggcgagtgcaagtaatctcacaaatatatcaattatatcggttagccacattttttttaggctaagtcataatatattcggcctgcaatttagttctagttaccttttcttaatctttttgccattcagttttgtattttattggctgggccattccttttcagttgtcttgtcattaaaatactagaatacagctagagacactgttgttttcgttgattgatgaataaaattgacaagtttgccgttaccagtcaacagggaccaagggacatctaatttttcatgcacattttttttccatctttatttgttattgctctctgcccttctgatatgatttgaatcaacttgtagaatggctggtctctatgtgtgattatgaagatctggacttaatctgagatgtctttatcaagtgaacataaatatatcagcttggcaaagttgactagagaagcaattaaggtaggttgctgcgtcacacagcacgtatttcagatggatgtatattatgaagagataagaatgacggatgccaaaattaatcgctattcattgcatggcatcatcaacagcgtttttttcaacaatttcaaatactatatctcgtcctaatttgaaaattgcatacctttttcaattacataatgtctttttcagagatagtagagtgtccatggaaggcgacctcattatgttgcaacgtgggagcagcagtaccaattggttagttcagctaacctgtgatgacagactcgtaaacatcccatttatgtgattgactgttcttgctgtgattttttccccattttctatgctcgactagattaccttgtctaatgaaacagcacagcgagtcagaattcatgagcttgatagaaagccatcatgtgattcagaacaataatcatctcaacattttcagggtaaatgttttcttttcatctcggaaaggaaacaaaaacaaaacaaagatgagaagtctggtcctatgtctaagcaaaacttcttcatttagaaccactaaagaaggaagccaggagagggggatggatatagtccccagtgtatccatgatgtatcaaaattatgccaccagcacatggattttcatgctagtctcacaattttagtaaggaatatatcatggttacactgggggaataggcaaaacaaaagagaattactggacctaggacttcatatagacgcttttctttttcttgattgatgttgatcttctgccaaacggagaattgcccccccttttgtttaacttcaccctctcctggtcttcctgctgctattgctgttggcgttgttgttgccgttgtcctgctgcaggaagtcaaggatcacggggctcttgcactgcgggcaccgcggatcatcctgcgggagcatgacgtagatgaagcagcgagggcaggcggcgagcaccatggacgtcgcctccgggctgttggaccactgcaggccgtgctcgttctccgacgacaggcacgagctcggcgacgactcctcgtcggcggccatcgccctcctggacgacgagtcccctctcgccggcagcgagaggttcagcttcaggtcgatgcccctagagctcttcttgttgctgcggctcatcccgatcgagaggtaacccacttgcctacacccccataaaaacgttcgttagccggttggtcaaatggaaacttttgcacgactgtcatatgaagcttagaggtaggagaagacatggcgatggcgaaggaacttactgttgcgtagggccggtgagacgtgcagatgatggtgattggagacgatgaaaggggaggagctccgagcgggtagaattgctcggggtcttcttgctgggtggtgtggttggacggagaagagatggcaagtatttatagggggatgagatgggtgagggtgagggggaggtcaattggttttctttaatgcagcattaagagtatagcagtactactactacttcatgtactagaggctaaggaaggacgcattttattaccaaggtattcatggctggagagtggcatggtaggggttgaataatctgtgttgggtgggagagaagtgcgaggtgagaggctttatggttggtcatatacacaaggcaaagaaatgtttttttttcatttatctgaaagaagaaaatttccagtgatgaatcttctctttttttttcttacttcggcggtagttttctttagccacatgctagatgactgtggcaatctcccaacagtgagcctggttgaaaattgtaacccatgataggcatgtctagtttaattgtgccaaaagtttgctagtgacttaattacctccagtagattttacaactttgtagtggccatgtaagcaagttagctggacttattgggtaattatgacaattatttattatttttaggtgtggagttgaaagttgaaactcatcaactatttgtcctttttgattgcttctaaagattatagaaatttgactgacctccaattcatttcactacttcaatgtggccttgaatggaatttattgggcacaccatctcaaatgcccagcattgctgtcaaaaaaaaaaggagagaagagagaacttgaatgttgagccatggttatgttaatcgaataaataggtttcttgaatagatatgctgctagtgcaccttatgcaattaggtctttaaatggtgcaacgcaacacctatgttcttgcacgcaccgatgcgttgcttctggtgcgcatcttgatacaatgacgacgagataagtaatacattaatgccactttgtttgatgcacataagagcagcactttgaaatctcagctccgttggggtttttcttgtttccagcttgcagtgtttaaatgccgagagcagatattaaattcgttagttgacttgttagtgttatggagatgttgcatcctgattgtgtgacttaatcaccttacaattaagaaaagggttaaactttgtaaagtcatactagtatcaacccactaatgtaatccccgagattgcttacatatcccaccttgattaatgatgatgacatacaactcacttaaagttgttttggtttgtgtgttgcattgggtttggtcaatgctgctactcatcaaggttaagagatagccacctgtagagaaaataatttgcctcagttaggactaattctagcattaatgctcccgttttgggcaaatagaagcagtaatggatggttttgggatccagagccaacgctatcggcctcgggatcaaaggtttgagttcagtttacctgattttataatatttcaccaccattcatcatgattcatcgatgatgcgtctaaaattgcaggtaaagtctcggagttgaaggcaactatgaaggcaaggttgacccaaatgcgagctcataactgtgccactaggttattgcttagtacaggatatggtatataaatgtatctttgcacgtatatattgccattagtcggtgtatgggggccaaacccatgtgctcttctttaattccatggtggcatctaaggagcttaattagagattatgagtgaaaaataatctccactgagttttctcgcgccttcttgttgtggttgcaaaggcaatgagctccaatgcaaaatagttggatatattgcgatttcgcataaggtaccaagttattggcaaaattcacaatttaattactttttaaactccagctgctgttctagtggactctcttgttgcttgtcttattttgaggtatgtattgatgaatactatgatagctcttttggaacgcatgaattttataggaatttcgtgggagttagttgaatttcagtgaacgtcctgaaggaggccctgatatttgtgctactgatatagtatttgtggtgctgatgatcagatgatgctgatatgccactcgcttagtgaagacttgcgaggtgtcgcgcttagatgtttgaattggatagaggtgatgggagtatgtcggatgctaatggcttaattaggccgtattattaagtggatcttatatggctagtccatgtcacttgtcagcgtgactacctattccatcagtttccaaatataagcactttttacattgcttattgtaccctctgtccaatatatgatgtcatcgattttttttataatgtttgttatttgccttatttaaaaatttagtataaatatgtaaatgtataagttaatattatagtttcttttatgataaaacacacaacaaaataaatgatatttatattttttttaataagatgacttgttaaacgttatgtgaaaagtctacatcttgggacagagaaagtacatattaagattggagataaaaactatagtgtctgtaaataaagcaatggatagttggaacttggaagtgggatgatggttgaagataaaattgggagatattagactgagtagtgagagtaggactctaagaaatgcttatatttgtacacaaaatttgaattctaaaagatagttatattcagaaacacacagggagtacacttttgataagtaagtttgtacactttacaatattcgtttgacaacatcgtccagtcaggggcggatccagcataggggtggcggggtctcgagcccccacgaagaccccactaaaattttttaccatatatagataggaggggggactgtaacattatctagtttgctcagaccctactactattttttttctggatccaccactgcgtacagtatattacatgtgcagttgaggatgtggtgcggtgtagtagtgtgcagttgaggatgtggtgcggtgtagtagtgggttgtagtagcgggttgggtatatgaatctatcttaggtttaaattctagtgtctataaatattacatgtggagacgcagtcgaaaatgggtgaggttaaacatccatagtcaaagtatatacacttgtgtaattaatgtgcaggaatactagcaaaataccagtgcgttgttacagaatatagaaaatcacatcggcgcattgaaaaaagaaagctattttgaatttagagtttaattctggaatgaaattagatgttttatatagctgtaaaaaattttaaactgactcaattgacttatcattacttatatttggttttgagaatggacatatgtgtttcacatgtcatagttttaggagttggtgatggacttatggtaaacccaacaccaccactactctcttttaaataattataaatttagaaggatatatgaaaatggtatgttcaaatctgtcttaaaatacattttcataatactataacggtgttatgtttcacaatatcaatcatagttgaaatcagtagttaaattcgcatttcagagtctattccaaatcatttatttgtgatggattacttgtaaaatccaccataaggaacagctgctttcgaaaatgatgtcaccagcagcagttttagtaaacaacttcattgttctgtaggttgtgcaatggataaacatggacaaaatgcaagaatcaaagggtagacagaattttgagatgttaggatacttcctgaaaaaaaaaaggaagttttatttcaactgcggtttcattcatacaaataaacttcaacagctagacatccatgaacaagtttcattgataattacacctcaaatttaagctaagttcaaatatttgaaacagacgatcgcaacttccaacggacacataccctacaggttttatgaacgatagaaaacacagaatgaaagatcttcacagttcttaaataaaaaggaaaaaaaatcttcacaatcctagttggccgtcggcagttatttttccatgccttcattgcttgcatcgagagaatagacaatagatcatcccgcccacgaagggaacatctcctcaatattttaaccacacagcgccgtgggggttaagtgccacacggcctcctgtaacacccacttttatataagtttaggccaaatatcatattctaatcctaattaaaaagatcctgcgcattaacgctgcagcagtgagtcaaacacctaatctccgctcacacgcacgggcgtgtgcaactaaccatgcattaagcaataggatttgtttaactttggttaaaagatagtggattcaaagtgcagggcatcgcattaatcttcgcttaagtgaagggattactccattttaatgatggtacgaacttgtgactaaactattgcaagaagctgacacattgtaagaaaaaccataactactaacccaaatggtttgaaatacaaccattagcttcatagatgtcttcaataaagaaaaactaaaatctaataataccaccataattatcatgacaacaaagtccagacctaatgtcaactctaaggacaagtctaaatcttatttatttccatttaattgttcgtacaattctagctttatcttatatactcactatttatctctatgcaatatcttctgagtttgaaagtttagaagatatactgagaagtatccatgcaatatacaaatgcaaaaaagttgacatttgatgaaaacattaagcaaagcaatgttggtttgctctagcacaaaacaattggtcatatgatttaatcaaccagaagggtgaacttgtatgaacactcaccagtatgttgattctttgagatccaacctaaacaaccgctgataactcgaatcttactcgcagcacagcgggtacttgctcaaataacctctttgttatccctgacaaagaagaagcaggacaaaattagcttcccctctccaattgctgataacttcaacgggacaacgttccaggattcagttcgtgcaccgtggtgttagacatgtgatacgacatgcacatacactcgtgcgcatgcccacacggagacatagtgctgcaattcacacatcccactaagaatctaacatggaccaaccagatagcccgagaatttaatggcattgtttatatattgcccaaactgtcgttactccctagtgctactaatacaaatgctatagggagatgtttgaatcaacgcatgatttcattaataacaagctcattgacctggaagagcactggtgcagcagaatgcgtgggcaagttattaataattaaatcgacatgaagataagtttgtctgccataaacggagcctaatagattcacacaccaaaataataaggatcgtgcaatacctatggtagaggttctccaacaggctaggtgattagatgaggtctatatacctaggagagcacatgcaaacaccaaaccttcgagcacaggtattatcatgtatctatgggtgtactgatatcctttttataatcagaaaatactaaacatcatgacttgccaatgatcccactacatcaccatgcacagatcttagataaatctggctatatttgatttgaagattcaggaagaaagatgatatagtgcaacatagtggcggtagtgcctgtccgagactgcaagctgataactaccagcctaccatcgacattgcattttatagaagacacttcgtgcagtatcgttagcgaattcattgtctgatacatgtgtatatttagcatagcgttgtacagtcagaaaactttcagctcaaacatttctcagtgatatgacgctgggccacaaaaacacacacagccacacaggtgacaggcactatgcagatgaaacagcaacaaggcctgcagaaggtggtccacttgacgccactcaacaacaagtctaatcacttttgtttaagactaggatgaggggacacaatttaataggagcacatgttactaccttaccagttaccacatttgcaaaccaaattccaaatggaggaatctgaaagcatcgcgcctcttaacccagaggtgacacgctacacgtgggccttaatggaaactgcctgaaatattactgtaagcatagcttactcattagacttcatcagccataattgacttttccaggtttatatttctgtgagcatatgccctcgagttgataggtcattggtatcattaatggctgataacaacaccaaaaggggtatgcaggtgcaacagaattttgaaacatgattggaattgaaatgaattatgttattactgaagtaattccaagaaaagaagagctcttgtaatgtttcgtaaactcaatcaactaaaaccttgatccttactgtgatcacatgacctaatggttttcaaagcataaatgtgacaataaggctgtttggtttatcgcccaaatcaaccctaacgaattcttgtcatgcaaaattttggcattgctaatatttggtaaggtagagacacacagtagtatgtttggtttgatgcaaaataacatccatggtttttcacatttcctgcaaataacacacttattgcatgcatgaaggcaatataagcaaacattctatgtgctactttcagttagcaagtctaattgaaccctgtagttctcaccttcaggaagtatagccgaggcacgatgctcaaaactccaaaattttgcactccacaacttctggatatacagttgttatttgcctcttctatatcaatgaattaaggcagagcttctgcctttgtttcaaaatgaaacttctggatacaattatctgagtatttgaacatacttagtgagggcattgaagctcaagccacacatggaaaccaagatataataggaatcctaaggacatacctgaagagctatatacttgttttttctgattaatgacaaccaatatcaggataccacatcacatactgatcctgccaaggcaaataatcagcaaccttttcccccatgtaaccatcctagtttgcatgatgggtagtagttcagtagaaatcacattataaaaaagctcgaattgatgaacaataactaagataggtagtaaagaagattaggaatgaccaagcgagcactcaccgggagtcgtctcatcaacaattgaaaaagtggatgagactcagcaacagaagtggatggtatcaaaccagtgtcacggaatcctctggttctcataaggtatcaacggcagaaagaattcaaagcactccgaagagaacagtctacttaagatggtcccgttcctcttattaactcccatacagcttgttaacaagcacatcatttatgtcatgaagccagatttattgtaggcattctcaggttgagtgtaaactcttggtttctattgatctcataaccatcatgagtcaacatgcacagcattacagcacacatggtttttcctctcattcagaaagatgttcactgaactttccagtagggccagtaaacatatggcaaaataaatccctcactcatctcaaccatgctactgcaaaaccaaggtacagcctgcaattttcgttatccctcttcctgtcatctcagctctagtttcagaaacatttccccatcggtcaatgttagcataaatgtttgacaacgagacataatttccagcattttccggttcaatttcaaagagcttctttgcagcaatttttccaagctcaatgtcacaatgaaacttgcatccccccagcaatgcaccccatgctcctggatgaggttctccaggcattgacttgataagctcatatgcatctctcagcatcccaaaacgtccgagaagactgacaaggcaagcatagtggtcaccagatggtacaatcatatactcattcttcatcatatcaaagtaccttttcccttcttcaactaggccagcatgactgcaagctgtcaaaacaactgtgaacgcggcgttatctggggtgatgccctccaagagcatctgagaaaaaagctctacagccttgctagctgaaccatggaggcaatgaccttgcatcattgaacaatatgaaaaaacatctcgaactgacatagattcaaacaaaagagtagctctctccatgttgccacactttgcattcatgttaatgagacccgccatcacatggacattgttcatgtctattggataaatcatgatgtaaccttcaatccatcttgccaatgtgatgttaccaagttgggagcatgctgacatcaaaccaacaataacaagctcatctggacatatttcttgcttttggaactcgttaaaaatcctcaaagcctctccagggtaaccgttctgtgcacaccctgatatcattgttgaccatgcgaacaaatcacggtcctctagcttatcaaacaatgttctcgcagctcccatgttccctgcatttaaatacccgccaatcaatgatgtgtacgctgcaggagttctctcaggcatttcatcaaacagcttccttgcaccctccaagtcaccgcacttcacatacccatcaaccatggcattccaatgcaccacatttcggtgtggaatttggtcgaacaactccctggcagtcaaaatatcaccagagttgacataggcagtgacaatggccgtccaagagacctcgctggggtttgtcagtgaatcgaacagagcccgggcggcggcagcggcgccgcacctcccatagaactggatgagcgccgtgcggacgaagaggtcggcgtcgactccgaggcggatggccgcggcgtgcaaggaagcgccggtggggagggaggaggcgcgcgcgcaggcgcagaggaggggagggaaggagaaggcgtccgggcgggacgcgcccccgcggaggaggttgaactgcgcgagcgcgtcccgcagcggggcgtggcgggcgagggaggcgagcacggcgttccgcaggcgtaccgggacggcgacggagaggagggaggcggcgacggaggggcaggagagggcgtcgcaggcggcggcgaagcgggcgaggagcgcgtggtggttgtggaggccgaggcggacgatgcgggcgtggagctgggcgaggcagcgcgcggtgcggcagcggccgaggagggtggcgaccggtggggatggccggaggacggcggtggtcatgcggcggcggcggcggcgagcggggaggccggccagcgggtggtcgcatttggattcgcctcgcctgggttaccgagtttcgatcgctcgaacccaaagtcgagtcgactatggatgactggatcacgagttgggcttgggcctagccatgttggtgtggtgctagactgctagctagcccagtagcaaacgagcaactaatgtaaaaattcagaatttttttgtacatgtttacgatttttttaaaagaaaatctacacatggttttcatatatccaattgaaatatttgaagattgatggtttgattgagttttggaaattcaacttataaattatgtagaatcaaaacaatatgttgtatcctgaattacgttcgttcaagaatagctcaccggttatgtttcttgtatttgacccaggccagcctgatttagggctattcagattgatgtcattttcaaccatactatttttgagtaaagttgccaaagaaatgtctatgtttagtttgttgttaaatttggtaaatacataaaaaatcctgccaaaattttgacaatattgccaaaatttttgaataagtctatgtctaggtttattttggctataatctgaacagaccttaagtcctactcactccgtccctaaatatttgacgtcgttgacctttttaaatatgtttgaccgttcgttcttattaaaaaatttaagcaattattaattattttcttatcatttgattcattcttaaatatacttttatatatacatatagttttgcatatttcataaaagtttttgaataagatgaacggtcaaacatgttttaaaaagtcaacggcgtcaaatatttaggaaataagagagtatatcacaggtgtttgtaattatggctaattattctttcagtggtagacgagatacctatcgacagcaagatgttcgtgttgacttcatcaatcttaagatatgtcggtccagtcttttgaaaatgctagaaaatcttataatataaaacggaggaagtagtagatatgaggtatcccatacactcatacttactttacggggaatgtagttatctactccctccgtcccaaaaaaaaaaggcaaacctgggttcccgtgccaacgtttgactgtctatcttatatgaattttttttataattagtattttcattgtagttagatgatacaatatgattaatattttatgcgtgacttatctttttaatttttttcataattttttcaaataagatgaacggtcaaacattagacacggaaaccagggtttgtctttttttttagacggagggagtaattgtacacaaaaagatatctatgaataggggtatactaggagtgaatacgcgtcacacaaggaaagattgcatagttcaagtcatagacgttatggcttcatggacaagatctagtgtcctacttgggatcaagatctacttgaaccagggtcgtattccggtataaagacacaccacgtcctaggagaatagggcgtcaaatctcaagccacagccttcatgccaaatccatttaggggaagcccagagctagccgccaattgcattgttgccgcatctttagagttgtaatagtatagcccactactagctctaaattatctatagccaatgtaataaccaattcatacaatagttgcttactatactattaatatctgatcctatatatcatacacacattatgttttggagtccgtgctgcaactggctacagatctgtagcccactgctattctctctatttctttatctttttaaaatatgtttatagttggcttatagcctgctattgtacctgctcttagtcaaggttagttgagtatgctagattagagatcccacctcagacatcatactcagtgtgatactttcggtcaatagatataaacatgaatagaactattactcacattgagggttcgaacttgtaaaaatctaattgcatttcttcttatgacatctacgtgcatatccttataccgatcttatacgctacatccacaaatactatagccaggatcttactcctcaataatgctatttaacaaattctaaaatatttgacaattgtataatcaatgaattatgtaaagagaaaggttatattacaaaccaatcaattttgtgttcttaaatatttgttaaatggcaaaatttgctacatgatatcagatattatggtatttattggtcgataccgttaaacatgggttggttttgtgatactacaaaattttggtggtccagtaattttggtggtctgtgcgagtgtgtaattgtgtacaactgtacatgcagtgtcgtttgtgcgtgcgtctgtgtctaattgcgaaaaagatttagccacaacacatatatttgtcctttaaagttttaaggagttgaggagaattacaacagcgtacatccgcaagaggatcaaatcagagccctatacaaaaggaaggatatgcagcgcacacatccgtccgtacagtcaagctaaccaaaagccactgtggattcattcacttgtcgaagtagccctcggtcctgcccttgaacccgatctggccgaaggtgagcgccaggaacagcccaaggtgccacgtcaccaaccacagcctgcaaattaatcacaaaacccacatgaacaattagacacgtagccactgaacgcttttgctactaattatataggagtactatactgcgtgcctgaagaagatagaggtactgaccagaacggcgagtcgagcgccggcggcgaggggaagtgggagagctcctggccgatgctggagaagaagagccccgtgaggctgttgccgttgatcgccgggacgctcgacggcgcgatccacccgatcagcccgaacccgatcacgttcaggtccctcctaagccagtcctgcggaaacctgcaggcccaacacacaacaccacgtacgcaccgtcagaatctcacgccacgtacgcttgctgctctcagaattcttcttgcaggtgatcctactactgctacttacgtcatgcaggtgatcctgccgttcctctccaggttcctcgtcagcagcgggttcctcgccgacacccgggcgcccgtcgtgaagcctgcacaaaaaaatcgagcattccaagatcaaattaaacacacggttatagcgcgtgagaagatgattgtgactgtgacgcacgcaccggtggagaaggccggccggcgggcgagggtggcgccggcgaggccggagacggtggaggcggccatggcagctaagctagcagatggtctctctctgtctctggtcggcgagctgcgtgtgttgtctccgtggtttgtggcagcgtaggttaggccttattttgtggtggtggctgcggttgcggacgtggcgggaggggatgagcgggcgcggatcgttgtgggggctcgcgtgatgtggatcacttgcagcggatgaaatagattcgtcgcccgtgcagcggcctattgggagactccacttggatatgagtggataaggccagtgccacggctgtttctgccgtccagtatgctgagtactcagctagtagttcctaccgaggcaaacttaatttcgtcagtagaagactatggcagttttgtggagattatggataccccatatttacacggcatgtatatccgactggatatggaatgccatatataggtagaatatctttaagggactcgggttacattccttaacttgtatatcaaggaaatactcgggattctagtcggttacgactgtattttatctttatttgcctattccgttaggaatataggctataccttgtaatacggactcctctccctatataaagaggggtccgagtatctcttgggacataacttttctcccagatcatacgatcaataatatactcggtggattaatccccggacaggagtagggtattacttctcattgagatggcctgaacctgtgtctctaaacccatccacttttctagcttgatagccaccctttttcgtattaccgaaatctttgtttcgacaagtttaactgcacgtagtagtgtacccgcaaatcatactttggtaggcgatggccggcactatgtttttccagatcaggtactctgttttcgtgctactaccttggaatgtgatcgaggtctagactctagactatgcaattggtgaactggagctgtttaacgaggtaaagtggtgaacaggtagataacttgtgtggatgtgatgagccaccggcccgcctagttcgttcacctcacaaggcatgataccgggcttcgctgcagacagcagactttaccaattcaccgttgcacacgatcagaaacagcggctcgtcgtaagttcttaacccagcgggcgggagacgcaaatccgtaaggaataagttcacttcaggtcccctatttgtcgctcagtccgatttttgtcctgaaccacaaaaccgggtacgacccgtcccccaactttcaaaaaccggacaaatgagatccctcggcggtatggagagcggttttggccgacgtgacgcctatgtggctaatttgactcagtcttcatctgacgtggcaattcgatctggaaaaatattaaacactatgggacccacatgtcagtttcacacacaaattaataaaaaatggtggagcccacgtgggccactgggccccacatgtcattctcaccccacctcttctttctccccatctcaccccacatagcagcggcgccggggacaacgacggagcggagtggggggcggcggcaggcggacggcggcgcaaagccgacggggcggagtggggcagcggcgggcggacgcgcgggcgcagtggcggcgcccgaagccggcggggcggtggagccaagcgaacggcgggaacctcgtcgttggcggggtgcggcgctaagttcccgcccgtgtgcggctgcaactcggcggcaacctgctcgccggcctcctcttccccctctcccactggcacagccggccgccgtggtctcctcctcctcctcctcctccacggcagcggcgcggaccccgcgcgggggctcgtggaggagttcggggccacggcgccgcccgactccgacgaactggagctcacgcgggcgaggtgccggaagctgcacgactgtgtcgtcgtcacttgctcatgttccttctcattttgcagcctcatcacctgctacttgcctcgtgccgtctcgctcttcttcacatccatccaacgcagctcagtccaattatactctctaccaatgtagttgaccgaagtactacacatgtgttcaagctggcttcaacccccaaccataaacaccatgaaccataagcatgcagagtggcagacatgcagttgagctcttcctctagctagctatccattgattagtggtgtcgtttaggagtttgaggagctgcagctcgacggcaacgaggcagaggagggaccgcagcgcgggctgccgcagcagggaaggggacgcggacgccacgactcggtcgtgcagctcccggcaccgcgcccacatgcgcggccctgaactcctccacgagaggggagggagagggagagggagagggagggaggaggaagaagagaagggtgagaatgatatgtggggctcacgtgggccccactattttttattaatttgtgtgtcaaactgacatgtgggtgccacggggtttaatatttttctggatcgaattgccacgtcagcgccatgtcaatatcacgtcagatgaagatcaagtcaaattagccacatagacgccacgtcggccaaaactgccctccatactgccgagggacctcgtttgtccggttttcgtaagttgggggatgggttgtacccggttttacagttcagggacgaaaatcggactgagcgacgaatagagagacctaaagtgcacttattccaatccgtaaagatcccgaactcccgaaggccagcccattccgcggctaccatacacactagcgtggttacttttcataatatactccctccgtcccaaaataaataatgttttgcattgttcattcaatgtttgactatttgttttatttaatattttttatgattagtatttttattgttattagatgataatacatgaatagtactttatgtgtgactaattttttttatttttctaaataagacgaatggtcaaacgttggacacagatatccacggatgtacatattttgagatggatatagtatatagcaacctaagacaaaatttattgtagtataaaatatcacatcttatcttaaatcactatattatgatgagacggacggagtattactgaatggttcatcgcgatgtctttgctccctgattgcaatcagcttgcacttgcttcctaacaaatttcgcattaagtacaccaactgttcatttataactatgcgtcaagcgactaatgagatactcactccatcttaaaaaaagcaacttagtactgaattggtcttattataatactataaatctgaatatgaatagatatctatctaattcatgatactaggggtgtgtttagtttacgctaaaattgaaagtttggttaaaattagaacgatgcgacggaaaagttgaaagtttgtgtgtaagaaagttttgatgtgatgataaagttggaagtttgaaaaaaaagtttggaactaaactcggcttaggatacatccttatccatattcatggtatttgaatgtgtccaatcgtgtgcaaaattgctactccctcagttccaaaataagcgcaactatgaatttctgtgtctaattttaatcgttgtcttatttaattttttttaaaaaaactaaaaacataattcacgcataaagtattactcatgttttataatttaacaacaatagaaatactaatcataaaaaaaattaaataagacggacgattaaagttggacacaaaaattgatgcgcttattttgggatcgaggaagtatattttagaatgtataataaaaaacaatctagaggatctaagataacgatatccagattattatcctaggttatatcctattattatttatattggtttattttgaagcggggaaagaagctagcattctagcaaaggagtagacgagtagctcggttcattggccgtcgtaccatgggaaggtcgctgaagcacggagccacagagcaagagggtgtggaagtgtttaactggaactttggggcgtaccgacatccaaccaaaattttctccgtcgattccacgcgccaccgatcgcggcgtccgatctgtcctgaacttctgatcgactgatcctgatacatcagcgatcagttcagttttcccatcccgtacacagcttctggcggagagtgtcttacaggataaccgatcatcgcccgttgtcagtcaaacgaagccatgagatgaactgctctgcatcgtactacgtacagtgagcccgtgagatcgagagcgacgccgaccaaacagccttcgtcgacgggattccttcctaacaagacacgtccagagtccaggactcttatcagatccgatcgcaccaaagagcacgtacgcacgcgcggccgctgattcgagccaagtttttccctgggtaacatgctggattagatggatcaatcgatgcaataccgctagaaacgaaaagatggtgacaaaagcaagcaaaccttccaggacagcagcaggtcaacagatatatactacacaagaggaagagccgaatggtttgagtttaggtcatggaattaactcagaatacgggatcacaagcttgaggctggaggtgctgccaaagcactcttctaactcttcacctgtacgccctattcaatgaaaagacactctagtgctgttttcagtttttttttaaaaaaactcttcacctgtactgaatcagaattatagtataattcagtactgcacaacgtgcaaatagaggatcgatgaaggcggcttgaccgctgaagacacggcgacatgcaaaggagaggcttgcgagcgcgcatgagacaacatggggaatcttaacttggatgtcaaatgtggcatttggtccagatgaagttcctacattcattttctttacctaatcgaagctttccacgattccacttctagacttgtcctagttcaatgactaattgtccacaaggaatatgcgcgagtcataaacaagctgcgcagaaaacagcttctctctccgttttacaccctccattttatagggtaagtcattttaacatttttcatatttatattgatgttaataaatctagatagatatatatgtctagattcattaacatcaatataaatgtgaaatggtagaatgatttacattaagaaacggaggaagtatataataatgcagttaaaccgggagacgatgagaaaatggagatgtttctctagagagaaaaaatgttgtaactcgagataatgattaattggattaaccaaaataattatctcagtctagaacacaacagaaggttctctgtgagactaaaatgctgagatgcacttgacagtgcagtggagcggtaaggggtatgtaatttcaactccaagattttgtgtttgatcctaacatgctcataattttttcttaaaaaaatgtttgaagggacatttctccctccaaatatcttcttattttttagactgaaaatgttgaatttctgtctgtatgaagttatttttttgaagaatctgtttttactccgaaacatgccttgtgccgagatcactgccacatgttcctgagctgcattctttagctctaattagggcttatatggttctttaccatttgtgatcttaccatttttcttttttacaatggtaattactaattttttggggaaaattgactaggcttttgattggtaagggcttgtttacttttgtgtcacttttaaccctactaattttggtattatcaaatttttgtaaggcaacaaattatacatattcttattaatgttaccctaccaacctttggtagggcctgttcactttgatgctattttcaactttaccaaattttggtaaagttaacaaaaaagtggctacatttagtttgctgctaaattttagtaactatataagaaatcctaccaaaattttggcaagttgtcaaaattttgacaacattgccaaaatttggtaaggttttttttcggcatcaaagggtctattcactttgatgccattttcaaccttaccaaattttggtaaagttgccaaaaaaagtggctacatttagtttactgtcaaattttggtaactatataagaaatcctaccaaaattttggcaatgccaaagtgaacaggcccaaagttaacaggcccgtagttttataagtttccactcgtaaaaattccatcaaaacttgataaggcttcaaacaaaacatatctagcactaaaaatttggtaatgtaaaaatgtgttaaaatttagtataaccaaattttggtaaggttaaaagtgactataaagtgaacaagccctaagccaaataatttggcaatatcaacatttattttttgattggttaattttggtctcaaacaaaagaagcctgaagcctgaaatctgcaatctgaaatctttagacagttcccgtgtactatctccatcactaagacttcatttttagcccatttctacccatgccaatacaaaggaaaaaaaaagaatgttcttactttagcaaactccaatataattattctccactttagcaaatctcaatacgtttgtctcccaatactctaatgcaatgatcgctgaaaaagatggcgtctctgtaagacaaatagatggaaaacaaacttattctgagatgaaggaagtaataccatagtagcatccaaatctttggtaaaactatcttttctcttaaaaacatggtaactcaaaacattatactaatgtaaaatcggataacttagtaccatcttaaagatactcgagttgtaacataacatcgtaacatgataatgacatataaaggctggatctctggatctacatactaatgacgtactccctccatcctataatataagacgcacacgtatttaaagatttagcatttaaaatatttcactaacacttagtataatactcccttcatctctaaatgtttgacgtcattggtttttttaaacatggttggtcattcgtcttatttaaaaattttaagtaattattaattcttttcctatcatttgattcattgttaaatatacttttatgtatacatatagttttacatatttcagaaaagtttttgaataagacgaacagtcaaacatgtttaaaaaagtcaacgacatcaaatatttagggacgaatggagtataaaataaattttatttgttaaaaattatatcagattgatatttaaatttactttcatatggttatagttttgtggctaggaaccttatagtacatggaaaattataggttaaagattagttttggagaccgtgtcaattttgaccgcgtcttatattatgggataaagggagtagcatgtattttttagctcgtgatttttacagcggtaataaacaaatttacccatgtaaaatagatccttgccatacatattgcaacgtcatgcagttatatatgaccatatgaggatttgggccccgaaaccctgatgctagttcaggcaacccatgacggccggccgagccaaggcttcagaaaccattatgagaaaagaaatcaaaggatatatatgattatcttattgcggggccaatctgaatctactccaatatgactttatttaatcttcagtttaattgctctggcaatcatgaccgcgactctaccgacatgctcagactgatcgcccaggctttgaaagctgaggaacttcaaaaatggagcgcgagaaaattgcattatgcatataaacagttctaaactctgaatactattgctctgctttccccagctgaagcacaatcacagaacaacagcgtagcattgctgtgcatctaaactactcattccgtctcaaaatacaataacttctctttgaatttgttctaaaatataacaacttcttcaccagcattctctttccaaccaatcacaaacctccatcattcactttttccatctacctccatcttaataactgtgcataactctaaaatttcttatattatgagatggatagagtagtaagcagaaagttaccacatttgtttctcattttgattgcttcaccgaacaccgaacgagagatcatgcagaaaatcgcaagatcaggagaaagctcgtgtgctaaaaagaattattaggagaggcttatcgtgtcaccgcgagaggataggaacgacacacacggacgtacatatccctgtatcaatgcgcctttcttgacgagaaatctgcaagagcaacagcgcagcagcacacggtagctgtacgtacgcaggccaagccgtcgtacacgtaacacgtccagtagccctcgatctcactctcccaggacattaatgccggtgagccgcccccatcgtcagcatctcagcggtatgcagatgccgtgccgatcgttcgacggccttctcccccccgcgaggaaaacgatatccttctaaacgcaattaagaatcagatacacggacacacggtacaccggtgcacaacagatttgctttgccatcaagccagaaaaaccggtcgccgtgaaaggcacagggaaacaaaacctgtttttcttttggttctctgtcacgtcaagtgcaacgaacggcacgtctcgcttgcgtttgcggttgcgcccgaccaaccagccgatcgcacgacgcgtaccgactcaagagtcaggtagacgcgccgcggcgtggcacggaggagacacggcgcgccacgcgttcgcggcctgagatgatacgccgaggcgagccgcgtcgcgccgtaccacgggcgccagcgcggccctggcacgcgccaccgaccccttctcgtcggctgccacgccggcgccctgcactgcaagccgcgcccacacggccacaccggcatgcgggttaaaacgaaagaaaattgtgaaacacaccaacgcactgtacaggtactggaccacgtcgcagccaggacggctgtggttttgaccagagttcaccgcgcttactactagtagggcacacaaggaggagtgctatataaaagccggaccacggcggaggcgcagtagttatcaccggttcatcgtacaaaagaggagagagagggtgatggcgccagggagagaagaagagaaaatggtggcgactactacgatagaggacctgcacgccgacgtgctggcgcgcgcgctgcggcggctggacgggcggtcgctggcggcggcgagctgcgccacggcggggctccgggcgctcgccgcggacccggagacgtggcgcgcgctctgcctcgcggagtggccgtccatggcggggcacccgcggctgctgtccgtggtcccgccgcgccggctcttcgccgacgcgttcccgttcccgcgcccggacgccggggagctcggcggcggcggcggaggtcccctcccgtcggagctcgtctcggcggtggacgtctactacaggggggcgcccctgctctcccgtgtcgtggagacgcccgcgtcgtcgccgtggttcctcggctcgccgttccgggtggaggccgtggagtgcaagaagccggcggcggaggcggcgctgtctccggcggagctggagctgagctgggtggtcgtcgaccctgcccgcggccgagcggtgaacgtgtccagccggcgcgccgtggcggtggaccggcactggtacaccggcgagacgctggtgaggttcgcggtggtgctgggcgggtgcaagttcgagaccaccgtgacctgctccgagggggccggcaacatcagcgaggtcagcctcgccgtgcaggacgccgacggcgccgcggcgagcggcgagcgaagcctccgcctcctcgctgcggcaatggaggaacagaggataggcggggggagagaacgggacgaggcgaagaggaggtatgacgagttcgtgaagagcaggaaggggaggaaggagagcaaggcgcgacgcgaggcgctcatcgacctgtgctgctccgccgccagcgccatggccgtgctgagcttcgtcgccgccgtggtgctccggtgatcggcggctgcggttaggaaaaagagaggacaaaatgtggccttctcttcatcagtgtacaaatcgagcagagaactcgcgtgtatttttcttccaccgtagttacattattcttaaactataaaaattggccaggtgcttatcatccatttaaaataggagataaaacacctgagctgatcctaggatgtgacattaagcctagtagaattgacattgttcgcatgttccaatctcatgtagtagtgcttttttacgtttcaatttgaaaaagaaagagtaatgttttcccttcaaataatacaagaatgcagaaaaaaatgtgccgtctgtccatcgcattacaattcatgttttccgtataatcaaggtactgttccacagttttagggaaatcaaatgaagtttaagttaggagtacttgaaaacaccaattcattattagttccatacagaacactggacagacatggaggaaggacactgttctaccacagcttcatcaagagcatatgcaactatatgaacagcacttttcagatcatttcatggcgacagcattatagatactgtccatgacaaagaaggaaagggcacagtatttgatcggcaagagcatgtgatgttatatcataatctgagctgttgatcgggcacatcttcttttattgcaaaactggaaatccagtattattacgcatgaacttctcaataataataggaagaagtcccaataacctccccataaactttggatgaaaatccattagcacctgaactttaaaactggacattcaacattctaagctttgtaatatcgttcatattactctctatggttttaggtactcccaatctaacaatagactactcgtgcagcagataaaaaggaaagtatgaagatgacacgcatgctatcaacagcggtcaggtggcttaggaggacctgtcgctcttggactggaatctgtagtacgattcattttggccttcgcaatgtcgacatagataactcggccgttcaatacctgttgcaagtttgcgttaatcaaatcaagtaggaaaaacagagtgtgcttctaacttctaaggccttgtttgcaagactgatattctacatgaacttgctaggaaagaaacaaccaacccttaaactggattttggggtttcctgtgaagttcatgtggtaatccaacattccaaacaaggcctaggctgaactaaaaatacactgtttcaaaaagcttgccttgccgttcatctcttcctttgctttattggcggcttcttcggaggcaaatttcacaaagccgaatccttttggtctgttggtcatcttatcggtgacaattgttgctgcatttgaacaagaacagtttccaacttactagtaatgacaagaagtataaaccaaagtgtgctctaggctcggctctggtaagttacaagtaaatgtaccttctagtacctggccatactgagagaaagcttctgccaggctatcctcggtcgcgaattgggacagccctgtaaaaggatagaaactcagggtgaatgcgtctctcgggcatttcgtcgaacactatgcatgcacaggcttgccgacttgccgagccgccaatcacacagatctgcacgcacgagagacggcgagcgagcaaagatctgcagcgctgtgatgacgccatggtggagatgttacacaagcggcatgcgcgagtcaggaaacgggaggagacggagacggggggtgaggtttacctccgatgaagagcctgtaggtgatgccccgggagtgcgtgaggaggaaggggcgcgcgtaggccgccggggactccctcctggagaccagacggcgggaggcctcacgcagcgccgccatcgccatggtcgcgccgggaataagctcttccagaagagagtgagcgcaggaagcacgcgatgagagtgtggaggggacactaggaaagttcggttttttcctcgacgcggtccacgcggaattcgtggttttgggggatttggacctgagcagaagacatactacaatttaaatgtgactttcactctgtgagtgattgtgttatgtgatgcattattctgcacttcctattgtgattgccacaatgagagatcaagatatgcacctcactttgtggcagtaagtacaaactttactcggttttgtgacgaagtgatctgggatgttagttgctaaaattttggattttatctattgttttagaaaaaaaaacacttggaagctcacttagagggatttttatattccgatatatttccgttcccatatccgcgtcattttgtattagctctgtttccgtatccgataatattcgattccatttttgaattcaggattttttttattgtgattcttaaaaagatttgaaaacgaaagcggtaaaggtggtttccatccatttctgagtcgttttcgccccttgaaaaacaacatattaccccaatctacgtagttctactggtaaataattcatacttgagtcatattaagtaaaaaccatcaaataaaacctatgaaaatcaaacataaaagttttttaaaaaaatattagatataggtatagtcataaaatacattatgtctaaatatcaagtctaaatttaacttcgtttgagtgtaaaaaaaaggatgaatagtatcagggtaatattcacatggaatttgtccctttttttcctcttggagatcggatttaagattttgtgtaaaataatttcaaaactataaccatctctgcatttttttttcatgaacttagagaaatttagatatagttttcatgggttttcaattaattggtggtttttattgcacgttttttcttggtaccaccagtcacccaactcaccacgcgaagctccatggccgcctctcctccccaactcgccgccgccgcggcgatcgcccccgactccgtcgacagaattggttggtgacctggtgcaccgtccctttgtaagtatctatctcgtcatggccttcgcatgctcctcccccccaccccggtgccttcggcgggaatagtcaataggtagggtttaacagtggcgccgattgacccgatcggagtttttttgctgccgattgtttgtttaagcctataatccaacttgctacgaagcttagtagctagcagtgctgctctaggttcaattaggagcgcttcgccggcagccacctctagcgccgtcctcgccacgcctcaatccgaccagggaatcccctgcaggctgacatgaccgcctagtgatgcgtttgatttgaggtatcgatgcaaacccctcccgacacaagcgtcccaacttcctaggaagtcaagaccggtgaggcggtgacatggtttttccatcattatggtcatattatgccagtttcagtttaaaaagaagttatattatgccaatccatttacccatattgaagcatacgatctgtgctattaagttgttccaaatatctttgaaatatgttgccatattgaaaatttgatcacttaaatgcagatagcatctgaggtatggagaaggattggctagaaagacatgggattcattacaataagcaagaggatgctatgtatgtcgacagcacaagaatgacccttgtgttgtttttgtccgtaaggcgttctatctgatgctcttcctcgtgtttttttaggggtaaaatcaggagctctgcctatttcatattaggagaagagagaaaaaaaacccagagtttttacaaactaggttacaaaatgatcccatgggatcccccttgaggagctcttcctcgtgttcgttgttgttgttctggctttcgggactccataggcagcaagttccctaataagagcacgtgctgcacctacatatagtatactgttactgattcttacgttaagtttttcattctttttgtctaatctagaagtaacttacatttgtgattctaaatattggcagtgatgcccacctctccagatcccaaagatgttcccttctgctataccattggcaagccagtattctttaccttcactgttgatggaacatggaacccctctcctgtttatgcttgtgtgggggtgtttagatggtgctaaaaattttttagcccatgtcacatcggatgtttggacgttaatttagagtattaaacatagactaataaaaaaactaatttcataaatgagagctaatccgcgagacgaattttttaagcctaattaatccataattatcaaaagtttactgtagcatcacactgtcaaaattatggcgtaattagactcaaaagattcgtctcgcgaattagtccaatattatgaaatggattttataattagtgtatatttaatactctaaattagtgttcaaacattcgatgtgacaggaccttaaaataagtctcgaaaaccacacagccccttagctcttcatatagcagtggggcttgcctgtcacatcttgagtgaggcattggtattatgcgcgcttccccacctctgctggtgctaagaacggtctatttggcgtttgagagtggtatattatcccagcgatatttgaacatctgctttgttttactaattttatctttttgctagcatggtcttatgaacatggggcttcgaccggagcttctggttgaaatcacctagtgagcaactggaaaattggtcctctctttaatggtaccaacgaatcttctctgaatcttatttcaaccaaaacagcaaatgcaggttaggccgagtttacttccaaactttttttttcaaacttccaacttttccatcacatcaaaactttcctacacatataaacttccaactttttcgtcacatcgttccaatttaaaccaaacttacaattttgacgtgaactaaacacacatataaatgcatcgttgattcctaacttctggtcagctaaggtagtactagcagcgaacagaagcctttgtatatgtacaggacaatgaagtgggttaccaaatttcaaatgcccggcaggtatcttagtatgcagcaagtcttaggcaaaatcttcaaatgaattaaccaaaaagacctgtgtgacacatggccagccagccagcctgaaataggtgcacaggtaccaggggtccaaatggactcaacaacaacagaaaccaattcaattttaccaagactagaccaaaagatacataggtcaagccagtttttacttagtagtttatccaatctatgggattactactgaattagagcctgattctagttagtttcgccctgttaggcacccccagaaaatgggttgaccaatgtgacgccgaattggtgcacattggagccatgctgctgatgtcaattactatagttctagcctgcacaagttaccttgttcctgaactcatgctagtagcagctccagtattggctcccaggactgtaaacacaccaaactagttataatattttcagaattgccttagaaatcattgacagttggttggtcattgacatcatccatcccgtcatattttccatgtgtaattggctgctaacagttggttggtcttgcagctgcaggcattgctgttgtagatcagggcatccaggatctaatggtgcgggcacctcaattgcagaatcagggcatcccctgctccaggcattaatcagcacagagtaaagacttcgcacgctaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23775 - DNA, 63 bp, Oryza sativa
tttttttttttttttttttttttttttttttttttttttttttttttttttttttttattttt

SEQ ID NO: 23776 - DNA, 427 bp, Oryza sativa
ggggctaaaatatgagagctactgctagagttaatgatatttttagtgtcctaaagaattagtggcagcccccatttgatctttagggctctaaagtaggggctgctgctggagatgtcattttgctacaagcacgctgatcagatcacacctgcgatgacgtcggcgaggtacgtcctgaacctccccatgtgctccggcggcagagcaatgcccacctcgatgccgccggagccgccacggccctccgccaccgacatcgcgccggtcttcgccacggacgcgatctccaccttcgctggcgtcccgaacccgaagtcgacgtcgtacacgcggaacctcggcgacccagccaccgagaacggcgcgccgtcccttctggcctcgacgatgcgctctgggtacctctcccagtatccggtctcgc

SEQ ID NO: 23777 - DNA, 71565 bp, Oryza sativa
  unsure (1)..(71565): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacatgttctacacctgtctttaaatattacaagctagaattgaccgatggaatatatcttagtataataaatagtaggatatatctaatccaattctagatttaccatattttgaaacgaaggaagggagtagcttgagctatgctggagtaaaatcccaacacgaaactctcactacacgacgccactacgggttcaagccgatcttaagtcagaaacaaagtgaccttgttccaagccgcagtagcgagcatttctttatatttagaatctgtttggattgctacctaaaattttggtagggtaacaaaccaaacacctctattaaaatactacgtatgctacaaatttggttttgcccataaatttgtctcttataggtatatttttggcttcaatccaaataaacattttcaactctatcctaccaaaattttagtagtaccgaaacttgcccaagatttggcactaccaaaaatttggtagagcattaatccaaacatgccctcaggatgtgtccatttggattggtttggaaacctctccccttcgcacgcaaaacggaatgacgaaataacacatgattaattaagtattagcaagagtttgaaaaataaattgatatgattttttacaacaactttttctaatgtttttattttttaaaaaagacactgtttgtttagtagttcaggatacgtgcgtgtgggcaattagagaatagaggttgggaaccttgagtgaagaacacatcctagggcaaatgaaatggcgaaaccattataaactctccaggtgacatttactcatggtttatatgtcagtcaaatgaccatgaaaaaaattggaaaaaaataagatagattaatatgcgttagatcactctacaaacataacatacaagttaaatttctcacttttatatgttgcaaaaacaaaacaaatttgactctaaatatactttaactatctgtaatttatttttttcttattgcaacttataaaagttgaattttaactttctaaagtgatatatcacatgttaatacaacttcttattttttacaatatttttgtaactattttaagtgtcatgcaaactgaaaagacgtccccctcgagagtttaaaatccactccataatgaaatgccattcaaaattgtctgatggttcgagcagcaaaataagctataaaaaaaatttaacaaggcaacaaaaaaatttataggtaaataattattactagcagtttaaaagtagtagagataaaaatacaatcaccaaaattaaattataaatttctaaaaggaatcaaaccctaaagatgaatctgaacacacatatggctgtgtttagttcgcgccgaaattggaagtttggttgaaaattagaacgatgtaattgaaagtttgtgtgtgtagaacagattgatgtgatgggaaaagttgaaagtttagaaaaaaactttggaactaaacaaggcctatgtcattcatcgctggttttgatttttgattttttattttttgcacagagagagtataagccagcaaatagacttgaaaaccgaatctctgaagaaatctccgaggagtacgtacggcagttcccacgctagttgcattgggaagacgaggaaagccaagcagtggcgtcggcgaggcacctccggaacgtgtccatgctctccggcggcagagctatgcccacctcgatgccgccggcgccggaccggtcctccgccgccgacaccgcgccggtcttcgccacggacacgatctccaccttcgccggcctcccgaacccgaagtcgacgtcgtacacgcggaacctcgtcgacccggccaccgagaacggcgcgtcgtccctgcacgcctccatgacgcgctccgtccacccttcccagtacgcgggctcgccgcgcaccgcctcgtcaatggcgacggccaccgcggcgcaggccgtgaagacgccgcccgcggcgtcggcgagctcctcatgggtgcggcgaactcgtcatgcctgtccggtacgtcgcggatgagcgtgcggtcgattacgggcagctccgggagcttccggtcgccggcgcaggctgcggcccaggtgtggaggaagtgcgtcgagcccaccccgtcgcaggcggagtggtggacgatgacgccgagagcgaggccgcggcgcttgggcggcagcacggtcacctgcagcgcgagcaccgcgccgccctcgggaagctccgggacgagcggcgcgatcttggcgagctccctcggctcgtccgtggcgagctcgtcgacgccgacgccgtcgtgctcggcgacggtgaacgccacgccgtcgccgagctggtagaggagctcgtaccggttggtctcgctgggcgtggggcggatgcggctggcgagcgggtagaaggcgtggatagcccggggcagcgactcctccatccgggacagcacggcgtcgacaccaccgtcgtcgtcgtcgtcgccggggccgagtcggtagaagaagacgcgctcgacgggctgggcgcggagccacatcgcgtccatgaacatgagaggcagggctcgctcgggcagcgcgggctcgccggcgggcggcgccggcgcgacgcgcgtcgtgcggaggacgcggaggccagcggcgtgagcggccggttgcgacgccattgtctcgccgcagaacaggtgtggtttgtgttgctcgtggttagctgcagagcgatggagctttgcttctactcctataatacttgcatctccgcgagtgacttcacttcactggtccatacccgaattacgcccctaagttattatgtgattacgaattaccccttgaactcaaaaataagatatctttcaccttcaactatcaatacaggatgaaaactcccttaaatagctttgagagcggttttggtcctacgtggtagttcagtcaacaattcttttatcaactaatcgatggggcccacccatcagatctctctcctctctctctcccctctcaaacctctctctcgcacgcacggatgccgacgacgaggatgaggcatgtgccggcagtgctgcaccatcccgacggcgctcacatgccgccccattgttgcctcagccacgccgccaccccgccgccatctgcccgccccgagcagccttcgccacctcccgccaccatcttgcccaccctgagctgcctccgtaccccgcccttgcttgccgccatctactgctgtcctcggcgccccaagcggcctccgctactgcccgccaccccgagctgcctccgcccctctgtcgtcctactaccctcgcccaacacaatccaccgctatcctcgatgcccgagcggcctccgccattgccatcgcgccgccacgaactgcctgcacccccgccgctgtcccactgtcctccccagttactgtcctgccgtacatcatagaaaacatgtaaatacactcaaaatttacgaaatatattgagaaatgtaataacacgttacgaaatataaggattgtatttcagtgaaatataatgaaatttacaaaatgtattgagaaatgtaataatacgttacaaaatgtaaatattgtctttcagtggctttcataagaactccaataccagaaaaagaactcccctctacataattgaggaaaagaacaccacaatctacctgatagcttcaggtcatccaaaccaacttcaaaagatgacccagtgaccctctcaatccacaggtacctgtaaataggtacctgtaaacctatagtaaatgaagttcaagcagcagtacataatcgaagtaaccgtaatttttttaatcatgttgttaatcacagaatatgggccagcggcatccacgagcttgaagtgtaactctacaataatcacaagagcaaagaccaattcatagctaatcctgatacaatttcagaaacatgacaaagttatactcctgaggaacctgaccagcaacttgtgatgcaccatttgtttgcaatcgttcaacactaacaaaaaacaaataaagttacaagacaaattgtatttaaaaatcaaagcaagtaattccaaagatatcaatattttgtttcctggtcatttaagaattcatctcaaaccatgaaaaaaaatagacttcaacaattagagcccatttcaaaagaagcggtttcagttctcacaaatataacaagcaatttgttaatcttaatactggtgggctaaccatataaaggctaacatggaaatgaagcacatcagttgaacttcagattcagtagtggtagaaaattggcatatttaggcattgtattataggagtagttttttgagcaaaaagaaactttcacttcatagagcaatatattactaactccacttcatgtagctagaaagtaacagaggagcttgataaaatagatgtgcaacgctgattagaaataacaggatgatgatgatgcttgatgataactcatccagataaagcaatgctatatgcagtggctttttaatattccactccatgattcacatgacctttttatcaataaaagaaggcaaataacagtaataaggtaatactgggaagggcaagtcaccttactttacatttgatagaacggactcagataattcttaatggcacatctgttacatcttgttatgtatggactaccaaatcagttgcagttgaacaataaagggacatatcttaaaataaataaatctcctttttctgtgggttaaaataaataaatctcaaaaggattttatatgcaactaaagattaaacaaatagatatactgcagccgagtccacatgtcccttgaaacactgtccaggattgctgatcgattacgaaatatgaatttatctgcaaacttttgactgcagtagaaagaggagacaaataaatctcagtcaagaaacaaagctattgtgttgggaatatcaagtaaaattggacatgttagcatatctatatcactattaacatactgacgtgactccaatagtcattaaaaagtgaagtatctcatagtaaatctatacactaaaataatagggtgttctaccctgcaaaaatgaaatatttgtttgcactatatgaagtattcgagaccaaggaacaattcaattttagtttacataggcagagcttcaaatcacaacatacagtgaaaaatagagtaaatatgagataataataaggattcaaacagtaacaggagtgcacctcgatcatgcatttcatcaaacagttggtgtgctgcccatgggcacaccaaggaaccaccgtgatagctgatctggaagacctcactgtaatggaagggtaccatccacagcacacagtagctgcagccgctaaaggcctaggtgcagacgttgaggcttgcctgcgcggcttcagcgatggcggcatggaattctacatatctatcgaacccaacttttaaaacaatctatgcacttgtgtaatcacttgaacaccatgtggatcagtttaatgataacaaaatgaaacacattatataatcttatgattataactaactgttaagtttgtattcttcttggtccctgaaagagaaattttcagctcctgcacttgaatcttgcatcatttacataggtaaaccaaattgacagctgcatttataatttcatttaggatttgtcatgtaaattcaatgtaaaagtgaaacaatacctcagaggtactgtcatcgtgtgcaaggatcaaaagcaaaaatgaccaactgataaattatgaaatttgggatctggggcaatgctttttgtagttgattaagtacccagaatcaatgatttacataaaaattgagcttttcattttatataattttcatagcataatcaaacattttatcaattttgttattttcatatctattggaattgcattctaacatgtatcgatcaagcaaatttggaaatcaacggataagacaatgaatcagtgtgacatagggtcatagtaggttgaatgttgacattatcacaaattcaagattaacatatagcatattgctacagattccattcatttatttttagccaggggaaaattctcataatatgatcagcattcacggaacaattcattgatcctatttgatagcagaaaggagaaggagaaactaaatgcaatctgacaaggggcacataaagaaattgagaaggagagaaggatgtggaaaagcaaacctgggataatgccggcagatggcaacagctttgctgctgtgttgtaaaatcattcatcgatgagaatactggcacaacagaaagaaggcggggggtgtgcatcaacctccgcggtaggagtcatctctcctcgggcgtgtagataacgaagaagttgcacacgatggagaggaggacggcagggatggaggttgtccggtggcgtggagttgggcagtgggcgtccggctccggggcgtcgagggtgaagacaactaaacatggcgcacggcagggatgcgcacgatgaagacaggcgatgagtgcggcggaggaggcagcgaatgggaaagacctcgcctccggttcagtgcgcgacggcggcggaaggggacgacctcgtgggtagcggtgaactgtggcggcggcggtggatggggaagacctcgtctccggcggcagcggatggggacgacgtcggctccggccgcgactggggacggatggggaagacctcgcctccagcggcggcggatggggacgacgtcgactccagccgcggcggatggggaagctccggcggtggctggggaagacctcgcctctggttcagtgcgcggcggcggcggaaggggacgatgacgcgagaagggttcggcggcgtcgcaggattcgggtgacggcgatctcggcggcgtcgaatggggcgatgcgacgcgatggaacgacgacgcccctcacctcccctgctctgctcacgactcgcgagatggggatcggattcgattccgtcctgactggcgtggttctagggtttcgccggtggtggggggaggggaaaggatgggcggaggggcgcgagcagcggccagcgggacagcgacgacggcggtagggcgatgatggcggcggcgcctgatctggaggaatcggtggcaatggcgatttgtggcggcgtatgtggcagatcggctggtggcgaggttagggtttgggcgccgatgtggagcagctgtcagcagggggagggggatgcgggcgctgggggatggggaggaaggaggattaaggcgacgctaggacgacggatatcggcggcggcggcggttgatacggaggggatcgaggcagtggttgagaggaagacgggagagaggggaacgcttgcgcgtctgcgctctgcaggatcagagcgttgcggaagcgatatgagccattggattagacaatctgacaactcatattccgcatgtatgatagggttggagtaacggccacaactacagaattttaaaagtagtaaagaaaatgtcgatgtccttatatgtcctagccttctttctatccttcattcgatctagcgcatgtgtatgcgtctctcctccctcacgcgcgtgtgtatgcgatttttccttgaagatgccacatgtcctcccctcacgcgcgtgtgtatgcgtctctcctccctccccgtttttctcaacggtggttaagatctaaatcattattttgttattcattttaaataaaagttctatgggtagatcatagccgaatctcccagttacgggtgtcttcatgcaagcctacatgaatgcagagacatgggctaatatatttgtgatcgtctatgaacaactttttataagttgagttgtttgatgattagtctttttttttatatcatgacatttcaatcaattatttaaggtgcacatggactatgatttattgtcaaataaaaaaaatagtgtgagccctatacctgcacgttatacattttattacttcctccgcttttaatatattgacaccgtgaactttttttatatatatttgaccattcatctcattcaatcattttatacaaatatgaaaaaaatagttcatgtatatattaatcacatatattttgttttttaaaatgagactaacggtgaaacatatccatccaaaagtcaaaagtgtcatcccaggcccaccctcctctctcgtgctcgggtctagcccggtcatccaaatcctacatgacgtgaccctatcaaacgggcaaggcccaaatacatcaccttggcgtatgtggacaaataccaaattagggttaattatgcctccgtgtgacaagcttgccgttgcatcgaccagaaattacataagcccgacaggcatgcatgcacgaacttaaaaaatagtagctggattttatgatgagagagactaccccatggtataccgtcaaagcaacgggatacatcgtttatgaccctcacgttaaatcagtttccacgtagtcaagtacaaccatgcaagatgtcagttggtcattaaacaatcccgtcgggacgtgatcccgttgcctagattttctcttttatgattgataaacaacataaaaatattttaaaatcaaatcaaatatatgtgattaatactcctaaatattctctttacaagttaaagaaaattctaaaaaaaggcagacgtaatttaatttatatacggttatatatgtattgtcttttatagcgacttaagttttctccctttttttttatggaacttcaagaaccagctgccttaggtaccataatttgtgaacgtgatctgcagtaggtaattttataaatgacataattaaatttatcatgcaatgctaatggataaattcatgaagaaatcatacttttaaaatccaatagatattattctgttagtatactacccttacatcgcgcgggctatcttcctggttcatttttaaaaatctcaccaaagggatcagtatttcatttgaggtactgttcacctcgatttgcagttgggatttgctatctatcagtggacacgtttcttgcttcaaatcacatgattttcgaccttacgttaaaacaaaggaacggataggatttaaaacgcacaacgaacaaaaattgcacccataaaccttaatcatgtgaactaataaatttgactgggccagcccaattaaagtaaacaagctagtacaaatcagttacgtatcaaattacattgtaaatatgatgtaacaaagaaatgagaggctgcatcaattcacatgaaccgattctttgacctcgattacaattgcaagaaatttcataacattgtcatgttctttattcttgtaacctaagatcaatctcttattctcatatatgaatactgcaaaaaaatgatattaagttctaaattatcaaaataaataaaagcctaaaacacaaaaacatccatcgatacagtttccgaactctaatcatttgaaaatgacaactactccctccgtttcacaatgtaagtcattctagcatttcccacattcatattgatgttaatgaatctagacatatatatttagctaaatttattaatataaatatgaatgtggaaaatgctataatgacttacattgtgaaacggagggagtatgaacaatccaaaatcagaagtctaaaccacaaactaaagaaaatgcactatgctacctgaaacactaaactatgcagagtgccattaaaaatgcatcatcaggagttgaataaataaataaacactaaagaacactatttcaaataataaacacttttagaactgatctgcatgttaacaaccgattctctagaccatcttttaggtttcataacattgtaattcagaggaacaatacattgcacaaccatcatagttcccaaaactatggttaagacttaagattcagattaagaaatttaaaattagagctcaaaaagaacatagcaaatacaccccttatcatgtattcataataaatataaatatttagatataactaaatcacacatgtaactaagttgtaagtgcaatataactacggtgtaactaatgctattttttctgtaagtgcatttaatataaatatataaaaaattatgcatcatgaaatgattatttgccattttcataactgtggcaatgaatctgaattttcagccgtaggaaacaaagcaatggacgagattaatgcaatataacacaaaagacaacaaacttgtacatattgatgggtcatccaaacttcaaaattaactgggtaaacaaatatttgtattgaactgaaacaaatcagaaatatgcttgttaacaccaattgtagtctattgaatttataccatcctatagtagtctgaagaatataattcagacaaacaatacattttcacataacatattgcttccaaaaaaactaatatgccattgaatttagaaaatgtaagaaatttcaaaatcagggttcccaatacacgctaaatggatccattagaacacattcacaacaaaaatatagaaaattacattatataaccaaagttttagatagagttgtaactaaaatgtaaatgcagtataattactataactacatttgaattgtggtgtaagtgaatttaaacctaaattcattactacccatacattagaaatatttgatagctatatacttcacaatgatcaaaaaaataggttggaggataatttgactaggaatacatgtgatttttgaacataagcagaattttgttgctacttgaaaacataatctatttgatagttaaatattaacagtaataaaataggttggattatagtttgaccacagaaacatgtgacattatactttacttaaactcacaattaaatcatagtagcgaaaccgtagtctgttcattgggatagaaaagcagatattgagatccttcagtcctttttttttctttttggcagaacacacttaaagatcaaactattccacctgttaccaattatgtactttgtatgtatgtacacattaacaagatatattgatatgtacaagaagtccaaaggacagacaatcaatcacaacaaatttttcaagacctgcattgcaggtgaactattttgtccttcactatgctattatttattgtttcacaaagagaccctctatagttacaaacattattaatagttaaactttagaaaggctgatatatcatattctaggatgttaataaaaaaggaacggatgtagtactttaaataatgggcaaaattggaatgacaattgaaaaaagggaactactacacaattcatttctttcgcaaatgctttagtgctctacacaataaatttcttcttcacaattgtccatgctttactctggctgggatagtggtgcccattcctaaccagttcttacaggaaatagtcccatataaattgttgattgttttattcagacaagtttgtaggtacaacaaggtggcattcaatcatgtttgggtgttagatacttcatacgtattgcggcgtgagtgctaacagaatattagcttgaatacaagccaggaagaacacagcttcaggtagaaaagcattgcagcttcattcgtccttccatttgttgcacaccaatagttgcctttctatatttttgtatacctctcatttgctcatttcatttcctttgccttcttatgttgtgcagatagtcaactaaagagtataaactactgcaatcaccttttttcaggaacataactttcatcaaagttattctctcctaggcctaattcagttaggactgacaatttgccaacccatactgtaaaatggtccataaaaagcatttgttgatatagtattttgagcaagtgttgaaagataaggtaatttccctgacaaactgtttgttgacagattaagaacctgcagatttgtgcagttggctagcactatggatgcaagttagaactatagatccagacattcgtcttgcttgtggttaaaaatatgtcgcatagaatctgagatgaatcatacgtaattgttagtaagactgttcatgaaacaagccatcaagcaagaccattttatgtagcatttttaccatcaaattagcatttttgcactatcactgcagcggatttggatttggtaaagaggcatgaagccttgcgagatacaggtgaggagaagacggggttctaacctactttctagtgatgatggaaatactattaaattttattagtagagaagagacagatatatgaatatgaatatggatatggatacagagtatgaagactttgcgtcaatagattcatattgtaaagcagttttgtatactatatggcagattataaacattatatattgtaaggaaatccatgaaaaaaatgttcagtttggtagatcgcaccatgtcaaaagataacattttacattactcttctcttctattttagtttcgttttcatgcgtgctcacactaacaaaaaaaaaaagagatatttttgggacacgcctcttgttttttttgcaggcagagagtaagaacgtccgtatgtaaaaaatagtgtgaaggtgcctagttttttagataatggaatttatatcccggcctttactcaacagagctacagccaattattacaaagtaccactcatacaaagagtgtgaaggtgcctagtagagacccacttatgaaaatccatttttgtaggtggtcctcttaacatgtctgtttgtgaaaataggattattttcagaggcgggcctgttaaaaggtccccatgtaaaaatcctttcacagccccacttcctctccttttattaactcttctctcctttctgtctcctctaccttttctccctctgtccctcgacttctccttctccacctccgcctcctccctcatcccctctcttcttctcttgacggttgtcgttgcgacgggagtagacaaaggggcggcgttgaaatgggagcagcctgccaacagggtgacgccgcgataggagcaaccgacaggcgatgtcactataggggatcaactgcctccggccccacatcgcgccatgccttggctcctctgatctcgcgtcgcgctgcgcctcgactccttctccaatctcatgtcgtgctacacctcggctttttcttcagcaacaacggcgaactcgcgacagctggatccggtggacggccaaatcctatgacggtgaccccgagacgagcaaatccatcagcgactgcgcacagatcgtcgacaacatcccccaccacggtggcagcgggtcttggccacagcagatccattggagttgaggcgcagccaggggcgacgccacgttcagcttgccaagtgcacaggcaccagggaaaaatttagtttttagttattagcatctaatctccaccttttgtgcactccccagaaaaaaatatgtgcaccaccttcagctgcccagcaggctgcaggcagcccatgaaggcccaatttcttacgtgcagcccaaactgtccaagtgcccaacagctacagcccatgcgtaaatgaagtgtgcattctggtccttcgtgctctagattcgcccccgcgcagcgggcttcgggcagtggtgttggaggtgcggcgtgcttcgggcgacatcaaggagctcagggacaacagatccaccggcaacaacaatagaagcggcggatccgctgcctgcgggctgtcgggctccattcgatggtttgcatgttcttgatatgtatgggctagggtttcaagatttttttttcttttttattcagaaaaaatatttacaagcgggtaccatatcatgagaatctgcttttgcgggcagccctcctagagaagctgtttgcgaaaatggtttttacgcgtggctgtgacgcccgtatgagaaaaccgtgatttttatagctagacaactttggccagacgggtagagcacccgtttgcaaaaacgacttttgaccgtttgcaaaaatcaattctgattgtcacttcttttctattcatttgccgtgtttactcgtcaagctttttctagtgaaaaggcgtctatcatagttactagttcaaggatacagattttttttttggaatgcgcacttgattatggaaaatcttaactaattaaaatattcgtaattttccttttgtcacctctctttttcatccgtgttttcatctgtacatcatatcaaccgatttggttagcaatagcgatggaaaaactgcaaaagaaaaaagaaaaagagaaaccatcagcggtcaccgacgccaccaccgccgccggagggagaagagaggcggcggagggagccgctgctgccggatccgcccgcggtcaccaccaccgctgacggatccacccgcgaacgccaccgccgccatcggagggagaagagaggtggcagagggagccgccgctaccggatccgcccgcggtcgccgccaccgccgccgctcgcggggaggggggagagggcacagccgcagccgctcgttgggaaggggaggggggggagggcgccgccgccgctcgcggggtgcaggcaccttgtcgccgtcgctctgccagaaatcgccgccgccatcgccattttagcctaaggggatcgggagagaaaaaaaactaaaactagggttagggtttggtacaagccgttttgacgaattcggaaccgatctgagccgttcatcaaaatgagcgactcggatcaatcccgcatcgagccggcctccatctttgggctgcagcactattgggccgcgcgcagcccatgaagcactagcagcgtccgattgaattgttggaccacattcggtatggttagtctttttttttaaagcaacaagtccactttgcctctctcaaatatatctcctatctaattcatagggaaaaactaaaaataaaaattacccaacaacatacaattacccaacaagagaaagttagtcttttttttaattgctacaaaaccttagttgatgttaaatctggtaaacaagaaatatattgttttcaacatgttgtttattggcagatttatatcaagaataccatattctaaaaggacccatatcacaaattaaattctaaaaatatttattgtgattttagttaaaattattccgttgcaacgcactattgaataataatttattacgagctactatatatttctctctatcatttgtgactttttctagcgagcaaaagtaccaaagcagtgtgaaaataacttcggttaaaaacaaatatttttagttttaatacaccgtagcgaagcacgggtattttgctagtaattataaagtgtctcctagatacactgtagggttacgatcgaaggacaacgttactagagtgtttataagagcgagctatcaaatgagttgccgcattcaggacagtataaacgtcattaaacaaacagcagagaaacccaccgccatgactcgttcaaggatacatttgtttacgaggatatgctttattccattatcttaaaaaaaaagctctatttcttaaagatttgaacctttgtatttcttttaacaaacgaatgtgtagtctaaatttatttattattacctacggagactcttgtactttttttttcaaacaaagagcaaaaatttgccactctaaccctcacttccaaagtgcgaacggtacactgtgtgatgaggacacaactagctcggatataaccgtgagtaccttatgtattaatcaactaaaggtgcatatgttttatattagatttacttgttatatatttggaaaaacgttgctacacaatgagttttgtgtgttttcgtttgcagagttacttgcttgggcgaaagaaaagagaccgaacgtaaggaatgcgtggatgattgaagaagttgattggtgacaaaaccaagaccttttccaagtcttctttcatctcaccacgtcacttttggtccatagaagacaagagataaagtttcgcatgctttggattcggactcgggcttcctgacagcatcaacttcaaacggacttagccgctgatctagaaggaattttggggcccataagtacttgttggaaagcttatgaagtctactttccgatggttttggtcccatgtcaaaattcttactgagctgccaggaatctgcaaaacaaatcatgtacctcatccagtcctaatctgatttgggttttgggccttataattgtgtcgtgggctttagtcccagggggtgcgcgtcctaggctaaccctaggacgtccctaatcatatttattcagtagccgtcatcggttagagtcgggtttttcttagattattatgttaagaacagtttcgtcgctagatcggtttgtagaatcccaaattcgtgtgcttaatcatttatacgcaatttggttgcaatctatcttgttcttgcttgtgttcttcgattcgcatgcagggattagccttcttggcgaggtcaatcaggtttcggcatggttgataaccagaggagacgtggtgctgcgattgcggaactcagtagcgtgttcgttcagaagccagatcgagttgtgtcgccactccgcccaaatcgactgtttgtcaatacctatcggatgatcaggacctaacatcccctcatcagttggtatcagagcgcggttgcccgttaggtaatttatcttccaataaccagaaaattgccacacaaaaatatttattctttacctaaacaatttgagccgttgtgttgttctattagattttgctttgttgaattctagattgcatcgtcgtgtcgagtgctagtttagttttagatttaatttttagatttgagtattgtatctgttcatcacttaggtctaggtctagggttcatcactcaagtcggtgtgagttgtacgtcagttttggtcgagtttttcatctcgtcggttgttgccgggaccttgaaaagttgaatcgtctcgttgtcgggtttccgtttttgtagtttggagatgtttttgtcaagcggttttggagttgctcggttgctaggggtccggttaccgtgcttgtgtatgtcggtgtgcagtaccatgcgcaggtagaaaagagaaagaggaggttttcttttggttgggaatagcagatcggtttatgttggttgaggataaattatctaaattttcatgtgggaccaataggaaaccaagccgagtcacacagtggccaatccctctcatcctcacgttattttccccacataaaggcggacctctgttacatcttggagaatttttttttatgtcggatttgagatatttttgtaaaaaagaaaatgacatgagcaatccatttttgaggtgatccaattttagttttgtactttgctgagtcccaataattttcatatttacatttgagtccctgttcgaggtcagtggttagttactgttgaaaaaaaaaataataataaaagaaaaggcagaaggtgcaaagaaaaaggaagaaaaagccgcaccaagaaaaaaaaaaggcagaaaggtgctaaaaaaggcagcaccaagaaaaaaaaaagaaaaatcattcatcctttgagtatgttttgagagtgcagagttgtgcattgattcatatctagtccttagtattgtcgggtgcttgcttgagctagagttgggtctaggctaggccagcacattgactagtactttgaactattattgaactttgtattttctgattagcacaattgcgttcctttgctactatatattgtgcctcccaagctctacatatatacttctggtcagcaccactttgatctttgcaatcgccacatcacatccttcgaggtgtcacgaactagccacggttgtaccgtccttagcattgctggtaagacacttgtaatagcttgataaggtgctccatttggctgagttattgagaggcaccactacaccgtgtagcagattactgtttgctgctgtttttgtgtttgcaatgacaggtatgagtggcgctcaaaatcagcgataccaacaaggtaacaataatcgcgtgcccgatgatccttatgttaaggttaagtttaaaataccatctttttttggttattatgatgctgagaaataccttaattgggagatgacagtagagcaaaagtttagtgcccaccttatacctgaccaacatagagttcgacaagccagtagtgagttcaaagattttgctatcatgtggtgggctatgttagctgacgatggagttttacctactacttggaaagaacttaaggtagctatgcgcgatagatttgttccaccatcttatcttagagatttaagcaagaaactgaagcgtttagaacaaggggataaatctgtacaggattactatggtgagctacaaaaggtatttatgcgatgtagcatagtggaaggaaccaaggattccatttgtcgcttttacatgggattgaggcgcgagattcaggacatattagataataaggaatttaacattgtcaaccagttgtttcagtttgctatgcttgcagagaaggaattacaggggcatgatcaacaggtcaagaacaagacgaacacgtacacaccgcgcacgacgccatcttcgagtctgcccaagcctatctctttctgggcgcccccaccagcgtgcaagcaaccagttgcgtctggagtttctacagcgccaaaaccacctcctccacgacctgcagatttaggtacaagttctttgcaggtacccgccaagagtgcctcatccgtcgcttcaacgggacgcattcagtgccaccattgccaaggatttggccatatgcagaaggtttgccctagtcaacgggcatacgttgctacggaagatggctacatcagcacctccaatgttgaagatgatgaggaggaagagaagaaagatggagagcaaaaagacctatccatagtttcatgcatacttgaggaatgtttaattgactaagtgcctataatttctgaagataagaaaaaaaggtaatgataatggtgctacaactactcaaggtatgcataattatgatgtgccaactatgtccactacttgtgctacattagagcaacccatagtggaaacaattgttgaaatacctttgtcacaaaacaatttgcttatgtttcttgcgataaagaagagttgtgcgatgcttcacttatatccatgccacaactagtgaatgaatatattagttctatagtagagccatcatgtgttgagtttaaacatgttattcacattgttagcgagaatgaagagcttaaattgctatcttctttaaatacttggggatatattcaatttgatgatttttgtccactcaactgcttagagaagaaattgtttgctagatttgaattgccatgcccttattatgtgatttttcatgttattggcaattatgatagcaaaggagaatataatgtgcatcgagtagatttagttaactactattaggtatgtggtatccataaccctgacacaaatgttgctacacaatgagttttgtgtgttttcgtttgcagagttacttgcttgggcgaaagaaaagagaccgaatgtaagaaatgcgtggttgattgaagaagttgattggggaccaaaccaagaccttctccaagtcttctttcatctcaccatgttactttttgtccatagaagacaagagataaagttccatactctttggattcagatttgggcctcctcacagcatcaatttcaaatggacttagccgctgatagagaaggaattttggggcccattagtacttgttgtaaagcttatgaagtctactttcagatggttttggtcccttgtcaaaattcttaccgagctgccggaaatctgcaaaacaagccacgtacctcatccagtgcgaatccgatttgagttttgggccttgaattgtgtcatgggcttagccccaaggggtgtgcgccctaggccaaccctaggacgtccctaatcatatttattcagtagccgccatcgtttagagtcggtttttgcttagattattttgttaagaacagtttcgccgctagatcggtttgtagaaccccaaaattcatgtgtttaatcattcatatgtaatttggttacaatctatgttgtttttgcttgtgttcttcgattcgcatgcagggattagccttctcggcgaggtcaaccgggtttcggcacggttgataaccagagaagatgtggtgctgtgattgcggggctcagtagcatgtttgttcagatgccagatcgagttgtgtcacgactccgcccaaattgactatttatcaatacctatcggaagatcggaacctaacatcccttatcactttgttgggttaactattcctcgaaagtcttggggtatttattgtgtggctatctataacgggccgcaaccaaactccgtcaaagattaactctgaatggtgacgagcttcacaatcatctttgtcggaccatggcatttgcccgtcactgatgaccctaatcggtgatggggttttgttgcggcccatcaccaattacttttaactagaaaggaagcccgcgcagatgcgtgggcaatttatttattgtttgtaaaaagaatactaaaataagtcatgtctcactatatttcattataagaacccaacattaacatataatcgtaaaagaaaaaatatttatactgttaaataaaccatagaatttatatactaaatgaaaatggctatcatattcaaacagaaatcactttgtctcaattatatgtaaactcgcctatcactgtccttcgcaaacataatatagactttgatttttttttcttttattatacatctaattcacctatgcatgtttgttggtaatatacgaaggaataatttatattgttgaaattatttgtgctaattgttaacactatttacatgggaacaacataattaaaaaatgatataatatggttccgtatgacatttccgattgtacgtatgtatatatattttttctggtgaatagtaatcgtacgcacttactttttcctttttttaacaaatatttttctctcatatggggtagggtgtgcgtatatgtattcatgggtgggtatgtacatgtttatatgagcgtctatgatcgcctttacattattttttttaaaataaaacctttcaagaaaattggtgggatggcgtaaagcggcaccatagcggtgttgcttcttcgacaacatcgtcaggagtggctgctacatatatgcacaatttgaagaaaaaccatagggctataaagaaagaaacgaaaaactatccaagatgggatggatcgtatgcactcttcggtttttcttcttttcgatatcttttgtgtacatacatacatagggatagattagctgatttctaggagcaagggaatagaatagaccaaatctaatggttgaaaatcatgaactgatcggtttaagtgtaaattgatgactatatgttttgccttttcttatattttctcttatttattagagcgtcacataacatcttaattaggagtgtttgtaggagtgtaagaatgctattactcatactcacaatctatttgtagtcaactattatttgatgtggcttggtggcactctctatttacctatcatttgttcatacttgcccttaggctgagttcggcactgagagttcctaactctcctccctcattttccgcatgcacatttttcaaacagctaaacgatgtattttttttacaaaaatattctataggaaagttgctttaaaaaaatcatattgatccatatttcatgtttttttactaatacttaattaattatactctaatgaactgcttcgttttccgtgccagccaactctaacgaatgaaaatcagccttagtatcgtccttaatttaacctccgtgcttcatgacaaacatgtttattggatgtcagctaattattagacgcactgtgcatagataccatgtaagcaatatgacttggcaattggtagatagtatataaaacctatatacatagggataaattagtggggacatttggttgatatgttaggatattcttgattgacaaattatatattgtatactacatgttaagtgttttagtacataaataacaaatttatggttaagttctaaaatgcttatctgattggctactcacttagttatcgtgactatgtttaccaaattgctaaatagtgcgtatttacaaaatattttctatacaattttttttaaaaatcaaataaattcattttcgagtttataatacttaatacttaataaatattgcgctagtgacctacgtcgatttgtgtgccctggacatgctcaaccaatgagctagatggaacgaaggctaagtagaagataaaaaaaacatcaatatggtgccaaaagaatatatttgttctttaattgtccaataatatatgaatagagaaaacaaaaaatacttgaaaaatacatttatgataaatttagaagtgtcatttgtatatatgtgtattttttttgttgttggagtaatttttattctcgaaaatataagtctaatttaactattatataatctacatttttcaacccatttatgtttttcatggatttttcaatgacatgcgtctaattaaaatacaactagaaataacatattccctctatcctaaaatataattatttttagctatgaatcgggactaatgcttgttcaaaatcatagttaaaagttactatattttgaaatgaatgtagtacatatttacaccttaaagcataatacccaacttatatgtgtattattattcagtgtggttttagtatatttttattgtatcattgttatttggttatcacacaaatggcaaaagacagtggtacatatatatgtttaaagttagaagagtgttttctcatatgtggatttaatggtttcactggtttaatattatggatctactgaattaaatggaaattaatgggttaaattttttgtttataatattttttctaaatttaaaatattagctagacaataggaaggtgagagagaggactcttggaggatggaggaagtttacatacgggcctacgtgcgtgcacggggtgtttggagtctgcttttcatctaatctaaatctaaatgtaagaaagaaaaaaaaagtgcaaccggggagttcataagtacatacatacgtttgtttttcttttttggcaggaatactatgcacaaacttaatcggtagtttttgaaagatattttctggaatacgtacttacgtgtactttttaagtagtatacacatgtacatatatctaacttattgatctaaaataaatggtccaccaatttaagtgaaaatcgacggcatgtacaggtctaatctaacggtataaaataatgggtctaccaatttaaatgaaaatcgacggtgagatttgactgtgccacgtggcagcctatgagcgtttgtaggagtgccacatggtggcttgggagcgtttgtagaaagtttaatggacttttagtatataatagaatagaatagaatagataatagatagatagatagatgggccaccaccaaaccccattttcgataagggtaatcggtgacgggcctggttctgaggacttatatactgcctctcggtgcctatgtgacggggtattttgtagcccaacaaatataagtacctttgtaacgggcctcaagtcttcatcactcacagatggatcgattgggataccctgtcctatggtagtggaagtatattttctagactttgcaccaattaatacatataattatgtttacggagcaagtatttgaacctagcgagtagagtcaggtactcataactgcactagcacaactacactatcacatcaattgtgctttccctaagccattacattttcttattttttttcggccaatattgcagtgtctcgatataaatgtgtataagtatcattatggatatacaacatcctcaaattatagtagcatttacaaactactatgcatatccgaaccgcttgttatcaactagaaagtaatttatgagttatatatatgtgtctttaacgattgaaaagcaaatgttggaaactacgatgatcagaaaaccataaaatcaactcctagtacaaaattatattttaatattagcttataagcataaacataagcgaaaatatgaaatgattgggctttgtattccattaaaaggacgtaaaatagggaaaacccgcaccgatattttgtgataacatggaatgccacacattgaagtgaagataatggtttaaatctctaaccacagcacgaaacgtcccatgtatgcgtaaagaaggtaatagaatttaaacttcagtgagatagtagaataagtatatagtgcttcttttttttctcatgatttcttgacgtttatgggctaggcttcgttcttttcagatgatttacataattattaaagcagatgctccgacctttaaaatatatgtttgcttaaaataattattgcattgtttagacctacttattttcaactatttgttaagtgtattaactaattaaaatatttaatatatttctataatctagatgagtaattaaattgtacaaaataataagctcaataatataaatgatacggaggctaaggtacgttgcagccccatgtgcatttggcaatttggcacttggatatgtatatcaaggttgtgaccatccgttatttttgtttggcggtgttgatcctgaggcgttcgctggccgctattgccgtgggtcagaagaaattggctagtggctacgacggttgacctcaaagttagtgaaattggctgtctggtggttttgggtgccaatggtttttcattctcgggtctctgaggccctgtttagatgggactaaaacttttttattaaatgtttaaatactaattataaatattaaatatagactattaataaaacccatccataattttaaactaattggcgagacgaatctattgagcctaattaatctatgattagcctatgtgatgctgcaataaacattctctaattatggattaattaggcttaaaaaaatttgtctcgcaaattagctttcatttatgtaattagttttataagtagtctatatttaatactctaaattagtgtctaaatatagagactaaagttaagtccctggatcaaaacaccacctcactgggttgggaaattattactactttatgtgtctcttttttaaaaaaatgttcagattcataacagtagattgtgtctgatatagtattagctatgttgttagtttctagaacagaggaagtaaaaacttttatttgtcatccattatgatattgcttgtgattcctactacactccctctactgaggtgtattatttagatatttaatattttcatgtttatctataacctctctaaatcacatactactagaaaaacaatttttaccaacatatttttattttctcaggtggagagaaaaaaatactctcttataaccgtttacaaaaatagagatttagcctcgcctggcaaaatcaatttttatgtttggagtcttaagagatccgcctataaaaacatttattttcataacggacgtccgaatatatgatttttgcaagccgtccgtaaaatatggggatcctattaggtcatggctcctctcctccatcccctcttctccctcagctctctctctccctgcacctactcccactacctcacactccttccccacctccatccctatccccccaccattgcctccagccgataatgacgacaacggcacaatgcttggatccgccaccggccacgacgacggcagcaatggcgaagatgacggctgcgactggctgcgacgatgacaatgacggtgcttggacaatagcaatgggattcgcttcctgctggcctcgggtgcatggatctgccgttggccatcctcgggagcgcggatctgccgtcggctgtcctcgggcgcttggatacgccggtggaaggagtgagtggtggcggctttgaccggcggtggcgtcaggaggtcagggtgggggctctcaggttgcggcagggcttcgaccgacgatgaattttctgctttatgatgatatctaatgaatttgttaaatgaatttgagtattgtgatgagttcgttgaatggatttggagattgtgataaatttgttgaatggatttgaggattgtgatgaatttgtgaatggattaggaggtttttgaatatgctcttataggaatgtttgaattttctgggtttttttgtggtctttaaatttgctctttacgcggccgtttgcccgcctacggaaatacactagtttcgcaggcctttgccctcaggcggttgggctggccgcctgcaaaaagctgatcccactactacaacaccgattgtcccgggcgggcgagccaattttcgcgtgtgggtgggcggtagagattggtgaataagatctcttaatcacccagtagtcccttaaagcccacatgacgatttaatctagctattccattattataatagattatacgagagaaaataaagtccagtggtggtacttacgattgtttaggcttgctaagtaccatgcatgtaaaaaatgttggctaccaaagcataagtatattttggtaatgccaaaatattttggcaacccagctatgtgtggtatcggtgaattttggtagcaatactattcagagtgcagataacttattaggacatttattttgcaggcttcgaaccaaaaatggtccttagagcatctccagcagggaccttaaacccagtccctaaataaattttgagggttaacataaaaaactagatccagtaaagaccctaaacctagcccccaaaataataaggccctcagatccacccccaagcccctagtcctgggggctccgagcatagccccatcgatatttttctggcgccaaacgacaattcactttcacgctctcgtcacattcccgcacggcaccacgatgctggatctcatctgggctccggcaccagcggccatcgattcccctgcacctccggcaagattggcacaaaaaggtgagaatttcccctacctctgtcgcccatcatccgcaaggtcctccggccgccgccctcacgagtccgccgtccacacagtgtcgcacgacctcccgccgtcggtccgcacgttgctgtccacacaccaccccgcactaccatggtcctcctgctgcacggccatcgtccctaccgctgtccgcccgcatgccactatccgctcgccggcaggagaaccggtggctgcccacccccacgctgccccattggcccaacggatggagggccaccgccttcgcactgccggagggccaccgctccaagccagcctacacgccgccctatgctcgccgctctctgccccctacggcttgtttggcaccttgagggaatgggattgggagtttacacgagggaattgatggtgagattaagatgggaatttggtttttattcccaatatcttgtttggcagaggtggtggaaattgacagggagtttagttggagattaggtcattaatgaaaatggatggctgagatttgtttaggcaaagcaaaggagaaattccctctcaattaccacccctacccaggtattgaaaaggagggagttccttcctcaattccccatccccatcccaccaaaattcccttgtctcctgaccaaacaaaacaaataatagccccatccctctaagctcccaatccctcctaaaaactccctccaaccaaacggaccgctagagttttctggattgaactaatctctgtggtaggagtactactagcagagaagtattatacttgaccactttttgtgttagacattgatttgtttttatatattttttttagaactgtaggagtagtagacttcttcggtggtagagaagaatctcaaacactgtgcttgtactagtagcactgcattggatcgtgggactgtacatactactagcactgcactgaactgtcgttgctatggatcactaggtgtttggatccagggacataactttagtctatgtatttagacattaatttagagtattaaatatagactacttataaaactaattatataaatgaaagctaatttgcgagataaatttttcaagcctaattaatccataattagagaatgtttactgtagcatcatataggctaatcatgaattaattaggctcaatagattcgtctcgcgaattagtccaagattacggatgggttttattaatggtctacgtttaatatttataattagtgtccaaacatccgatgtgatagggacttaaaagtagtcccatataaacaaggtcttatgtagcacttctttttataggctttgagtcttaaatatatactccgtactgtgtattattatgaatataattgtctattttgttatttgagatagtggaaattaaattttcttattaatttacaatattgtgatggtagtgattattttatatggatttctacgatgatgatgatctccttgctcaatggtgggagcaggaggaagcgtctgacgacgatgactactatattgcagctgctcttcttactgacatagagcataagagaaccaaaaggaagcatcgtggttcagtcatgggtcaagagataatttacagggacagatttgctggcaatttgcgcatagtggctgattattttgcagatcctcctatatatagtgcaaaattatttagaaggaggttcaggaggatgtcaagggagctctttttgcgcatagtggctagtgtggaggcacatgatgactactttaggcaaagaccaaacgcggtgggtcttcttggtgccactgcattgcaaaaggtgtatggtgcagttcgcatgcttgcatatgatattccagccgatagtcttgatgaagttgtgagaatttcaaaaaacaccatgatagaagctttcaaacactttgtcaaggctgtggtggatgtgtttgctgaccaatacttgagggcaccaacagctgatgacactgcaaggttgatggctatgaacactccaagagggtttccagggatgctaggttgcactgactgtatgcattgaaggtggaagaattgcccaacaggttggaaagggcaatactcagggcatgtggatgggccaaccatgattcttgaagctgttgcatctaaagatttgtggatttggcattccttctttggattaccaagttctcttaatgatatcaatgtcgtacagagatcaccactctttcaaaggcttacttcagggacagctccagagctagagtttatggtgaatggtaagaaatacactatgggttactatcttgctaatggcatatacctttcctgggccacttttgtgaagaccatttccaatccacagggtaacaagagaatccattacacaaaagttcaagaaggagtgaggaaggatgttgaaagagcatttggtgttttacaagcccgctttgcaatggtgaggggtcctgctaaattttgggataccgagaccctatggtacataattaatgacagcttgtgtaataatgcacaacatgttcattgacagtgagcgagatgaagatgtagacttcgattatgatcaggggatagtgaggtgttgaggaaagaggagtaccaacgacgcaataaatttggttagagaagtttctacagatacataaagaaattgaagaccgacaggcacatgagcaacttcgagatgatcttctggaacatttgtgggcgcttcatggtgctcgatagtttgtttcgttgcattttctgtcaactatcggttgtgttcaatactttcttgtaggacatgtcattttcatgttaaaaattttgaattcaaatttgaatcatggtgtttaaaattgtaattttcaatatggttgaatttcatgtgctagaattatttgtgtttaaattattgtgatgttaaagtagacacaaacatacaatttatactaaaataaaagagaaaaagaaataggggctaaaatatgagagctactgctagagttaatgatatttttagtgtcctaaagaattagtggcagcccccatttgatctttagggctctaaagtaggggctgctgctggagatgtcattttgctacaagcacgctgatcagatcacacctgcgatgacgtcggcgaggtacgtcctgaacctccccatgtgctccggcggcagagcaatgcccacctcgatgccgccggagccgccacggccctccgccaccgacatcgcgccggtcttcgccacggacgcgatctccaccttcgctggcgtcccgaacccgaagtcgacgtcgtacacgcggaacctcggcgacccagccaccgagaacggcgcgccgtcccttctggcctcgacgatgcgctctgggtacctctcccagtatccggtctcgccgtgcaccgcctcgtcgatggcggcggccaccgcggagcacgccgtgaagacgccgtcggtcacggtggcggtggccgccgccttcctgggcatcgaggcgtagcacgggccgacgcagttgccgaagtacctgcttgggacgcggccctccatccgccgccggtggtcggtgacgaagaggaagtaggcgcggccgccgccgtcgtcgtggccgccgtcgttgttgtggccatgtgtagctcggaggtggcacagccacatgacgccgtacgtcgcgacgatggacgtgcaccgaggcggcgggacgacgccgcggcgtgccgcctcgccggcgacggcgtccttgatgctctgcagctgcgctgacgacagcgcgtacgtggcgacgagcctgtccatggcgtcgggcgaatcgaaccctttctgagccctgggcgcggcgaacaagtcgtggatgtccttgcggtcaacaatgaagctgtggtccatgactggtggctccggcgggacatttccggcggcggcgcaggcggaagccgcccaggtgtggaggaagtgcgtcgagctcgcgccgtcgcaggcggcgtggtgcacggtgacgccgagggcgagaacgcgcggcgccgccggccgcaggcccaacaacacggtggcctgcacggcgagcaccgcgccgccccgcgggagcgccggcactagcggcgcaatcgtggcaacttccctgggatcgtccgtggcaagctcgtcgacgccggcgccgtcgtgctcggcgacggtgaaggcgaccgcgtcgccgggctggtagaacagctcgtaccggtcggtcttcccgggcgcgaggcggatgcggccggcgagcgggtagaaggcgcggagcgcgcgggacaaggagtcggcgaggtggaacagggcgccgtggacggcggcgccgggggcaaggcggtagaggaagagtcgctcgacgggctcgacgggcttgagcggcagagcacgttcggagagcgcgtcggcgtcatcgccggtcgacgacggcgtgacgtgctcggttcggaggacgcggaggcggccgccgtgatcgtgaggtggcgctgccattgccgcctcgtagcttgtagctaattaagcaatgtgcgagagaggccgatcagaggacgaatgctctcgtcggatgatcagaggcgcgtcgccacagcgtgacagcgggcacgctgctcggctcttcgactagtagtacttatagagttaacgccgatcattatgccgaaatgttacctacggcaatctaccggatgaacgtccacccggttttccatgtaaactactaaatgattattaaaaatatattaatatgaaatgtatcactcaacaaaattaataaaattaatatgtcagttcaaattcgacttcaagttataacaaaaataacatattaaactctaactagtacttatcgaaactgaagttgaactggtatatttatgaagtgttatatttcatattaatctatcttgttatttttctaaaacatttttctataaccatttaagtggcatgtaataaacggggtagatattcacccggtatccaccctagtggttgaaaagtttccctaccataccaacggcccatggttgtcaatgtttttttttaactcaacttgattttgctgccccatcacttatttaaaaatttttataattgattatgaccataaattacttctgatgattatattatgagtgatgaaaaatggatgctcatattcatgaagcttttacagacatcaataatatagcatatctataacatatttctaagtgtttatagttttctttagaaaaaaaagccaggcaatcaaagtctaaactagattagtgtccacgttaattttattcgagaatggaggaagtatatatcttgtagtaactccgtcccaaaatataagaatctattactagatgaaacattttatagtacgaaaacgtctcattcagttttaggtttttacattttgggacggatggagtaactaattactccctctgtttctaaatatctgataccattgactttatagtacatgtttgaccattcatcttattcaaaaacttttgtgaaatatgtaaaactatacatatacataaaagtttatttaacaataaatcaaatgataggaaaagaattcataattatttaaattattttgaataaaacaaacggccaaatatgtttagaaaagtcaatggcgtcaaatatttaaaaacggagggagtagtctttaatacaatttgaatacgatgtcttttctatacttattgagagcggaaaatgtgataattagcaaattgtaacacatactcatcttctaactttaatgttctaatttaccgacttgaaattggcacttctttctaagattatatatggatgatagattttgtgtagatcattaatttgtgttttttattctaagattatatatggatgatagattttgtgtagatcattaatttgtgttttcaaaaaacttttacatcagttttgtgtagatatttaattttgtaccatactttttcttgacatcatctctactattataaaaattaaagatgtttttgcctgtattttggtacgtcattcgtatttgagtcggtttttaagtttgtttgtttttggaaatacatatccttgtttgagtcgattttaaattcgttttcttttggaaatataaaaagaagtcgtataagaaatatctttaaaaaaactcgcatgctaacatgagaagaaagtcggactcctaattacagttcattattttcttaaaaaaatatccaagcaaattcccaaagtgaatttcatcctagctaaaccgtataaaactagcatcacccgttgcaatgcacgggcatttttctagcaatatacaatatttgattcttcactgtaaacaattgtcgatattatataatttgattcttcacttttattttggtcattttgctatatgactttgtttcaataatttgaatttgaatttcaaattatgacaacttcaaacaacatttataaatactaaatgatttcaactgaaaaattcatcaactacaaagttgtataactcatcaatatctataacttttattttgataatttcttcatccgacaaaatgacagtaacattgttcacaaaaaattacatctctctcttgtagtttataaactatataagagatatgtacattttgtgaacaatgttaaaaataactttctcggatgaagaaatgacccaaataaaagttatagatcttgatgagttataccactttgttattaatgacttttcagttgaaatcatttagtatttgaaaatgttgtttgaggttgtcatattttcaaattcaaattgaaactgttcaaaaaaatgttatatagaaaaataaccaaaataaaagttatagatcttgatgagttatacaactttgttgttgatgaatttttcagttgaaatcatttagtatttgaaaacattgtttgaagttgtcataatttgaaattcaaattcaaattattgaaccaaagtcatatagcaaaatgaccaaaacaaaagttgtagatcttgataagttatacaactttgttatgggtaatttttttcatttgaaatcatttactacccgaaaaactattttaattgtgaggaaggaggcaaaatagacatctcggcgagagaggaacaaaagggctgggccggcggcccaaagagggagaagaagggagagagaggctactggctgagggagggagagagaaacagctgaaaaaggatgagaggaattttaatttgttttttatttattttaataagttaaataaactttgtggtattaaaattagttactgagcaccaaaaattcatgaaaaattttagagaattatttagaccacgtagaatataaaaaatatttccggccatgatttttaacggaaagttttagttttctcattaattcacttgattaaattgttttaacttttaatatatttttttagaaatgcattatataaatttatgacgtttgctttgtgcccgttatgacaaattaatattcgtcgcgatgtcccattgaaatactttatgacgatttctagttggtattaacaacgaacacctttttttgtcactaagccacccatctcatactaatcgtcataaaataaaatgtgctagtgacgaatagctccgactttacaaggaattcgtcacagaagatcatatttctcgtagtgtccaattatcgggccatatcattacagtttggctgattatggatctgtgcttctccgacctaaacaatgctgctgcccacccgatgagacagaactacggctaataaaccgctttcgtggaaccgatgatggtcggttcgaggaaaccgatcagttttagctagttttcgtgcagcgatgacaaaaagctacagttttttttatcggttttaattatgttttgagaaatcggtaaggagcggtttttaatttcaaaacaaaaagctaaaacaatgaacgaaacacgagcacctgccctatatcctccgatgagctaaagctcaaaagcttccagcaatggaagtcgcatctcagccatcacctcccccaacacaaagttgcatagacacttccaccaccttgacaatgagccaaccgtcgtaacacaatgggatcaagctgcttaggacatgtacaatacaccaagagtgcttagaaagatcgatacttagaaaaaaccgtctcaaagttaagaaccacaatctccaataataaaaaagcgtattatggagatgggcgtagaccgaggtgacaacgctagattgcgtagactgaggtggcagcacgagatgtgcttgcgagctcaatagatctcgccaaacatggggtgatggcaacagagatggagctcggcgatgttggcatcggctcaaccaatactgccttagcgttgacgaagcacccatatcctccatagggcacgaggggctcaacgagatattgagctcaatcgagctggagccgacgcaccgatatggtgaataagactctggctcgccacgttggttcactacaaatattgttactacccgatttgtttcatctgtttagtttttatttatttatttgttccattctcatattatcttattttcttataattttatgcattgtttttatttctttgttttaccaatcagggcaatagtatacatggacatcgcatgttttatctgttattcaaacaattaatcataaaataattataataaatgaaaactcgatagagatatcgttgtacaaatatataggttaaaattaattcaatttaacacggttaaaaatgaaaaacgtacccatagttgaggtgtgcaggagttggacatctggctctttcacaggtgaagtaataacgagcatgcaggactctcttcagggcgattgatatgtacagggagatagtaggttcaactggtacgaatagtaggttcaactggtatgaatagtttccgtccgtccagaccattttttatttcggataggttcggtcggaactattcgaaaattctcggatttagaaacgattggattttttttctcagaaacgaaatgaatacagtaagattactatccatcggaatcggaaaatgatcagaattaactatccggaatatccacagacatggatcaaattttagagaaaacacgtatatatacataacttttttatatggagtcggatgaagacaaacttttataaaaaatgtagagctcagtgagatctacaactttcttgttgactattttattatataagatcatttaagggtctaaatattcattataaaataccatatatgtttttacaaaatctcagatctacaattcaaacgacatctgatggagacgtattccatatcaaagttgtagagcttaatggaatttaccactttatagtttataacctttgtatttgaaaatgtttaaagtataaaacaaacactctaagttttgaagatgtgaaataaaataaaaaaagacatctccaatttatacaacaagaacttgttaagttgtttagtgaaatggtaagtaagctatacatgtagtaaaatgtcttgggatgaggggaacagtcatgaaaatcgattttcacatccttttgtaggaccgcctacaaaattgatgatataaatgttggagacgttgttctaaaagaaatatgcgatatctcttctctcaaatatccgttgacgtattcgttccgtttcgtattcgctccgtatctgtattcgataataatcatttcatttccatatccgggttttcgattcagattaaaaaaataaaaacgaatatgataaagctagttttcatccgtttccgatccattttnnnnnnnnnnnnnnnnnnnnngggaaatgtcatctctggtgctctttctatcaaccaccattttcttttatcacgtgccgcgcatagaaagagggtagtatgtgttgacgaaaaaatggaacacaccggtctgggagatctgcttaactccagtgcaggtccaaaggttggtgagatgcggacgtgcctgtcagtttgatcctgcaactgacaagatatgcaaatagtagatcaaacagccgatcggctgactgttgacgaaaaaatcgaacacactggcctgggagatctgcttaactcctgtgcaggtccaaatcttaatgagatgcgggcgtgccagtcaggttgatcctgcaactgacaagatatgcaaatagtagatcaaaatagccgatcgactaacaagccgatggagtagttccagccgatagccgataatagccgatgccgataccagccgatagcgatagggtttaagcaatcggctatatgtccaatgtagataatgatataatggcaatcggctgatgatgatgtaataaaataacaatataatccagtataaaccgatcggcaaataatgatatgataaataagcatcgatccgaaggttaacgcacatatcggctggaggtccgacatcatgaaatccacaagattagattaaacagtgaaacctttgttgtcatcggctaaatccaacttatatgtatttataatccttatgagtcgatgcaacgtccagataactcaccggctgaaaccccgatgaaacctttattggcaatcaagaagcaggctagagattatggttctaagcacgacttagtagatcaaacttaactgatacagcactaagtatgaaaagaaacataatatctagacaatcaagccgttgactgagtttgcagggtgatagatgtctaagctaatctaatctagcaacgcaatttagccgataacggcagaaaccctaaaacgagaagcagacgatagagctaaattgatatgctaagactagattaacagagacatatgataaataggtaggcaaatatatcatccaaaccagagcaatccaagaggtcgaatgtactgatgcggccttgaatgacgccgacgtaaacgatacaattgcctgggccggcgaaacattagacttaccccttagcgggagatcgaacactgatgcagccccgcgtcaggtgccaagtcccgccggacgataaaataaagtagaaaaggtaaaaggtggcgatgcgccgaattgtattgatcgtgaggatagattacataaaccctggctgtatatatttttacctatgggttgatacaagtccttgtcggacaagaaagaaactttcctaaagataaaaggaaaagataaagtccttacaggacactaaacacactttcctaaagataaaaggaaactaacaaactattcctaattaatagataatttgccatgccatattctctttaaactcggtctcttatagataagctttctttagtagatcaatttccttaaccgaatatagcaagaatccgacaactgacgacttgacaactctcatcggctaatctcaggacttcgaagccgatgctgactctaagccgatgactactccgggcttaccaaatttaactgttaacattgacaagccgataaagtagttccagccgacagccgataattgccgatgctgatactagccgatagcgatagggtttaagcaatcggctatatgtccaatgtagataatgatataaaggcaatcggttgatgatgataagtaataatatagcaatataatccagtataaaccaatcggctagcaatatgatatagtagaacaagtattgattcgaaggttaaagcacacatcggctggaggtccgatgtcatgaaatcaacaagattagattaaacagtgaaacctttgttgtcatcggctaaatccaacttatatgtatttataatccttatgagtcgatgcaacgtccagataactcaccggttgaaaccccgataaaacccttattggtaatcaagaagcaggctagagattatggttctaagcactacttagtagatcaaacttaactgatgcagcactaagtatgaaaagaaatataatatctagaaaatcaagccgttgacttagttttcagggtggtagatgtctaagctaatctaatctagcaatacgatttagccgatactggcagaaaccctaaaacgagaagcaaccaatagagctaaattgatatgctaagactagattaacagagacatatgataaataggtagacaaatatatcatccaaaccggagcaatccaagaggtcgaatgtactgatgcagccttgaacgacgccgacgtaaacgatacaatcgactgggccgacggaacgtagcacttaccccttcgccggagatcgaaagccgatgcagccccgcgtcaggttccaggttctgtcggatgataagtaaaaacctcggtaaagagggtggcgatgcaccgagagtagttgtattcatcgatagattgatagattataatgacctcgggtgtacatatttatacccacagggagatactagtccttgtcggacaagaaagaaactaaagataaaaggaaaagataaagtcctcatcggacactaaacacactttcctaaagataaaagaaaactaataaactattcctaattaatagataacttgccatgccgtatccttcttgaactcggactcttctggataaattccctttagttgatccgactccattgaggacacggttgctggcgatttaacgactcccatcggctgattctataactctgaagccgatactgactctaagccgatgatgactttagtcttatcaaatttcgtcgttaacagtatgtactctcctttttcttccgcagggccagcggaaggatgacaccggccgaaggcagaaagaaagagagtacgaagaggggtacatgacaacatgacggccagagcttgacagtacaaaagaagaacaagtccgcaggttggttttggagctcgcatcatcgaatcggtagtacaatattgcagcaaagctttcaggtacgaattaaatggtcatcccacgtgtttttacttgaaattgatgtacaatcaagtaaggtcctgtttagttctaaagtttttttccaaacttccaacttttcatcacatcagacctttcatacacaccaaacttttctatcacatcataccaatttcaaccaaagttccaaacttcagtgtgaactaaacacaatgctaacagaatctgcataactgacattacacagtgcattaatttcagcttcatgtcaatatcaaaagcgattttttgtaggcaccctgtaccgcacatcacaacaggcatagtacgtaatggcacccacttgtaccggttttgctaattggcgcgcgcacgccagatccgtatctggcgcgcgtgcccctccacccgccacgtgtccttttccttttagcgattttttttccgcattgctttttttttgcgcgattttttcctttttctttggcgcgacttttttctcttttttttggcgcgattttttccctattgggctccctcccctcggtgtatttttcatctttttggtatactttttgattttttttaaatttgaaagttttaaaatctgagttgaaagttttcaaatctcgagttgaaagttttcaattctcgagttgaaagttttcaaatttgagttgaaagtttttaaatctcgagttgaaagttttcaaaaattttcttgcaaattgaaaattttcaaagtctgagttgaaagttttcaaaatttgagatcaaagtttaaattttaagtcaaaagttttcaaatgtaactcaaattttttcaatctattagtaaaaaagttatcctaagaaaataaaaaatctattcttaattacagtcattatccttgactaacagagttagttatggtaccgcgtccttccaagaacgtgctccgcgtgcgcgctagttctgctcgcggcgcgtacgcgcgtactaggaacgccccgcttgtataggaacgccccgcttgtacagtacatcagggtaggcgtaagggaccatatgtggaaaccaattttcacatgtaacatatgaaaatgcccccatttacacagtcttaagtgatctccttacgaaatgtttgatttttcaaagcagtcgcttaagatatatagccgcttatgaaaatgatgatatttatgtaatcaagcatattaaactgaccgccttagagaatgtgtttatcgagatggcgctcttaactgtctgtatatgtcctgtcttttcatctacttcgcgaccttcaacaatcatgcctaatcagtgtgtgcttatgcatcatcactgcatttcttggtttcaaagcccaagaaaccaggaagaatctcaagagaaaactaaactaattaaacaagaaactgattaacttgtcatcagacagacagagcgctgctcgctgaaattaaatcaatagtattaagagggggacagtggcagaggccgtatctaccccgggacggcctgcgtcgggaaaggagcacctcctcctcctcatcggcgtcgagcagtcgcccggacagcgaccggaccagaccggaccagggcgccgcggaggcagcaagggaagggaggagagagagggcgcgccgccgtgcgcgccttgccggctggccaccgccgctcactgcagcaggggagggaggagagagaggggatagtggatttaggaagagagagtagagagagattgagaggatagaggggaaagagaggagagtcttataggtggggcccacactactttttttaaaaaaattttgctgactgtactcacgtagaactgaaactaccccgaattaagccggaggttatttgtccgattgtatagttaagggtgtaaaatatccggtattcgagtttagggagttaattcaatcgcccatgatagttcaagggtgtaattcgtaccttttcctagcaaaacacacaacgtttaaccatttgaaaagcgtacgtgcggaacacgatggagaggagttggaaccaaggatttaaatctccggctatagctgccgctattgccggagatagccgctgggagaagcaaccactaagatatgtccaatttggcgctacacattctatggcgctattagctgctcttagctggctatagctgctaaatgggcccttaaatagcggcagctaacttggtgggctgagagcctaaaactaaacaatggggcatatagaaacaattcaaccctaactctatcactctttcacagtcactctgtcgctcaccctctcccctcgaaaaacaggcacagcggctgtgcctggaggcgacggcggcggctgcaacctgcagcagcgacggcgatgaaaacagcagcggctgtgacctgcagctccacatggaggccgcaacggtggcgcccggaggcggcggctgtgcgtatgccagcaccaagcatctgcggcggctgtgatgggtggtagctgcaccaatccctccctccccactcttctctattctccctcaagctgctacggaggcagttgtgccgaagacagtgagggctgctgggcagcacaaatcctctccctattcttcgctagtttttctttttcctaacaagagacgtgcaagatttttttgctatgattctctgatattgaatgtggtattgaactattcaatgtaatatcaagtgtcttggctctttaaactgtacaagaattgcaaaatttatgttagtttttgtaaaaccgctaatgagcttagctgcagcaatagccagctatagctggttgttgacagttcgatcagtttcgaccgtcaatattactaaaataggggagaactagtgatgcttgcaatgcataaatatgttagaataataatattccactagtattaggtatacttaccttttgcagagaatgacaataaagtggaggagaatcaacatcaactcagatgataaatcaatcggatgatgtcgagaaccagacttatgtatgaatgggccaagaactcagaaataacacgacacattgggccaaaattcacaagtctacggaggaggacaacaaaggaggccgccagccgaagatgggttggggccgaacccaccgcagctccgtttgatccagggttctcctggacggctgagattgctccccaatgacggttggagggtattaccgactattccaaccgttacaaccgtcattgggaggctataaaaggagcaatcatcctcacttcactcacacacctcaagcaatagctctctcatttatctcaagtttagtttagtagtatctagctggtggaataggaacatagtagaaatcaggagtccggaagccttcggaagagtttgggtatggctctagtagcttttctcttctcttttgtaagccaagccttgtacttttagtagaatactcttctaaatacatttatggtattgaaatacattccgagtatatgagtacctactttacattatgttcatcttatactgaatatacggctagcttatctgggagatgctttggtgcgggtataatgtttgcctatgcaattactctatgtcatgacgatgatattagagtagtatctggtagtttagacgtggtgtctagattacgggatatcattatttggggttatatattgcgaatgagaggtgggctgctgatagtgacagctcagtacgggtattcctccgcgccggtatataatcctaagttaattccctagggaggatactcctccgtatttagccccggttgtatggtcatgacgggctgtcgtaaggaactcggcagtcaggagtggcttctcgaagtaccaggagggcatcggatagagggtattagttagtatatcggttaactagaatgtatgtatactatgtatattagaaatataggaatagattttcttttcttttctttccacttagcttaggtgatatattatgagaatgagtagttaatgcttgtgtgtcactctacccttggattatcttaacccctgcttagaatatgattatcacaagtaatatataaattattagtcaagttctctctacatgatctttccacgggataaaataaatacgatacccttggaatactctcgggtgaaacactacaatggtatatctgtgggcttgcggatgaactctgtaaccataatatatcagaagtacttttgcgccattgctgggaattatatttctagtaatgtcgttaagaaatacgaacaagcatttctggcgccgttgccggaggagattcataatagagactacttgaactaatattttatatttgcctctgtataatcattttcctttgcaggctaaccttggttgttttcacttttgttgtgaaaacagggtagtgcatgactggtttcaacttgccgaaaaacttcaaagaaaatccagaagctttctttcggagcattaggccgtgagtcgctgctccgcagaaaactctaccgatagataaaccagccgtaccaacgccaccgaccttcaagactatggctaataagactctccgcgagttcgctgctccctctgctgacaatgtggccattgggccgcaggtcaacataggggacgtggatttcgacttgaagtccagcctcatcacgattgcgcaggcaaacccgttctgtggtgagcctaatgaggggtccaatgctgatctgcaacagttcctggagatctgtagcacgtacaacatcaagggcgtcaatcccgacaccgtcaggctgcgactgtttccgttctcccttctcgggagagcgaagcagtggttctatgtgatgaggacatcaacaccaacgatacatccacacttccacaattacaacttcatggtcctattacccacgctcgtgcatgtcaactcaactatcaggaacaatggagaggatcaaacggggagaggattcgcgcgggatggattcggactacagcatagcacaaacttctgacggccgccacgacttcctgcgaactccgatttgggcttgtaagtacttcatggaaagcttgtcaagtctactttcaaatgaatccagcctcatgtccatatcagttctgggcagccacaatcttcattttactaccgagtccttttctgtccacggtgccgcgtcacctctttgggcccaatgggcagtgtattaagttgggtccattagggacacgtcgtagggtgagagaacgaccccagcactcctgtggtcgtcctcttcctcttcttatagctttctccgccgccaagaataatcgggttttgtttagatcaaagtatagcgtcgctactttgccgagttgatcccgtgatcgattagattgccggattgcttgttattgaaccccacttgttacttctattgattcaatccaacatctttgattcgcaaatttagttgcttgttcatcttgttcttgctggttctcgattgcttgcaggaacaaataccctcgtagttgggctgatcgtgcatccgtcgagattcacgaccacctctggagttggggtaacgattgctaaggcgcaacatccccggatagttgtagtcggatcgccaacgtcactccatccaatcgacttatccctctcatcgaaagatcgagacaccctcgagcacatcaggtggtatcagagcccaagttgctcggtgagagatttcgtaattttcttattcctacagtccagaaaaagccaaaaaaaatattagattagttttctatgatcctactagtactgcttagttagggcttgttgagttttcgattgcatcggttgtgttaatttgttggttttagtgtttagtcgattagagtttcgagttctggccaccgcacatcgccatttttttctttcatcaccaccatctcagccatcaccacttctgttgtcgtcgggatctacgaaaacggaaccgcctcgctgccacggttctattttagtagattttagaagtttttatcggttggttttggagttgtcaagttgcatataaggtttgccgagttggccgtgtttctgtttcggctgtgcttgtgtctgttgcgcgaggaagaagagagaaaggggatactagatcggtttttggatggagtcttacaatttgtagattggtttctatttgggcgccatgcagaagagataaaaaggaatcgatttccttctttcattttttttaaccgagtcccacccccttgcgtcggtttccatccccctctcccaagtccgactccccctctcgtatctcggtttgaatctataccgtgagttagctacataccttggtgaattttcgtttggtgtcggtttcaagatctgtttggaaaaacggaactggtgtaaatttagcattccatttttgtatagttttattttttggttcggacttttacacttgagtccctgtattttttatatttacattggagtccctataatcttacattgaggtccttgagttgtttttgctaaagaaaatacaaaagagtgagaaacggcagaaaggtgcaaaaaaaagagaaaaaaaagccgcaccgaaaaaaaagagaaagaaaaaagaagaaagaaagaaaagagatgagaagctgacttgtgtgtgagtacaccccccccccaaaattcagtgttgtcaccaccatcttcctatcatcgctcatgtttggtttgtgtattgtggcgtcctttgtggttaggctcgtgtctctacttcggctagcctaggaccagcattgtaccaaccttgagagattattcaacttgctttgactaacgtggtttctagtttttctttgactcattacacagcccacccatagctccaccggttcgactaacacttgacagggattcagctaccaaggcatcaatacaccttctccagaggttcgtccaagtccgacggttgccatcacctcctgtttggcatgatgagaattggtaagagcttgtggaacaggttgagagtgagtgacttgatagatagaaccacatccaactagttttgtaggattttttcttcttcttcttcctttttcatttgctgctccatagtatttgttttgtctgtttattttgtttctaaccatgtcaggtgttgagcattccaacccccactcaccccgcacaaaaggaattatttagcattttgacaggttagtgagggaccgcacacaagggctcgaggaggatgtttgtatcaccaatgaaaagcttggtcatgttgaacgcacgcaaattgattccaacaccaagcttaccaccttggaagcttctgttgcgacggtgaacaccagtcttgatggtattgtgtggcgtcttgatgagatggcccgagcatcccaccatggtagtgagatggatgaccatgactacgttggtgattctgaggatgatgcggaccagcgacgacatcgcttcaatcgccgtggtgtggctcatcgtcggccacgccgtgaggtacgaaataatgatgattcatttggtaagattaaattcactattcctgcttttgatggtaagtatgaccctgatgcctatctttcatgggagttagtagtagatcaaaagtttgcttgccatgatgttcctgaggataagagggttagggctgccaccagtgaatttactgattttgcttctgtttggtggtgtgaataccgtcgtactcatataaatgctttgccacctacttgggatgatttgaaacaaattatgcgtgctagatttgtaccttcatattatgcacgtgacatgttaaataagctgcagcaattgaaacatggtggtactagtgtggaagaatattaccaagcgctgcaaatgggtatgttacgttgtaggttagtagaggacgaggaggctgccatggctcgatttttggggggcttagatcgggaaatttatgatattctcagttacaaagagtataataatatgactcggttatttcactatgcctgtaaagctgaatgggaagtgcagggatgacgtgcacaaacaagggctaacattcctgcaggtagaactccatggacggctcggagtggcgctgcccccaccgatcgttcatcagtttcgacatcgacatctgcaccctccaacagcaacagcaacaaagcgtggccaacaccttctacggcccgctctcgtgcttcagaggttgcagaaaagcccaccaagagtgcctcctctgttgcttccacgggtagaacaagagatgttcagtgccaccgatgcaagggctttaggcacatgcaacgtgactgccctagcaagcatgttttggtagtcaaggctgatggtgagtactcgtctgctagtgatttcgatgaagatacacttacattgcttgtagctaacaacatagctagcgaggatgagaaacacatcggggctgatgtagcggaccaatatgagagccttattgtgcaacgtgtcttgagtgcacaaatgggcaaagcggagcagaaccagcggcataacctttttcagacgaagtgtgtcgtccacaagcgttcctggtgcacaatcatcgatggggccaccgggactaaaaatctgggggtatatatattcccggtgctccctcgtcttctccaccaacacttagacgtttttccatcgagatcgatctcggcttctccttcgccaccactgcctagggcaaccccgcgccgacgccgccgtcgtctctcgccgtcgcttggcggtcctcgccgcctccgccacagacgccgccgccacatctcttgggtgagagccgccgctgcctctctctctctctcgatctcgatctctctctccaaacctccgccgcctagctcgttgccgacgccactactacgccgcggtcaaacgccaccgccgacgaccgactttgacgccgccgcccccgcctcgagctcgccacgccgccgcgccacgccgccgggctgctacgccatgccgccgcgacgccacgccgccgccgggcccccacgctaccgccgcggcacgccgccgccgggccggcccacggcaccccgacgccgccgccgcgccgccacgccactgccgcgcgcgcccaacattgccgaacgtgattgaaacgtgaccgaacgcgaacgaatgtgaacgatacgtggacgactgtgaacgaacgcttaacgaacgtgaacgaatgcaaacgaacgtgaacgaaacgttaacgaacgcgaacgagcgtgaacgaaatgcttacgaacgtgaacgaaacgcttatgaacgaacgtgaataaaacgcttacgaacgtgaatgaaacgcttacgaacgcgaatgagcgtgaacgaaacgcttacgaaacgcgaacgaacgtgaacgaaacgcttacgaacgtgaatgcacttgtactaaaagtgtgagaacgaacgcgtttagactaatacattttcctggtaatacatatatgattatatatatgtaacttggcccgtttagactaatacattttcctggtaatgttgcagagaagacgttgtcatcgtccgtcaagccgaagtggtagctagccatcgaaggaattcgcgcaggcaagtgatgcaaagaagtgattgttagagatttaatataagattgttagacttagcatatatgattattacaattttaatataagatttgtagcgatttaatataagtttgttagacttagcatatttgattattacatttttaatataagattagtagcgatttaatataagattgttagagatttaatataagattgttagacttagcatatatatatgattattacaattttaatataagattagtagcgatttaatatgagattagtagagatttaatataagattagtagcgatttaatataagattgttatacttagcatatatatatatatgattattacaattttaatataagattattagagatttaatataagattgttagactaagcatatatatatgattattacaattttaatataagattattagagatttaatataagattagtagagttttaatattacggttagcaaatatgacctatagatctaacaaatattttttgtatgcacacatggctgatcgcgatgaggaacagatactatacgatacaaacgcagagggaagcagccagtactggaacgaagaagaggggaacgaggatccaaaccagtacttgaacgaggaggggaacgtggagagcgatgcggaggggaacgaggagggaaacgatgaggaggagtctactggaagtcatccctctgctggacagaagagggcacacggacaacgaggtgccgcaaagaagatagagggtcggcacatcgtaactgaggtggacgaagacggccgacctagtgccctagcagaagcagccaagaattttgtacaccacagcagttgggttgtgagggacaacgtgcctgtcagcacggtgtactggcgcagaacaagggcacgcagggataatgacagctttgtcccggactcagaaaaagagatgctgtggaccacaatgctcgagacgttcacgctacccgcaggtacgaagaacatagtgaaacagtggactctgaagaaaatagcagaacagttccagagcttcaagggagatctctacaagaaatacatcttgaagggactaacaccgaacttcgacgtattccaaaagctaagggatcattgggacgagttcgttgcttacaagacagggcaacaagggcaagcgatgatggccagaaacaaagaaaatgccgccaagaagaagtaccatcaccacttggggtcaggcggatatagcgtcgcaatgccgaagtgggaggagatggaggcaagtttgattgagaggggtatcgaaccggccaccgctaaatggccggatcgatcgaagttctggtactatgctcacggtggaacgcttaagccagttgatggctcccttgtcttcagtgatcagatacgcgacgctgccagtcgactaacggacgcggtggaagcctcttctcagggcacattccgacccgacagagagaaggaagagctgtcactcgccctacagattcccgagcatccaggacgaacacgagggaaaggcgtgattccgtggaagattggatttaaggaggacatccacacgtataggagtcggatgaggagcaagagagataccgaggcgaagattgcagatcttgagtacagggtatcgagctacgagctcagcatgcaagagaagatggcaaggaaggtggatgaacgtatggccgcacatcggtcccaggatcccagtcgtacattcctcctgcaatggtcagcccatcaggcaatcgtagcagctgcgcctcaacggggtaggtaggatcacagagcatggacgccatgcaaacccaggacgaaaccacctgccccgttgatgagatcacgcagcggacaccatgtgagctgcatattcccttcaagaacttatcaatcaaggtatgctcatagtttgatgatttttgacttgtacattccacaagttgctgcttaggttgattactaatagataacctctcatcacatgaaggtggcgtcgggaatggccatcccaacggacccttccgggacttaccactgcaggccgattccagcaggatactcgagggtcgaagttgagctggtagaagccgcgtacaaggacctcgagttggactacccaggaggagacggtgagacgcatctacgagacacaagacacgccattatactatggtgcaagcggtacatcatcctccctgggcgacaagcggcatctcatgcaccatctcctctggctccgccatctcctcctgcaccatctcctccggttcctccgccacgtcctcctgcaccatctcctccggctcctctgcctcctccgcctcctccacctccaccgtgtctgcctgcaccacccaagacaaggtctcgccaagctccaccgcctgcccgcacaagggcaacgaagaaggcgaaagttgatgccaccaaaaacaaggagccaccgtacgattgtagtcaagaggagcttgatgcttatgtggcaggagaagtgaagaggcaacttgagcctcggagtcctgaaaagaagatacctattgacccgagcgtgaagaactacttcaagggaatgtccgcaacaaacaaggaggccttatagatatcggactatgactgaacacttcagagagcctatcacaagaagtctaaaccagtccctcagcttggagaacaaccaaaccaagaggtcgagccgttggtgaccggcgaagattttggcataacggaattcatttcagacaccggtctaactgtggatcagctgattcgaggcgcaccaatcctgaaggcggaagtggcatacaagtttgaactcggtaaaccgcttgtcaagcctgagcagctgcagtccctaccgacatagatgtacaaattccatgaatggtacatggaaatgagcgccaagggtagagagatgttcggagcgaggatcagaaaccccgacttcttgcaaggagaagatattctctggatccatttcaaggatctcttcgatctgtaccatctggacgccctcgacgtctctcttctgagcgcatggattttgtgagtatctttgagttcgatttgtttcgttcaataattagctcctggcatatatataagcaataataatttcctttcatcgttgtagaatggagattcaaagggcccgacggcggagggtctacgatactgggttcatcgaccctcggaaaatcaacaccaaaatgatcgacaagtaagagaaagacacagaggacaatctcgtccatctcctaacatagcagcatttcaagacgtacatactactgccgtacaacacagagtgagtttttattgtcgttcgaacaaatttcgttcccatacatatagcatgtacattttcatatatatctcatctcatgcatattccagattccactgggtcctgtcattcttcgacttggacgcatgcaaagtcactgtgtacaactcaatgaataaagaggagaagatttttgacaaggtcttccaactgatagacaggtaatataatgccatctattccaaagtcgcggggaatctattgctattatgttgatctcgggtaataattaattaatcatagcttgcaactgcatatgtagggcttgggatcggttccgtcagttggtccgcgggacttagaaagaaaaacttggaaggaggtttcattttccagtgagtacatgcatgatccaaaattatattgaattgaatctctaattacagttaatataaagagtatattaaatctctcatcgtttctcatgtagtgtgcaaagcaggaccagggaactaacttatgcggctactacgtatgcgagtatgcgagtatgcccactgcctatcaaaccaaatatgcacaacacgagagctcgatgtacgtatacataaaccattcaaaatttcattgcgtatcgatttgttaagttgtttattaatttcatatattgatacgtcattattttttcgaatgatagcatattcacatgagggataatctcccacacaaggtttttatcatggctgttcaagaacaactgatgggattcatcaacgaagaagtccttaattccgatggtgaattctactacgacggatcgacaattcataacgtcggtccttcctcttctgacataacgccggcgtcgaagtggtagctatagctactgagcaaatgaattgtactatatatgcatgtatatatatatttatatatgtacacatttactttagtgttaatatatattttggtaacatatatgcacataaaatgttaagtgctttaaattatacatatgtgtgtaatatatgatttatacatatacacatatgcatatatatacatatatatatatatataatcaaccatgcagcaaacagggccatgcaaataaaaaaagtggtgcaccgatctttagtcccggttggtaacacaaccgggactaaagatggttcggccgaccacgtggctgaccgatctttagtcccagttggtaacacgaaccgggactaaagatcgatctttagtcccagttatttcacccgggactaaagatagctatctttagtcccggattcgtagtcccggtttgacaaccgggactacaaacggtttctccaccagtgccatcgtgagccactctgacggtctaaggccatctacaatgggtacccctaggtcgtgtccctagcaccctccatcaatttttccgtctgcgtcgttccctcgctagtccgcgcacaccctagctaggggtcgcgcctctcgcagctttttagccagggacgaagacgagcaacgcattgcagcgaccggttcctatggccaccgtgtctccagcgatagattccccttccacccctctcctctctctctttctctctctcgcccgttcccctctcttgggccctccgccgccacagcaaccgcccgagcagtggcgaggagcgggaggaggcgacggcaagagcggcggcgaggagcgggagtaggcggcggaggtcgagctcggcgtcgtcgacgggctaaggagcaacggaggaggcggaggatggcggaggtcaagctcggcgccgtcgacgggcttgaggtgcccgtgctcgcggccgagcagcacgaggacgacgtcgtggtggtggtcgtcacgctcggggatggcggcgacgagatccggccaccgcgcgccttgcccggcctcctccaccggtgccgtgctcgccaccgccgtccgccacctcgcactcgcagtccgccgcctcacgctcgccgtccgtcgcctcgagctcgcctcgcgctcgccgtccaccgcctcaatgcggcgcggccggcggcgctccatccaccggggggccagatccggccacggcagcgccggatctgccgcctccggggtcgccgccaccaccatcacgggagagagagagggagagagcggcgggagagagagtggcgacggcactctcacgtgcgtgcgatggagaaagagagagagagaaggggaagagaggggtagaataggaaagagaggaataggagagaaagaggcttttttgggttggggctacccagagtcctagacgtggcctgcattgtaaaggtgagtacgcctagagtacctcagttagtgagggtactctaggagtgtctcagattgtggatgccctaaccagtaaaatactccttgtttcttctttcttcctgccttggtgagtgccttcggccgtagagcaaagagcgagctctgttctttcttttttttccctcatatctctctccctacgtcatttttttcttaactactactcactcttctcttttcttctgcagttctactgctgctagcgagctctccttgaactcactggttggagggaagctatttccgatcgagctcgtcggttgtcgggggtgagatatgtgttctggtgaggaaaaggaggccagcttctttattttgtgcttggggtgagcgcggtcgccttctttgagcgtggagcatgtgaggatcatgtagcggtgccgtccaaaggctaagtatgcaggtgtttgcccccattcagtgttgtcagctccgacagtgtccatctccggcaagcaaacaggagccgataaactgatcgacttttgaatgtgttctcatgtctctacatgtgttctccatgccggtcagggtttcatgccctgccgctgctgcgcgaaccccgctttaccgttgtctttgctgccgtcagtgtcgccttttgttgttgaaattataagcacataatgatttaatttattccataaataaatcatgacattgcagatgtaaactagattgaacgcatcattagatctacacatgtaaactaagcagtaaaacatgaacagatcaaatatgcgcaacatgttgaacacgtaccgaggtggcggaaagacaggttgcacggcaggaactactcgcggttgcgagcgtcgacgaaggcgcgaagcacacgagcggagaggaaggcgagccgtcgcggacgaacagggagcagtcgcgcgaagcgcttccaaaaaacctcattgccgccttctcccggtgcaggacgtcgaaggcagaggttccgaaaacctgctctcccgatcgccggtgcacgccggcgagcgggatggagtagtctatgagcgacggcgcagtatagagtaggaggcaaaccctagattgattttgcgtgtgttgcgtgaaggcggcggctcggtttatatagagataggtcgcttgatcagggcgcccgcacgatctccactccgcgtaaccgaaccggataagtcgcgcgtaacttatccggactccacgccgttttcacgcaccggattttttggaatgtttccaaaacaaaacaaatctgaatttcccgcagcaaaacaaaactgcaaaagcttatccggactccactccattttcacgcaccggatttttcggaatgtttccaaaacaaaacaaatccgaatttcccgcagcaaaacaaaactgcaaaaggaggttgcatttgcgcaagggtgaggagacaattttgtggaccatttgacgcgtacgtcgtgcacgcgcgtcgcctgtcctgccaggccaggcgaggcgaggcgaggcgaggcgaggcgagcgagcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgatttttcaaagaattaatcttcgaatgggccttagcccatatattaattccaacaatcccccaccaaatctcaaaatcccactaagatttgcctttttccaatgtacagttaatataccagcggttcgatggagaccgattaaggttgaacatccacctagaactccaagctacacttactcacaacttgaacaatggaatacgtcttgaattgcaagtcttgtgcaagaaagtttcactcagagtcttatctggtactagaccgtctgtagactacccctcgggtggagcgtataagtcatactcctaggtctttagtaagctttctagaagattcacccaaaatctccatagactgcgaccaacagtcaagcttacaaatgtgagttctttcaagaatgctctacaggacagcatcttcgctaattaaagccaacagaactcattaaggcatagccaacctgccttgcagctcacgagagtacatgcatcttcatttagagagggtatagatcggtactctcctctagtttactaatggtttgttcttcccaggttctaattcataggatctccgatcacatagactgggataccaccatagtataactcacatgtgtctcaaacccatctccttcgatgcattatctatcacatttcgtgatagtcccttcgtgaagggatctgcaggtttctagctgtttggatgtaatccaacgttataactccagagtttcttaatttcctgacagacttcaatcatcttttcacatgtctagacgatttcatattatccttaaaactattcacttttacaattaccgtttgattgtcacagttcataaggatagccggcaccggtttttcaacaataggcagatccattaatagatcatgcagccattctgcctcaacagtagcagtatccagtgccgtcagttctgcttccatggttgacatcgtcaaaatggtctgtttgcaagacctccacgaaacagcaccaccacccagtgtgaagacatatccactagtggctttgatctcatccacatcagagatccagtcagaatcattataaccctccagtaccgcaggatacccagtatagtgaagccccaattccatagtacctttcagatagcgcattactcgctcaagcgcacgccagtgatcatctcctggattagaggtaaaccggctcaacttgctcacaacaaaggagataacatgcctagttgcactagccaggtacatcagcgagccaatgatttgggagtattccagttgattcctagcaatttttttgttcttacgaagcaacaagctaggatcataaggtgttggagaaggcttactatcaatatagccaaagcgattcaagatcttctccacataatgggactgcaagagtgtaatcccattctcacctctaattagcttaatgtttaagataacatcagctactcccaaatccttcatatcaaaattttgagacaagaatggtttaacctcatttatcacctcaaggtttgtcccaaatatcagtatgtcgtcaacatacaagcatagaataactccctcacccccaccatggcaatagtacacacatttatctgcctcattgactgcaaagcctgcagatgtcaatgttttgtcaaatttctcatgccattgcttaggagcttgtttcaaaccatacaaagacttcaacaatttgcacactttgccttcttgaccttcaactacaaacccatcaggttgatccatatagatctcctcatccagctctccattaagaaaagctgtcttaacgtccatttgatgaacaagaagaccatgtgaggttgctagggaaagtagcacacgaattgtggtcaatctagcaacaggtgagtaagtgtcaaagaaatcttcgcctcctttctgagtatagcccttagcaacaagccgagccttgtagttttcaatagtaccgtcaggcctaagcttcttcttgaacacccacttgcaccctacaggtttacacccatagggtcgctctgccacctcccaagtcccgttagcaataatggaatccatttcactacggacagcctccttccagtagtctccatcaggagatgcatatgcttctgaaattgacttaggagtgtcatccatgaggtacacagtgaaatcatcaccaaaggacttagccgtcctttgtctcttactccttcgaggagcttcactgacatcctcctcagagacatgttcatgtgtatgttcagtttgttctggtggtgtgattgtactgggaattatttcagagggttggctcgaaccactatgtgtatcgttcattgggaaaaagctctcaaagaaggtagcatcacgagactccataattgtaccaacatgcatgtcaggtgccccagatttaactattaaaaatctataggcaatgctgtgatgagcatatcccagaaagacacagtccatagtcttaggtctaagtttgcgcttcttcgttattcgtacattgactttcgccaagcacccccatctacgcaaataagaaagtgatggttttctcccaatccatatctcatatggtgttttgtccttatttctgttaggaactctgtttaacacatgattcgaggtcaacaatgcctccccccaccatgccttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaacacgtttgagaaaaactctccaccacgatcagacctaagcctttttatctttctgtcaagttgattttcaacttctgccttataaattataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaagcttgcaaggttgcttcgattgcacacaactatggcacttagaacctttgacaatggaaaacttaggaattaaacacatgctggaaagctgagacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttagacatgactactttattagactcaaaaaccaacttaaatccgtctctagtcagacggaagccactaacaagattcctgtcgatagaagggacatgctgcacgttcttcagctgcatgatccttcccgaagtaaacttcagatctaccgtgccaacaccatgaacagaagcatgtgacccattccccattaggacggtggaacccggtgcgacctgataaggagaaaacaatgagatgtcagcacaaacatgtacattggccccagtatcaacccaccaattagtagactgattaactgaaaaaacagtaggtaaattaccatacccgcttccatctccagtgttgccaatggtcacattagcagacttagaagtctaccctgcaggtgccttcatccccttgcgctgtggacacttcctagccagatgaccaggttgcccacacacaaagcaagtcctctcatcctggttaggattattgttgttcttcttctgcttcttgaagttggtggtctgttgagctttgtatttccccttgctcttgttctgagccttgtgcacaacattggcactggactgcccaccatggcccttagacgtggcatctttttctcgagctttctcctcaacatcaagagacgctatcaacccctcaacggagtattcctgtctcttgtgtttgagtgcagtaccgaaacctctccaagatggaggtagtttcgcaataatgcacccggccacaaatttgtcggctaagacacacttcaggagttcgagttccttagccatggtttgtatctcacgagcctgttcgactacagaacggttgtcagccatcttgtagtcatgaaactgctctatgatatacagatcattgctagcatcagtagcaccgaatttagtattcagtgcatcccacaactccttagcgttggtcatatgcatatacacctcgaccagacgatcgccaagcacgctaagaatgcatcccacaaagagagtagtgggctcatcgaattctttctgctgatcagcattaagaacgcccataggcttgccagtacttacccagaagcatttcatagctgtcagccacagagtgaccctgatctgccatctcttgaagtgcacaacggtgaatttatctggcctcagtgcatcggcaaaaccagccatagtaaaatcaaagcgcctataataaggtttttggattgttgaaattataagcacataatgatttaatttattccataaataaatcatgacattgtagatgtaaactagattgaacgcatcattagatctaaacatgtaaactaagtagtaaaacatgaacagatcaaatatgcgcaacatgtcgaacacgtaccgaggtggcggaaagacgggttgcacggcaggaactactcgcggttgcgagcgtcgacgaaggcgcgaagcacgcgagcggagaggaaggcgagccttcgcggacgaacagggagtagtcgcgtgaagcgcttccaaaaaaccttattgccgccttctcccggtgcaggacgtcgaaggcagaggttccggagacctgctctcccgattgccggtgcacgccggcgagcgggatggagtagtctacgagggacggcgcagtacagagtaggaggcaaaccttagattgattttgcgtgtgttgcgtgaaggcggcggctcggtttatatagagataggtcgcttgatcagggcgcccgcacgatctccactccgcgtaaccgaaccggataattcgcgcgtaacttatccggactccacgccgttttcacacaccggatttttcggaatgtttccaaaacaaaacaaaacaaaactgcaaaaggaggctgcatctgcgcaagggtgaggagccaattttgcggaccattcgacgcgtacgtcgtgcacgcgcgccgcctgccctacccttccctaccaggccaggcaagcgtgtgtgtttcccctcttctctccaccactcatgcttcaagtggctaggagggcatcctcccttttaatgaggttcccctctcctagaatacgcaaggtggtactaaactccacatgcatgctatcccatgaggtgggcttttgtgattttccaaagaattaatcttcgaatgggccttagcccatatattaattccaacaattgtttccgccacccttatccccctccgtctatctatcgggagtaccggagtggttagcaaaggaaacagtggaagaggaggtatttgggggaggaggatactgcagaggccgaggcgacgatgtgtgatgtcgcatgatgaggagtcaagagggggctgttatgtaattttcaactataccattttttatgtaaaattgttaaaaaaaagtgcatatattaattcgttgttaaacttggtgatacataagaaaccctgccaaaattttagtaatattgctaacttataaaaattttgacataatcaaaatttgataaggtttatttagctacaatttgaatagtcccgaagatcgccacccttatggccgctttatcttatttctcattcctttatttcttagtagcattttatatcctttgaactcccgttgactgtttccagagtgttccattgtcttattttaaccgcatgatcggacggcgtgagcttcttccttacctccatccaacggttaattttttttaatgacgtggctcattcttgagataaatctgtcattaactattcacagataccagtcactgctcccactgtcctgcctccctgaatctgacgctcgctgcctcgctctacagcgctttcgcgcgcacgcgtcacgtgatcaccggccacgatataagcttgagactgtcccggtggggtcgctccttaccggcgaaatgagaaggtgaaacaaaaagaaacacagtaaaaaaaattagtactacctctgttccatagtaagtgtagccatgatattccgcgtcaactttgatcgagctaactttgatcatccgttttatttgaaatttttttataattagcatttttgttgtcatgaaatgataaaatatgaatagtactttacctcgtgacttatgtttttaattttttttaaaaaattttcaaataagacgaacggtcaaagttggacgcggaaaaccatggctgcacttattttgggacggagtaagtactccctccgtcccataataataagggattttgagtttttgtttgtaacgtttgaccactcgtcttattcaaatttttttgaaattattatttattttatttgtgacttactttattatctacagtactttaagcataacttttttttatatttgaaaaaaaaattaaataagaagagtggttaaacgttgtaatcaaaagctcaaaatttaagtgggactgatggagtagtatatgtaccagtacttgtctgatccaacaagcaaaaactctctgtgtactttgttcgatcgctttcctatgcaaaatgtcggtagcggagatagcgcccggctagcacgggcgcccgggctccaccctccaccacatttaacagctgcacacttaattaatgtcatacttaatctgttggttcgccggtcaaatcaggtgggcaaactagcgaagtaatccctccatcccatacctccatcctataatataggagatttttggtggacgtaacacatgctaatacaataaatttagacagacggttttaactaaatttattgtactaagatgcgtcacatccatcaaaaatctcctgtattataagacagagagagtatggtttaacatcatcacattgtgcagtctgcagcttatggaccaaagagaggcagtacacagccatattattgttccatcgcaataatttgtagcactggtccatcacaagttagcaactactcctcgctatttttcattttatattaggagtattaaatttgcccgcatctatattaaatcataactgctatgtgtaggtgtatggattaatgtcccgagttcgaaaatgccgacgatggcaatcaactaatgtctccgtccaaaataaatttatttttcacctatttcatgcatacaaatataaaataaaaaatagaatatcatactttatcaaatcgcaatgtaactactttttaatttatctactcctaatataattattctctacttttataaactccgatgcaataattactcaaaaataaacttactgtaagataaatgaaatgatctaaaaccaaacttattatgaagcatttttcacttatctcacacatatcaatacaaaataaaaaataacacagccatattttattaaatcctaatacaattatttctctttttatctattactaatatatttatcttatctcacatatatcaatacaaaataatgattactaaaattaagtttatgttggatacaagaagttattatgtaacagagggaggagtaactattaaggcttgtactctcttcatcccattttaaacgcagtcatgagttttttttccaactctaattatacgtattatttaaaattattttatggttagtattttttattgttattttataataaaacataaatagtactttgtgtcttatttatgtgttttaaatttttttaaataaaacgaacaacaaaaattagacatgaaaactcatgtgtgcgcttaaactgggactatactacctaagctcggtatcgtaaaaagctgcttagctcggctatatatatattggtgcgctgaaagcctaggttggttccggttcgcaagttaactcattacgagctttggcttattcatattacctttacgacttttagctagagttctgacattatacatttgccgatttatcatttgctagtcttaaacattattccttccatcctaaaatataaacattaaaaatcaaattcataactaaaatttactgtattttaaaatggatgtagtacactacaagacttagaacctagcctgtaggagcgaaacaagtaattaaaaacttacgagcagggttcactgtaccgtcggtaaccgcgcggttaccgtggggtacggtaatgtaaataccacggtaacctccttaaattcaaataaatttaaaaaataatttaaatttttgatgaattttgtacagtttttcacagttaccgtggtttaccgtgcggtaaccgtgcttacggccggggcgcggtaaccccagcctcagcggtttgggaaaccctgcttacgagtaaatacaaatacaatagcttacaaacaatcggagacttacgagtagtattgagtaagaagcataagcataaatagagatattggtcttgcatactaccaagcttaacacgccccactcccgtctcaaaatattacaagcaagctaaaactggacgagatacattctagtataataaatctagacagatttatttagattgtaacacataattaattaactattagctaaaaatgtttaaaaaatgaattgatatgatctttttctaaagattattttcccaaaaacatattgtttaatagttaaggatacgtgcatgcgaggaatgagagagtgcaggttgagaatcttgagttaagaagacagccaagggcaaatgaaatggtgaaactattctaaactctcgaggcgacatcccttcgttgtttacatgtcactcaaatgataagaaaaaaattgataagatagattaataacgatgtgttagatcactccacaaacatgcaaattaaattttaacttctacactttgtaaaaaagacatgtgtgactacgaataaacattaattagctgtagtttatttttctcattgcaacttataaaagttggattttaacttacatgtttctaaagtgatatagtatatgttaatacatcttctcaatttttacaatatttttataactattctacgtgtcatgcaaacaataaaaagacatcacctcgagagtttaaaatccactctcaaatgaaatgccattcaaaattgtctgatcggttgagcaacaaaataagctataaaaaaattaacaaagcaaaaaaagtaatttataggtaaataattattactagaattttaaaagtagtaggcataaaaatacaatcaccaaaattaaattataaagttctaaaaagaatcaaacccaagggatgaatattaacatacatgtgtggattcatcccaggttttgatttcttttttcacagagagagtataagccagcaaaaagacatgaaaaccgaatctctctaaagaaatctactcgacgtacgtgttgcagttcccacgctagttgcattgggaagacgaggaaaaccaagccatggcgtcggcgaggcacctccggaacgtgtccatgcgctccggcagcagagctatgcccacctcgatgccgccggcgccagaacgatcctccgccgccgacaccgcgccggtcttcgccacggacacgatctccaccttcgccggcctcccgaacccgaagtcgacgtcgtacacgcggaacctcgtcgacccggccaccgagaacggcgcgtcgtccctgcacgcctccacgatgcgctccttccacccctcccagtacgcgggctcgccgcgcaccgcctcgtcgatggcggcggccaccgccgcgcaggccgtgaagacgccgcccgccacggcggcgccggcgagctcctcctcgggcgccgagacgaagcccgggccgacgcagttgccgaggtacttgtcggggacgcggggcaccagccgcgaccggtggtcgacggagaagatgaagtgggcggcggcggcggcacggccgctgccgccgttgtcgctttcccgtctggagcggcggtagcagtgccacatgaggccgtacatcgccacgagggacgtgcaccgaggcggcggaacgccgcgacgtgcggcctcggcggcgacggcgtccttgacgccctggaggtgctctctggacagggtgaaggtggcgaggaacttgccggcgtcgggcgccttgaacagatctttggcttcgttcgtgggtgcggcgaactcgtcgtgcatctccggtacgtcgcggatgagcgtgcggtcgatgacgggcggctccgggagcttccggtcgccggcgcaggcggcggcccaggtgtggaggaagtgcgtcgagcccaccccgtcgcaggcggagtggtggacgatgacgccgagagcgaggccgcggcgcttgggcggcagcacggtcacctgcagcgcgagctccgcgccgccctcgggaagctccgggacgagcggcgcgatcttggcgagctccctcggctcgtccgtggcgagctcgtcgacgccgacgccgacgccgtcgtgctcggcgacggtgaacgccacgccgtcgccgggctggtagaggagctcgtaccggttggtctcgccgggcgtggggcggacgcggccggcgagcgggtagaaggcgtggatcgcccgtggcagcgactcctccatccgggacagcacggcgtcgacatcgtcgtcggggccgaggcggtagaagaagacgcgctcgacgggctgggcgcggagccacatcacgtccatgaagatgagaggcagggctcgcttgggcagcgcgggctggccggcgggcggcgccggcgcgacgcgcgtcgtgcggaggacgcggaggccagcggcgtgagcggccggtggcggcgccatggtctcgccgcagaacaggtgtggtttgtgttgctcgtggcttagctgcagagcgatggagctttgcttctactcctataatacaatacaatacttatatctctctcacttcacttgtccatatagtaattaatttctaaggttaattagatacatatatcattacaaatttaacggttttaaaatattttattactattcatctaattgaaacaaatatgccactaaatatctccctcacttcactagtccgtagccattaatttctaaggggtactttctttcttaaataaaacgttttgagttttaaatagatcatgtaagcttgatatatatatatatatatatatatatatatatatatatatataatttaaattatacgtatattagtgactctaaacgactgacggtggtggagaaactaaactatcatattattagaatggaggatgagagtaggttattctacctaatcatgtgggactaattgccaatttcccattggcatttgccgagatgaacagtgatgtcacggctgacgacgggtactacgaaatgcttgcaattttgaggctatgagccaacagtttttgggtgctagtttaagctgggatggagggtctgtttggcacaactccagctctaactccacctcttctgaagttggagttcagccaaacagtttcagctccacctaaaatgtgagcggagctgggtgaagctctctcacaaaatgaactagaaaggtggaggtgggtttagacagctccacaactgcactccagacctaacttttggagcaaaatttttaggagttggagctctaccaaacaggtccagagtgtatggtttggcgtcagattcgttggtgccataaaacatggaagtggattcagaggatctcgttagtgccttcacaatgtgctgagctgtcatttagcccgatctctccacgtcagaggttcaatacgaatctttaccatgttcatgagcgggcccaccaaattgaagcccgtgtgaccctttttgtcatccgttcttggcacggggagagaaggctgcaaacgcgttgggagggtgtggcttcattccgcttttcctacatgcactgttgaccttgtggctttcctaggttttggtggcgccttaggccaagcctatgcgtgacccccttaccctcccatctatagatgcaatcatgctcttagggatggcaatgatgatattagatttgctttgaggttcgtgcaagccctcaaccctaactccctctctttctttgtttcctcgtaatgccgctagttctctactctacccaatttccccgcctcctatgttgctacaacgccacccccaagccttctctcacacaatctaaatagaaccctatctgacattgatttatttttaaaccatactagaataattttgtttaagattttaccggaatcaataaaaccattactgacatgtgctattgttaataattagtacatccgtctcaaaatgaatctatcactactacaaaactcctaatatgtactagttttccaccttcaaaaaatagagaaaatataaaaccgatatctttgatcaactatatgtaccggttttaaataaaactagcacatataatattagtgcaactggcatctacacttgtattatctgtgccagctctaaataaaaaatcaacacatgaaaaaacgatctgagctaagagccgagctgaacccatccttatctactcaagtgacttgtacttatcctcgactctctctcgtgcttctctccctcttcctctccttctccagcatctcaccctctccttctccagcgtgcttctccagccattgtctactaccttcaacgacactggcgatgcagcggcagaggcggccgccctctgtccatggagagcagaggtggccagtcccgagctcgggacaaccagatccacgcgcggtagcctcttccttcctctcccctgcgtggcgcggtggcggccgcctcttcctctacctagtgcagtggcggtgaccccttcttgttctctgcacgtcacgacaacagttgcgatgattgtctcttcctctccctgccccagcacgatagacactggatccggccaacacgatggtgactgcaggttattcatggtggagagtaggaatctaattggattgccaatatttcagaatgaatttttgtgatttatgatgtttgatttgtgcggggatgttgttgttggatggatccatggtgatttgtcctatgtgatttggggatgttgtaggatggattgatggtggtatgtggatttctgatgtgtgatttgggtaatggggaggggctcgatgcatcggctcgttttgagccgatacatcgagctgtcttttcatttgtggagtttcaaaggtgtcagttcgtaaactgccacagttgattcctccatatcaatgcctcttgggctgcgtaggttgagaaatccaaacatctatgtgggcttcccaaccgacacctaacacatttatgtgtatttctcccttgccccatcatttcaactaattacaagcattctccatttaatttcttcacctacttactttttttcaattaatcaaaatttttataatcattttcacatatcctcttactataaagttagagcccactaaatcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23778 - DNA, 2069 bp, Oryza sativa
agcgaggatgagaaacacatcggggctgatgtagcggaccaatatgagagccttattgtgcaacgtgtcttgagtgcacaaatgggcaaagcggagcagaaccagcggcataacctttttcagacgaagtgtgtcgtccacaagcgttcctgctgcacaatcatcgatggggccagttgtaggaatttggtgagtacggagatggtcacgaagctagctttgcagatgaaaccacatccccacccatactacattcagtggttcaacaacagtggccgcattaaggtaacacaattggtgagattaaattttgcaattggttcttactgtgattttgttgattgtgatgtcgtacctatgcatgcttgctctttgctgttgggtaggccttggcaatatgataaagacacattgcatcatggtagaaccaatcaatactcctttatgcataatggaaagaaaattgtgttgcatcctttgactcctgaagctgtttttgagaataatgttgctagagctgagaaagagaaaaatgttgagcatgctaaaagtgaaaatcagattgtagcaaaagaacaagtgcaccataatttgaaaggttctcaatctaaccgtcgcaaggatagtgtgattaaattgaatggtccttgtttgcttaccactaaatctgatattgtcaatttggacacaagtgatattgtttgctatgctttcatttgcaaggatgctttgttttcttttgaaaatattcctctctcttttcctcctgcggtcactaaccttttgcaggagtatgaggatgtgttccccaaggacgtgccaccggggctgccaccggtgcgtggaattgagcatcaaaacgacttgatcccaggagcatcgttacccaaccgtgcgccataccaaaccaaccctgaggaaaccaaggagattcagcgtcaggttcaggacttgcttgacaaagggaacgtacgtgtctcttagtccatgtgctgttccggtgattttggttccaaagaaagatggatcatggcgtatgtgtgttgattgtagagctattaataacattaccattagatatcatcatcatattcctaggttagatgatatggtagatgaattgagtggctctactgttttctctaaagttgatttgcgtagtggttaccaccagattcgtatgaagttgggcgatgaatggaaaacaacatttaaaacaaaatttgggttatatgagtggttagtgatgccttttggtttaactaatgcaccaagcactttcatgaggttgatgaatgaggttttgcgtcctttcattggaaaatttgtggtggtatactttgatgatattctgatttatatatagcaaatatttggaggaacatcttgatcatttacgtgctgtttttaatgctttacgtgatgcacgtttgtttggtaatcttgagaagtgcaatttttgcaccgatcgagtctcgtttcttggatatattgtcactcaacaggggattgaggttgatcaagctaaggttgaggcaattcagagttggccgattcctaaaacgatctcacaggtgcggagctttctaggactcgcggggttttctcgccgttttgtgcgagatttcagcaccattgctgcaccattgaatgagcttacaaagaagggagtgcttttcacttggggcacatcacaagagaacgccttccgcatgttgaaagataagttaacacatgcacctctcctccaacttctagattttaataagacttttgaacttgaatgtgatgctagtgggactggattgggtggtgttttgctacaagaaggaaaacttgttgcatattttagtgaaaaattgagtgggcctgttctgaattactctacttatgataattaattgtatgctcttgtgcgcactttagaaacatggcagcattatttgtggcctaagaaatttgtcatacattctgctcatgagtctttgaagcacattcgtagtcaagaaaaactgaaccgcagacatggtaaatgggttgaatttattgaatcttttccttatattatt

SEQ ID NO: 23779 - DNA, 17303 bp, Oryza sativa
tgcatgatgatgattttaaagattgttgctgcattgtaaggatggaaagacatggaacaaattcttcttgaatgatgggtttgtttttagagctaacaagctatgcattccagctagctccgttcgcttgttgttgttgtaggaagcacatggaggtggtttgatggggcattttggtgccaagaagatggtggacatccttgctggtcatttcttttggccaaagatgagacgagatgtagatagattcgtttctcgctgcgctacatgtaaaaagtctaagtcacgtttaaacccacattgtttgtatatgcctctccctgttcctactgttccttgggaagatatttcaatggattttgtgttaggattgcctaggaccaagagggggcgtcatatcatttttgtggttgtgggtagattttctaaaatggcacatttcataccatgtcataaaactgatgatgcttctcatatcgctgatttgttctttctagaagttgttcgcttgcatggtgtgtcaaatacaattgtttctgatcgtgacactaaatttcttagccatttttggagaactttgtgggctaaattggggactaagcttttgttttctactatttgtcatccccaaactgatggacaaactgaagtggtgaatagaaccttgtctactatggttagggctgttttgaagaaaaatatcaagatgtgggaagaatgcttgcctcatattgaatttgcttataatcgttccttgcattctactacaaagatgtgcccatttcagattgtgtatggtttgttgcctcgtgctcccattgatttgatgcctttgccatcttctgaaaaaatgaattttgatgctaagcttttgttttctactacttgtcatccccaaactgatggacaaactgaactggtgaatagaaccttgtctactatggttagggctgtttcgaagaaaaatatcaagatgtgggaagaatgcttgcctcatattgaatttgcttataatcgttccttgcattctactacaaagatgtgcccatttcagattgtgtatggtttgttgcctcgtgctcccattgatttgatgcctttgccatcttctgaaaaaatgaattttgatgctaagcaacatgctgagttgatgttaaaactgcatgagacaactaaagaaaacatcgagcgcatgaatgctaagtataagtttgctggtgacaaaggtagaagggaattgaattttgaacctggagatttggtttggttgcatttgcgaaaagaacggtttcctgacttgagaaaatcaaaattgacgcctagagctgatggtcgatttaaagtgttagccaaaattaatgagaatgcatataagcttgatttgcttgcagattatggggttagtctcacaattaacgttgcagatttgaagccatatttgggcgcagaagatgaacttgagtcgaggacgattcaaatgcaagaaagggaggatgatgaggacatcaacaccaacggtacatccacgcttccacaagtacaacttcatggtcctattacccgcgatcatgcacgtcaactcaactatcaggaacaatggagattatcaaatggggagaggaatcgcacgggatggattcggactgcagcacagcacaaacttctgacggccgccacgacctcatgcgaactccgatttgggcgtgcaagtacttcatggaaagcttgtcaagtctactttcaaatggatccagcctcatttccatatcagttctggggcggccgcaatcttcattttactaccgagtccttttctgtccacggtgttgcatcacctctttgggcccaatgggcggtgtatcaagttgggtccattagggacgcgtcctagggtgagagaacgaccccagcactcctgtggtcgtcctcttcctcttcttatagctttctccaccgccaagaataatcgggttttgtttagatcaaagtatagcgtcactactttgccgagttgatcccgtgatcgattagatcgctagattgcttgttattgaaccccacttgttacttctattgattcaatccaacatctttgatttgcaaatttatttgcttgttcatcttgttcttgctggttctcgattgcttgcaggaacaaataccctcgtgcttgggctgatcgtgcatccgtcgagattcacgactgcctctagagttcgtgtaacgattgttaaggcgcagcatccctggatagttgtagtcggatcgccaatgtcactccgtccaatcgacttatccctctcatcgaaagatcgggacatcctcgagcacatcactatgcaaaccgtgctgctgtcaatacctaggacaaatgctctacgacattcctctcaaaattcttcccgatgggcaaaaaccaatgcccttcgtggaaggattttaagtttccagcagacaagggatgagtctattccggaagcatgggaacgactgcaggagtacgtagccgcctgtcctcatcatgggatggatgactagctgataatgcagaacttttataatagactcaccccgatgtcccacgatcacctggacgcggaagctggaggagctttcttctctaaaacggttcaaggagctgttgatctaatagagaagatggtctccaatatgggttggagcgaggaacgacaccagacccgtcagcgaggcatgcacaccgtcaaggagacggagttacttgctgccaagctggacctcctcatgaagcgattggacgaccacgagaaatggccacaaggtaccatcaaggccttggactctcacgtcacatgtgaggtctgtggcggcacgggtcattctgggaatgactgcccggaaacccgtgaggaggcgatatacatgggcaacaacaacaacgggtatcgtccacaaggaggtcatgggtggaaccaaccacgcccatattatcaaggaggtaacaacaacggtaatttttctaaccagccctccttgagggatctcatttttgcacaagctaaaaccaccgatgcactaagcagaaaacttgcggccaatgacaaggtcctagaaaacataaatgtcaagttagatggctttgcttctgcttttcaaaatcagctgagctttaataaaatgatagaaacccagctagctcagttggcatccttagtccctgcaaatgaaactgggaggatcccggggcaaccctactcctccattgaaaatgtcaaggcggtcatgacgaggggaggtaagtccactcgtgatccgccatatcctaaccatgcaggaactaatgggatatcaaaagaagtgccatctaatgattcggctgacaaggaagttccgctagaaaagacagtgccgcaagagtactgcgacacacggttgctgttgttccctcaacgaagtaggaaaccgtcagtggacgagcaattcgctcgttttgttgaagtaatccagaagatccacatcaacgtgccgttgttggacgccatgcaagtgccaacatacgcccattatctcaataatatactcaacaacaagagaccgctcccaacaatggaggtggtcaagccgacggaacaatgcagcaacgtaatactccacaagctcccgggaaagtatgatccacagtcagactatccgaaaatatcagatagtctaatgttggatcagactgtctgatccactaaagagtcaccacaagtagatctatcacacaaacaagagtatagcgcaaacagtgactagatctatagcggcacaattaagcaaagctaaagagaggatatagagagatcaccaacgatgaagttcgcggagttgttccaggagttcaaatccttgaggggattctactctccgttgaggagttcactaagagccaggtctttgctaaccctttcctaaagaggttgtactaagcactcctccttccactaaggggtatctctttccttgtggaggcaagatccggccttcgcaaacttctccctgccaaccacacgtagatcggtggctcgggagtgacacctagccgtctaggagtcctcgacctcgaagagtaacaaacaccacacaactcttggtcaaaccctagtgctcaagatcgagtgaaacacacactaggtcctcaaacaccaaatccacaaccaacaagatccaccacacaaagaacgaggaggtatttgaaagagggagaaagagctcaaagatccaaagcaccttagcaccaaactcaacccaaagtgaatgagaatgaatgagttgggtaaccctagaaaaggtgggggtatttataaatcccccaaaaagtggccgttaggagagactcttttcatcccacctcggactttccgaggtgacatcggatagtctaatgttttttttgacccccaagcaagcccgagacagaggacaaaattctggagaatttcggacaatccgatcaatcggagagtccgatgtcatatcagatattccgttatttttgaagcaagaatttcatcatcttacagagactcaagttccattgaatttcggagtctctaggtcattggatagtccaattctttttagccaacacttagaccaaagacagagatcaaagttctatgaaatttcggatagtctgagcatcggatagtctgatcaaaatcggatagtccaacaggataaattcaagaacacttcaagtaaaggattttgagcactagtgttctaccaattatatgcatgtggtatccctcttaatagtacggcatcctaatactctcaagaacacaagatatacatggtttagaaagacgattaccacaaaagatgccacaatgcttttaaactcaagttccactccttttttatccttgcattcatctcaacaaaaagcattagttttcttctaattgtgttgtcatcaacaccaaaataaatgaggggtactagatgcactttcaatctctccctttttgattattgatgacaacacaattagaaataataaaagattaggattttggtggagctcccctaaagatatgcttgaaatgaataggagagctccccctcaatctatgcaatagattagaaatgacaatataacctcatgcatatgcaaatgacaagatatatcacacatttaagcatggataagatataattccacgtaacatcattcaagcctatagagttcaacaagacataaacatgcataataaagaatttaaacatgacacaaaagcccaaggttcgactagccatcacgaaaggggatagttttttttttttgataggtggttctccccctttggcatcaaggcaccaaaaaggaaaaacagagtggatcactcatcctcatcaaaatcctcgtcctcctcacttgactcctcaaaagcaaaaaaacggaaaactctctctccgcgcgcgacacatgtagccttctcgccattttgctgctgtctcgtcagggtgtcgttttcttctcaacttgtgactagctttagtaatgctgacggtgacaaactaaaaccaggtaattgtccgactcacatataattaaaattgagcaacggctgcaatacatatgaacatgttcttttttattggtctatgattatatatctctagttgtatatcttaacttcttaaaaaatcggtaattttgcattcgtcacctaaatttttcatccgttttcatccgtcggcgcttgcacgcggagtcaccttcagttatccaaaagagaacggacgggaaatttcaattcgaatcacatactggattcatggagcattaagccaccggtgggagcagcgcgggtccgtccggcccttcgctaggaagcggcatcaccgccgtcgtcgcctgttgccgtcaccgcaccataccccgccatcaaggccgacagggagaaggagagggggagggacgtccattgctgccctcgctgcaccgtacccccgccgtcgccgcaccgcgtcgtactcttgtcgtcatcgcgctgtgctggcaacacgggaggagaagagatggggagctgcgccgccgttagggagaggacaggagaggcgaagaggcgccgccggtgggaggaggcggaggggaagcagcggagagggagcagcagaggggaagaggcggcgcaacagggagaggcagccgacggtgggggaagtgggagagggaaaatgaattagggttaggttttttttgtaccggtggttttgattgatttggaaccaatctaagccatccatcaaaaacaaacggctcagatcgatcccacgtcaggccagcatcagctgggccatgcacgcttgatggaccgcgcgcgggctagcgggtctaacacaacgcttaggctagaattttgcttggggcccacacgacagtgagaggaggagttgggatgactaattagacttgtacgttgggctggacgcttgcttgcggaccgaggtggaggggaggagaagagaggaaagcatgccgctcggttgcgggctgaagaagaaaatgggcggaaaatgacccgaagagaaatgtggacttttatttagatttatttaaataaagatgatgtttgtattatcaaaattagcaattaagttctagaaattccaagaaattttcaaagactattattaatcatggttaattttctcacgcttactttgcttgtaaattaatttaattatactactacgtacttaaaaaatacccaaatattccggaaaattggtatttcaattaattacacaatgtacattatctttctcaacttttcctcaattttttctttttttttaccattgcaatacacggacacttttctagtaagttatacagctgaatcgtacgtataacagtactcctaaaatctccaaatactagtagtgatcatgggttcatagctaagctaccctttcacctccatactctcagtctcagaatattcttaatttttattcatcctaattatatcaacacaaaattaaaaaaaactaaaataccccttatttgttaaatccaaatacaattattctttactttatctagtttcaatatatttattttctgtttttataaactttgatgtaatgataattcaaaagttaattcttttttaggacaaaggataaacgatgattttattctaagacggagaagcattcaacaactcccccttgaactcgtgtggactagtatgtttttcaccgtatcatgattaagtgatcaaggacggctcggtcatgactcatcgaaagagagaaaacaaggagtgaaaggtatgtgtgaatactaatgttctttaggagatttccttcttccagaattaatacctcagttcaaaaacaaatttattttttccctattttatcaaattttattacaactatttgtttattttatcttctcacaatataattatttatattcttataaactccgatgtaatgattatttaataatgagcttattttgaaataaataaaataaaaataaacttattacgatacggaggaagtactgatgttcttttcaccgaacggtgagatttcactattcacatatcatgacgggaaaagggaccgcattaattatcgacaattctaggtgatctgacgtcatcagtcatccagaggtattcccgcacgaaaaaacaagttagagtaaatttaataaaactatatggcctctttaaatcgcagtgttgaaaaaacagaggaataggaaaaacacatgattctgacaggaattaaagtgtaaaacagagtattgcaaaacatagaaaaaacacaggaatggtcgtttgattagagcgcaggaaaaacgtaggaatcggatgagagagatagagtaaaggaaattttccaagaggttggagctcttgctaaattttctccaaaatccacatgcaatgtgtcattccataggaatttcataggatttggaaagcttcaatcctttgaatcaaagggccaaatagaaaaatttcctataggatttgaatcctataaaattgctacataaatcctttgattcaaaggggccctaagtaatttggtcagattataaaaaaatatacatatttaataagatatatcacaaaactatagatttgaagataaataaaaggaaccgtttataaagacaaataaatggagctaaaaacaaatttattacggaatattttttttcatttaactcacacatatcaatacaaaataaaaataataacattgccattctttatcaaatccatacgtaacactaatgttaccttttagaaacatgatagtccaaggacaccagccatatttttattttttcacataataatcatcatgcactttaacaataatcattatgtgtaaaaaagaggtcttctcattctaaacctgcacaataattagaaataagaattaatatgtgcatcaccaattcaaatcaagattgaaaaaataatactattcactaatacatgcgtctaaaataaacaggaagttataggttcttcagaaaaatgatcatcgtatagtctccaatgaccagccaatcatacccaattaatcacctcatgtccaaatacagacaggggcagagctagagcgagatgaggggagtgccacttgtttaatttactctgctttatatcaagtttaaactaatacaagtgtctaaatatgtattgaggggtgcatatatagtgaaaataagttaggtatagctccaaaaaaaatttttgaccgggttcctgggcacccccctcaatacactagctccgcccctgaatacagacccaccttgcattggttctttcatgttctgatcgtacactatttgaaccgtctcaaaaataaattcattgttgtcatccaacaaagactcatcatccagtagcatttggagggagttgcatcgacgactcatctctttgtcttttaacacgacgaggacatgtaaggagaggtgggacagcaacaatgggagatagaggggagggggaaaggagagctgacaggggatggtgggggagaatggcgtcggggaggcagatcagcatcgatcagggagtgcgtgggagaaaaatcgtcgtcagggcatggagcgagggagatcgatgcagcattggggcaaggaggagtgcctggaggatagcgtgatcctcttcagtatggtaatagaggaaaactagatagaagggttcacttttactttttggaattcaaagagatgaattttttcactttctattttcaatttaggaaacaaaaacaaaattttgggtgggttattcacattatgttggtgatgctcttaggaagaatgtgtagtacttgctgcctcagctggcataattttattatgtcccattaattcaaataagagtgacaccgttgcttaaattgatacgtttatacctgattttgtaatctaatatgatgggatttggtgagatgaagatgacaataatgtattatagcttttgtcctgaaatttatatacgtacccccccccttccaagatgtgtccatttttcacgtttaaaactttgtcacaagatattatatctatttataaagtattatatccaccaataaccacctttcattttaattttcatccaatcttgtcttaaccaccttatcttcaaccattctcattgaatgagaaattaattaatccatataatattttttgtccaccccctctaaaacaaagagaggtcagaagagaatgggcagtagttaatccatataaactgtgcacagcacactagacagtaactgcagatggatactatcgatctcttaaccagtacaaacacagatgatgttaatctcaacctatctgacaggggatagggtagattgtcatgctccactgatgttaacattgacctttacagttatagatactcctgtaaatatatactgtatatatatttggagacaaatcttcggccgagtttagttctaaatttttttaaaaaatttctaactttttcattacatcaaaactttcctatatacaaattttcaaattttctatcgcatcgttttagttttaaccaaacttctaattttaacctgaactaaacacacccttcctatcttttcatatgtgaacgcctgtatttgcccgcatccagagtccccctttgctgctgtctcgtcagggtgccgttttctggagtactcatctgtgactagctttttttcatctgtaaacgcctgtatttgccctcatccagtcaagtcccatttcgctgctgtctcgtcagggtgccgcatccagttaagtcccattttgctgtcatcttcgactagctttagtaatgctgacggtgacaaactaataccagagaatcgtgcaactcacaaattgatctaactgttacaatacatataaacatattatctatggttatacgaacaattcagttgttcccccctatagccaaatcaaacggggtctcatcttaacaactcatcggaaataagcgtacttaatttcatacctctctttaatcacaaattaccttgtactggctccttccatcaccttgacaaaacttattagataccctcttcatctcagaatataattatttcaagtgtttaattttttttcaaactgtaactcattctccaattactcgccatatttgattcgatcgtaactgtcttatttaatttttttcacctaattcttcatcttaaccaattacaatcatcccacgttataattttacccttcattctataaacttcatagagaaaactttcttaaattctttacaggtgctcttctcttcttttctttatatgtgcttacacataatttgtagcatgctattatactcgttctgatgaggtggaccgacctgttgatgaggaggagtggaggacagagcccagtgatgacacaagagttagccattttaattatttattttccttccggtggggagccaaccgattaccgatccaaatcaggtccccggtcatgatcatctacaactactagagcaggtgtttgcgtcttgattaatatcgctattattatatcagtttcgtccttatagcttatcatatactccctctatccaagaatataaaaagttttaagattggacacggttattagaaaatagatagaagtagtggagggttgtaattagatgagcagtggaagaatgtgggaaaagttaacggtggagggttgtgattagttgggaagagaatattggtggagaagttgttatattttgagataaatcataagtgataaaagttgttatattttgggacggagagagtatcaatatatataataagggcatcctcaatatttatggtgtagtgtaattttaaggtgggccctatgaatagtgagtcattgttatagccatatccacaatgctatggttagaatttagccacaagatggcccacatagaatggaaaaataattgtttcatctcttgttcataaagtgaatgagagagaaaaaatattttctttttgcttgtggtagaacttaagcataaggtgcactctaagctaatgctattttccacaatgtatatagctcactttacaagtgcaatcattatcttaaggttatctttttcatacataataccattataataaaagatgtgaacccgaggactctttaccctcgcttctcatgcctccgctttcgcattcattacacactagcctattaaatcaggcattcgcgtgactatgacctgttttttatttggatatatacttgtttgtttaaggacagatgacgttttgtgtttatctgaccataattgttgtctagaattttctcttttatcctttcttaatttttttttgaatggccttctggtaccaaggtccattcggcctcatttgccagcatagaccctttggaggatccaatataaaatatttatgagcaaaaatagtttctttaaacatgaaaatagaaaaaaaaaggatatagcccttataatttaatcctattttgtacttatctatatttgctcttagcgctatttatttccaaatattttaatttagcgtatagaatagtagtactatattagcttctaattaatttattattaaggatcgaataactgattcgtatgtgtttggagatcatttgaattggaattgtcttatacattcgtgtaagaagtgctctcattttgaatggttgcacgtggagaagcattaaaaggtacggagtagtagtaattgttggtttcagaaggggaaaaaaaaagaaagagcacctttgtcggttaggagtatgatctaactcaactgaaaacttccatgccatttgtcacaaatttgctaggcttaattagatcaacagagaggttgttttaaatacttttatttacaggagatataggataaagaatattcatatgtgctgaaatgcaaaagtggcatgggcatcaccttttttccacactggtggagaaaccatctttcgtcggtcggcctaattccacaatagtctcggttgcaacaaaaaccgatctttagtcccggttaaaaagggtaacgggcatatatatatatatatatatatcttcttcctcctccagcccgagcaagctttaaaatttcttcaaaaaagaggggaggtcatgccaaaatttctagtaaatttattttggtgattatatacaaatcggaggtgcctaaaaggttagcaacttcatcctccaatgttttttttgtcatattacatttggagctatgtttagcacacttttttgtctccaaaattttgttgtaagttgatgagagagaaaatttctgtggggaataaaaaatatatagaaatttagtttatttgctaaagaaggttttataaaatagttgagaaggaaaatatagcaaaagttaatcttgaataatagaaaacaaactaaaatgaaaattaaaaggagtacaacacattaatattattttaaaactttagaaatagtaaataagaattatttggtgtaatatttcataatttttgtatgaataatgatatgtcattattgtgtgactgttgaaagagtttgtaattattttataattattgtatgagtgtcattattgtacgaataattatttgtgtacgattttttttcatgtcatgtagatggatcggaaatggatgtacgctgaccggcggtccaaagagtttattgatggcgtgcattattttttgaaagtggccgaagctaacaggcaaaagggtttaatttgttgtctatgcaataagtgtaagaatcagaaaaagtattctgcatccaggactattcatttccacttgtttgagtcggggttcatgccaagctataattgttggacatcccacggagagcaaggtgttgaaatggaagaagatgaagtggaagacgacaatatttcggactttgctcagtacgctggatttgaaataaatcaaacgggcgaggaggaaagggatgctgatggtaacgacgttgcggatgatcttggtcagatgttgcaggacgtcaaggaggactgcgaaagtgaaaagggggcctataaattggacaagatgttagaggaccacagaacgtcattgtacccaggttgcgagcaggggcacaaaaagttggatatcactctggagttcttgcaatggaggacaaaaaatggtgttagcgagaaggcatttggcgatttattgaaactcgtcaagaacattcttccggagagaaacaaattgcccgagacaacgtacgaggctaagaagatagtctgccctctaggactggaagttcagaagattcacgcatgtccgaatgattgtatcctatatcgcggtgaggagtacgagaacctagaagcatgccctgtttgcaaagcactacgatacaagattagacgagatgatccaggagaagttgacgggcagctaacgaagaagagaattcctgctaaggtgatgtggtatttccctataatactacggctaaggcgtttgttcaggaacaaggggaatgctagaatgatgagatggcacgctgaagagcgttaacaggacgggatgctgagacaccccgccgatggttcgcagtggcgaaatatcgacagaaaatttaaagactttggaaaggacgcacgaaacatacggtttggtttaagtacggatggcatgaatccttttggagagatgagcagcggccatagcacttggcccgttacgatgtgtatctacaacctccccccttggctatgcatgaagaggaagtacataatgatgccgattattattcaaggccccaagcaacctggtaacgacatcgatgtgtacctaagaccactggtcaaagatcttaaactgttgtggaagaaggaaggtgtccccgtgtgggacgaggacaaacaagaggagtttaacctacgagcgctgctgttcgtaaccatcaacgattggcctgcacttagcaacctatccgggcagtccaacaagaggtacaaggcttgcactcgctgtatggatgaaacagaaagtacgtatcttaagcactataggaagattgtgtacatgggtcatcgtcgattccttgcagcaaaccacccggtacggaagaaaggcaagcactttgaacataaggcggaccaccgtacgaagcctaaacatcgcagcgggaaaacagtgtttgctatggttaaagatcttaaagtagtgtttggaaaggggcctggtaaccagcctatagagagcgaagatggtcacgcggcgatgtgcaaaaagaactctatattttgggagttaccctattgggaattcttggacgtccgccacgtaatcgacgtgatgcacctcactaagtacctttgcgtaaaccttcttggcttcctaggtgtatatggaaagtcgaaagatacactggaagcacgtaaggatctgaagcatatggaacaacgcggtgaccttcacccggaaccaaaggagaaaggaagccattacttgagtccagccagctacactcttagcaaggcagagaaggaaagtatgtttgaatgcttggagagcatcaaggtaccgtctggatactccatgaatataaagcgaataataagcacgaaggagaagaagttcacaaatctaaagtctcatgactgtcacgtgttaatgacacagctgctaccagttgtaataggggtatcctcccagacaatgtccgggcaacaataacaaagctatgtgctttcatgaacgcaatttcgcagaaggtcatcgatccgaatagattagaagccctgcagaatgatgtggtgcaatgtcttgtcagctttgagttgatatttccaccttcatttttcaatataatgacgcatctgctttgtcaccttgtcaaagagatcggtattctcagtcctgtgtacctacacaacatgtttcctttcgagaggtacatgggcgttctgaagaagtatgttcgtaaccgtgctcgtccagaggcaagcatcgccaaggggtatggaacagaggaagtcattgaattctgcgtaaaatttatcgaagacctttgcccaatcggggtacctgaatcacgccatgaagggagactacggggaaagggaactctcggaaggaaagcaataatgacggtagacaacaatttattccgtaaagcccatttcacggttctgcaacaatctgcattggtggctccctacatcgaggagcacttggctctagttcgcgccagaaacattggtaagtccgatgcatggattacacggtatcacattgatactttctccgcgtggctgcgacaacatctcatgagtaacgagacgattaaccaacaactggccttcttggcgaggggaccatctggctcgatcgcgacattccagggatatgaaatcaatgggtacacattctacacgagggcccaagacatgaagagcacgaaccagaacagtgatgttcgtatcgatgccataggtcacgatggtacaactggcacgtattacggtgccatcgaggacatatgggaacttgactatggacctctcaaggtccctctgttccggtgccaatgggttaggttgactggtggaggcgtaacgattgatgacagtgggatgacaacggttgaccttaacaaggttggatacttggacgaaccttttatccttgccaatgatgtaacgcaagttttttacgtcaaggacatgtctagcaaaggaaaaaagggcaaagggcctgacgagccgaagcgccaagtggttctcccagcaaaaagaaaaatcgtcggagtagaggacaagactgatgaggattacgatcagtttgatgggcaaccccctttcacggtgacgattgaccctagcatcctcctatcaaatgaagacaccccttactcacgtagcgatcacaaggaaggaacaatagtgaggagaaagtacgtgcggtcaaccgtcaccgccgatgtattgccgtaattgttgtgtacacgatgtaaactattttggatgtattgaatatccatacaaataaattgttgtatggaatatgctaattatgtatgattattagaatttttatcaaattgaaatcgtccatatgctagttatatatgattattagaatttttaaaagttttaaatcatgcacgtggtatttacatatgttaattagaattttcaacaatttattatcatgatatgctaattatatattattattagattttttattaattttaaatcatgcatgtggtatttacatatgttaattagaattttcaacaatttaatatcatgatatgctaattatatatgattattagaatttttattaattttaaatcatgcatgtgctatttacacatgttaattagaatttttaacaatttaatatcatgcatatgctaattatatatgattattagaatttttaacaattttaaatcattcatgtgcttattatatattatccacttattctactacatacaacaataatttttcgaaggttttgtcattaattgttcgactttaaataattttaaataattgtaatgcattatttactattttagaaatacatatgtaatgaagttcaagacacagctgctattatctttagtcccggttcttaaccctaaccgggtttaaaaagaatttggaaatagcgggaaaagatctttagtcccggttggtgagaacatccgggagtaaagatatctttactcccggttcgtacgaacaac

SEQ ID NO: 23780 - DNA, 4829 bp, Oryza sativa
ttattagggtgatctaaattagaagataataataggtggttgcccctcatactttggaatggagggagtactacttctctctttcatgaaagttctgtttttcctaactattattttccgtgattgatccaaataaaatcacctaaatattttcacaatttaagaccattgtaaaatttgatttttcttgtttacaataagatatcttatttcaataaaaaatcataattatttgtaattatataaatggctaaaaaaactcttcccacaccttcgcatgtgtcacgcccagaaattcccgaatagaattccaagcagaatgtgcattaaaatccccgtccaggaccagccggcgtacacaaacgacaatgttgacattcagatccacgtcttacaaacatcataaaagtcttacaaaaatgcagcggaaaacaaaaggtaactggagctaagccttgactaaactgcagcgggaacaccactccacaggcatcctcgacagcacggacaaagcctactcctcggagaaaccttcatctgacccgaactcgaactctggggttgggaaaagtagagcaagactgagtactacccactgtactcagcaagtcataccggaataggggtatgatgcagggaattaacaaagaagagctagagtggttcatttgcataaaacgagcatttataaacagaaattgaatgcgaaaacagttgtaaattaattaatattaaacatccgctgtccaacgctagcccacgttgcgacaggcccaaccatccacctaaactatccaaattcaaaagattacactagggtgagactaatcacggtgaatctggttgaccgcccataaccgcgggcactgctattcgaatagttttactctgatcagaggtgtacaactgtacccacaagacacagccccacgacacgtttccgtgcgccgacatgccaccacgacatcccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttaattaaccaacaccaaagcggtgtcactaatccaacattatcataaaaacctatagtctaggttttaaatgagatctccccattgtgtgctagttgaactaagcatggctaagcaaaccctagtcctaactctaatcatgttataacccaagctaacaaaggagcatggtatcaaaatagcatggctgtaacaataggtaaccatcccatagtattattgcaaaacaaatgcggtatttgaaagaaaacattaggacatttgcaatataggatcaatatgatcaagtgacaagcatgacttgccttgctctgctgctggaggtacctcggcgactatctcaaagtacaccggagcgtcggaggaatcggaatctagcgacatacaaagcaaacattgcaaacaggctataagactactgaaacagggaacaaaaccatttttaatggattctacacatttttcttgatttactgagacttgaatgggattaaacggagctcggatgaattagatatgaattttagaagattctctgtgtttattactataacaaaaatccttaaataatttattgcgcaatattaaccagggctgacgtcagcacggggcgcggcgccgacatgcggggcccaccggtcagcgactcgggagagggaggaaggggcgccggcacgcgggcccactggtcagcggcgcgggagagaaagggcggcggcaccggctcggcttggctcacggccggccgaccgaccgcggcgacggcgacggcgcacgcgcgaacgggttgccggcgacggcaaccggcggcgaaggcgacggcgcaaaggcgatgcggaggcggctgcgctaacggcggctaggaaggggagggaacgggcggcgatagaggcggccgccggctcggctcggcatcaaaaccgaccggccggctaggtctagcggcgacggcacgcggccgacgacggcggcaaccggcggcacgggaggcggcggcggcagtcgaaggtgacggcgcgcgacactaagaggagaggaaggggaaaaagaagggaggggtgcctcaccgagggtggccggcgcggaggaagacgatggcgaacggcgacggcaagccacgggaggacgacgtcggcgagcggacgagcttcggggtgccctaaggaaggagaagagagggattagagagaggatgataaaccacggcgaccggaaaccatggccgaacgcggcggtggaggtgatgctcacccgtgcgcgagggggtgagggctccggcgacgaacctcgacggaggagaggtggacggggtggatctcggccacgcgaatccgacggcggcgacggcgcggcctggcggcgagcctagcggcggctagcggcggccggagcagcgaaaatggcggcggcaaagggttgcacggcgcgggagcgatgggaggctcgagagagtgcggcgaaatggggaaaaagcgagagggagcgacggcgatgcttaaatagggggagagggaaccggacgtggccgggagaggcgggaatcgccggccgacgtgagggagtggggaagagagagaggcggattcgattttcgaatcccggccatctcgggcgcgggcgcgagcgggagagagaggggagtgggcgcgggagacgcggcgcacgcgcgggcgtggtcgacgtggcccgggggaggcggaggcgagggcgcggcggcggttgcggcgcggcggcgcgagcgagatcggcgggaggtgggagacgggcccgacaggtgggccccacctgtcggcgacccggagaggagggcggcgggcggcctggctgggcctcggcctgcggccggcccagtaagggggagggggaaggaaggagggaatgggccggcggcccattcggaaaaaggaggaaaaagggagggaaaagaaaaaagaaaaaaaggaaaaaggattttccctggaattaaaacattgcttgctcaattttaattggttaaaattatttctagagctctgaaaattccactaaaaatccctgttaatgagtttcgacatgtagaactcaagaaaaattccacatgtcaaatccgattattatttgcattactttcttagggttttctcctgatttcacctgcattttcttagggtcatttatcaaaattacaattttggcttgggaggaaaacttcggggtgtgacagcatgccactaataaaaaaaatattttcgcagacggtcaaaatggctctatatggaggcagccaaacacactgcctgcaactaaactttgcaaaatacaatattttttaagcggatatgctcgtacatttacgtgcttttaatcatttgttattcaatatccttgattcatagtttcatatatagtcacccaattataatataatccatatgagttgcaatgtaattacctcacaattacattataatctatctattatatactaaaagtccattaaatttcctataagcgctcctaagccaccacgtgtcctcctacaaacgctccaaagataccaagtggcattctaaaagtctaaccgttgattttcctttaaattggtgggtccaatattttcaaccattagatcaaataaaaaaataaaatcctcctctccacaccggtccccacctcctctacgttcccctcctcctcctcctccagttggtacgtaacgtacgtactccctctctccccacatatcctcttccctttcctaatcttcaatctatctattatctattatctatctattatctactaaaagtccattaaacttccaataaatgttcctaagccgccacatagcacctctaaaaacactcctaagttattatgtggcgctttaaaaaattttagaatgcagtggacctatatttataactattagatctattataaaaaatacaattaaatttacctcaaaaactcacattgtatgtgcacgtataggtataaaaaaacaagtacgtccatactttgatacgtacgtacaacgttgggcccacatcattctttttttttctttctcacttattagatggaaaaccaatccgcctatatttatcgtctcactttcccaaaaaaaaacttaattacatacgtcatatactatggacaaaacaataaatcacaaaaatatatcaatatattaatagtaaaatcagaaagaaatactaataagaaaaatcataaacgccagcacttattgttgtcaatagtctttaaactacgattttattaaaaataataccacacagaaataagtaggaggcaaaaattataattattttcatcacctcctcttttttccatccctgtccttcaatgcagggtgtagtgtttactatgccattgtaaatatcacaggcatatgcatatggttgagttaagatggtgtcagtaaaagaccaatgtagacaatgtatctaaagtgacattcttactaatgcaatcctttgtgggtgtgcctatagtgaactaagtgttaaaatg

SEQ ID NO: 23781 - DNA, 2046 bp, Oryza sativa
ctatttttaacggtgctatcgtattatccggtagaagtggtatgtttagactatttatacatagatgtggaaataagtcatgggcatcgagttaagcagtgttgatgattttttaataatatacaatgcagtttcatttattaaaaatgcacatagcttttaaaactataacaataggggagtttatatatgaccacgacaaaatgatttttatttaaatatgagagatattcttattcttatatttagtagtatattaaaatataccatctattttacagcaaatatatttcttttttattggaagataatttacattcccttacagtgtatataatgatatatgatttattttactattctttttctagaacaacaaataagtgtcagtgcatctatgcggcctttatttccagtttatattttaaaaatattttctaatttatatttcacccttatagtgtttgaaatacaacctacgatacatgtccgcgcgaatgcgcgggctaccttcctggttacatttagaagtgtttcacctaaaatacttgcaaagtttcttagatagtcccttttcttgtttgatcataaaagaagacaaaaagctgactaactgtttttttgaaaaaacaaaatcgtgttagttgtgctgcttgtgcaacgtatgtttagtcgaatgatgtattaaaacgagtcgaatctttaattggagaaaatgaaaccaaattcggctttatgcacagatgttccatcagcacgtgtatatgatgggttattatatattcataatatattttttcttgacagggatacattcgtatcattatctaaaaaaaaggatacattcgtatactcaatctcgattgtcagtcgccgtgtcattgatgttgccttttcccgtacacgtgttgttgataactaaattagctacggttacaggtacacttttaacatttatattaattaatttgccatttagaatgaaataagtttcatacatatatgtgagtaattcatttggacccagataaaaaaaaaacaagatcagaaaaattgtaccaccgtatctgacataaaacgataagttcatactcccttttctgttctaaaataaatttatttttcacatattccatacataccaacactaaaaagactagaatacctccattttattaaaatctcaatgcagatatttcccattttatctattttcaacgtacttattccctattttttacaaactccaataataattccttaaaaataaagttattttgggatgaccaaaaggcaccaaaaatcaccttattatgcgacatagggagtatcacacaaatactatccggcacattatccatctaagatatttatccgatatgcatattaattatccggactgtttggaaccacatctcctatttttgcacatgtatccagggtacaattccctgtatacatctagccagatacgtacggtgtcgaatcaattgaaaattacttttaacatttccaaccagtctatactgtctgaaaatgataaagacagatgaatcaactggggccagacacatacataggatcaataaacatatagtataatttagcttttctgcaagatatcacttaactggaaatgttatcccatataaagttgtcgcggttctttttcctgttttgacacatatctgccactttaatggagatatctgtcccgcactaactctctactggtctttgtaaaactccctaactgaatttgtttaatttcaaacattagaatcaattggtgattgtgtatcataaccgcattaaactaataggcatccttaatctttaggtaggtcatcctggtttccacctcggcaactaggttagtgccatgacagcttctagctagtagcacgtatgtgaaaaacattgcatgttttgcaatccaaatatgtaatataatattcatccgactcctatgcatgttcagggtttacacttttgttttccaacaaattctcggaaattcagtggctcctgaaattctgggaattt

SEQ ID NO: 23782 - DNA, 11548 bp, Oryza sativa
ctgcagcccttacacaatgtaagtcattttagcatttctcacattcatatcagtctagattcatcagcatcaatatgaatgtgggaaatgctaaaatgacttacattgtgaaacggatggaatagtatagttatgtagttagagaaatcacaagagataaatactactgaagttgaaatctgaaaaaatgataaagctattgtatattctctgaaacttgtctattttgtttgtctaccgaaagaactccgaattcttcttaagaaaatgataaatctatatatgttgcaatatcaatattgtcaaattgccttggaattttttcaattactctagctagggcttccaagagtatgtgggccgtgatgtgtactttatggctacaacctgaaacattgaattgtgttaaccaatatacatatagttatgtttattcgagaaaccaattaatatacacatactgatgacgatgttatcgttcctttacgttatatgatcaataggagtacctttgttggacctatatgaacatatagtttagccactttgttacaattaattaggtcgtgcctcgtgttacatgagtcatgcatgatatatttatttagaggtgcgccgatctgtacactacgatttgaacatatataaaactagagataaaaagaaaagttgttgcacttttgttctcttatgtcgtcctgcatttcacgaaactactacaaaagtatcacattatttttatatacaaaattacaactttttctcttacgtcaaacgatgtatcgataccacatgttacagagagttgtcgttttcttgaaagaaattagtattgcgtattatggggggcggagctacatgaggaatcaaggaggcacccacaaacccagcccattaatttcttttatagaattatacatataaacttggtataaagcagagtaaaacaaataagtggtaagctcctccatttcgttttagctctgccccaatctattattgtaatttccataataaaagctataggtacataagtgaggaagcctgctacggtttcggcctatgggccttcagcgagctctgctgcgataggcccacttaagcccatgtagtgtcagacaaatgggctggatatggacatggacattgttagcctgctttctgggctgggctagtttggaagtttcttattgagctctgaaaaaaaattatcactgagaacacacttcttgatgttacaacattgttgatgccatcttaactcgacagataaaccagaggccacaaacacagaggaaatggatcaaatgaacctttcatgcacttgcaaagctgcacacagattacagagtctcgtagttgtttcaccacctgggaattatgactgcccatttgcgtttcaaccacttcataaactcagcagaaatcagttattggacatgttctctgcatatgatatcctgaagcaaaactggggaaagaggcaggttttatcaggccaagctgacagcacagagttggggtaaaaattcttaagaaactacacgagtttcatccgattccagcatgatttgattccaaatcaagcccaaaagatgcctccagtcaaaaaagttgcaaaactgcgctctgaagagtgtaaggacacactattcagtcatcctcttcctctgtcaataccttcttgcaagcctcatagcacataaacgaaataccggcggctggcaccaacttcatgcaacttggccccagacccctgtaaagccctccaaccccttcatcctccagaatgctcaggagagcatgaagcatgttcttgtagaccttcctgccaccgactgcgccaacttgcatgtgcttgcgtgcaacctcgagggggaaagtagctgtgcttgagatagctcctgcggccgacccaatgagcagggtaggaacgttgccgatttcattcgtcttgaacatcttcttgtaggccttcttaagggtgtcgtaagcaaagtagttggtcgccgcatatggcacaactccaattaaacttggcgttaaacctcggtacagctcagtagggccttcttcacggacaattttgacaagagcgtggagaaagttatcatatacacctctctgcacattttaaggcacaaccatcgtatgacattcgtgtattgcgtctcaggaagttaaaaggctctagtttcagggaggcatacagagggatagaactaacctgtatggttaatcgtgtcttaattaattccagagggtaagtacagagggttgaactgacaccagcaaatgccccagccactagtgaaggagggagtgggaccttcttttgttccccagatttgggggtcaagaacttgttagctgtatcaaaagcgaagagctgcagaaaaagaagggacggccaaatattaatatatgtatgtgcacaaatacttgtacaactagctatttatgtttcaacatgcatccatcatttatatcgtagttgtccgatgatatacacaaccatgcgcatccaacatgtgtgaactaagcaacaaacagaacataaaaattaaacacccaactgtgttctgttcaaccctctaactgtgaatgccagaaaaggtttcttgataaaagaaatgaaaatttgaagaaagccaacaataatgcaaggacctgcctgatgttttcatacttcaaataagcatgagaattagcctttttatagcccttattacatttttaattacgataaaaaatcaatacaagaactttctgactgtagcttccttgaaacatacaaaccttttcttacatgaatcatgcaacaagttgcctgaggtttggagcagctcactcaaacataaagatataggaattatttagctgcagatcaaaaccttggtttaatcaggccaatacctctgggaatggaaatctcaaaaaaaaaaaaggatataattagttttgtcttgtatgtgccttcggtttgcgctcagctgttgtctaatattgtgtaaattatcaggtatggttcactggagagaaagcaaataccaagtttctattatgttaaaataaaaaaaaatagtgatttatgaagaccatactctgttcaagctacttatcttcagaccagcttgagcagggaaatgttatggcaacagataagagcaattcttacgtaccggtggactaaactgcaaactgcttcttgtttttgggtatataatcatcactattttttcccattaatatcatccataaggtcaagatagcacaacgctgatgaaatgatgtgttataacagaaattacatcgatgctttcagccttacactagctccgaaattgcatactgcgcaaggctagcacactgacctatataacttaactctatggtatccaataccaaaatggcacaatctctcaacaaattttaagctatgccaaaagagctattcagcttttcttgggtaacaggggttaatcttaaaatataaaagatatacctagatttatttgaaccacatacctaacaatttgcataatgtatcctaagcataagggagaaaacacattttgccgtttacaggatcaattaagcacacgaaaagcggaaagaaacaaacattgatttgcaacaaacattaatgcttactacctccgtcccaaaatataaccacttttggctacgaatctagacaaagattcatagctaaaaatgcttacattttaggacagagggagtaccattttgtaagaataagggttacatattttgtaaaacaaaaatccattaacaggattcccccattgtatgtaaatcacaaacaaagcacagtacagtatcaatatacattacacataaacactgtaaaaaaagtatgactccaccatgatcagtaaatcagtcggttacctcaattgctttgctcggggcgactcgaatgacattaacaaagttaccgcggaacaacccagtccacccttcatgcttcatgatggactggaacacctccgcggtcgaattcccattactccccaccatcaaatgcgtcctgatcgtctccaatggcgcgacggccgtcctcgacaccgcgccggcgatccccccgctgatcagcctcttcaggtggggattgcccaccttgatcttgagcttgaatgctttattcgtcttcttcttgttcttcttccccttctccattagctccacctccacactttgaccgggcagagcatggtgctcgatctccggcgagacatacttggcatacgggtctccgggagcgtccggcggcgacggcgagctcgaggaggtcgccgggaagccgacgccgacgctggcgaagaggccggaggcagggtggaacgactggtggagagtccacgccaggttgaatccgccatcggtgtcaccgcctgagggcaccgccgccgccgccgccggtggcagcgcgaggaagcagccgccccaatccgccgccgcgcattgcaaccgcgcgccgccgccgccgcaactcctcttgctcatcggctcacctcggtttcgatccccaacacaactccagcaatcgcaaggccggacaaagaatcactaattggccccaaaaaagaaaaaaaaaaaaaaagcaagctcgtcgccgtcaccgtggcgtggaaaagacgcagaaatggaggggggaagaatcttgggagccaaaaaagggcgcgattctccaggaattggcagaaaaagaaccaacctgaaagaaataaataagagggaaagaaaaaaaaagggaaggaaataaacgaaagatgagagacctttttccacggcgtgatctggaatacggtgtcgcaggcagcagcagcaggtggaattgaggtagtgagagaatgggagtaagcgactattttgtacctgcccagcactagcagcaagcaatccctttgacctcgccgccggtcaccgccctaccaacccccgcgcttcttggacgccggcggcggcgggtaaaggaaaggggagagagagagaggaggtgggaggtgagaagaggtcactgcagtgcagccggccaggaaagtgcactttttttttctttgttgcactttgcggcttcgaatgcaaagggccagtttagcttgcgaaaaggaaatttttagacgacgtattagatgtttagaagggattaactcgtctgtaaaccgtgagacgaatgttttgagcctaattaatccattattattatatgtgggttactgtaactgtgcaattagtttttttaatctatatttaatattcatgtgtccaaagattcgatgcgatgttcttgaaaaaaaaatttgggaacaaaaccaggcctttcatcaaaaggtctcattgtttcgcatgcttatgcagatcaaaatttaaaatttacaacttagtttgaaattgagttttttttggcattttatctaaatttattttacagtatttctttgtaatacgtatataaaataattacctacaaacatatatttttatttgctaataagcgattcggttagtataagaataagtgaatagatagagctcaatagtaaaaagtcaaaagtctcatctaaactggttcctgacttccgtggacttctgtttcaaccaaaaatacaaaagaaaacgcagaaaactacccacccgtcctaaaataaatcaagagaatctcttgtagtgcaataaaatgtgtcctgtgctaaaactgaaatgtggtaaatcatggtggctacaacatcacaaatatcacagcgtgttacctagtccgttcgatctcgatcgaatggctaccgggtaccttaaataaacacggtactattcatcctctatgcagaggatccaaatcctggtttgcacacgtggcgttctactacttctagtagggagttggtgtgctcctgtgtggcagtctaagtgacgttgattagctaccagaggttttgattcttcgtctctacatgtggattttataaacgggcacctatcacattttcttcggtacaacacacatgtttttcaatggctcaaaccaaaccgcacggcacagaagtatatgtatgttgcaaacatgatatgaatttattttgtggtcatgtgtagcttcctcatctttaaatgtgttcacggattctctctattttacaatatatgcgatatgtatattgtttttgtttttacttcaaagagggaattttattgattacggaaaagagaattgcattcttgatttatcaagtctaagatttctgcgggaggacacaacttccactcctcatacgatctagacctcatagccatttgagctaaagcatgagcaatcctatttgcttccctcctgatcttgcaaacctgcacactttggagacgctgcatcatccctctcgcttctgattgttgctgcccacggtgatctcgatagctcatgttgatatgtatattattttgggagtacccattttgcaataaatgctttgaatgatgtagaggggtgtcatgtgctggtattaatgcttgattttttttaatatactcattaaatattttgaaaaatgttgtgctttatttacctatctagttcctctctatttctgtttttataaaaggaactaaattcaggattcctgtgttttaaaatcctattattcttatgcttttcatattcctatttttctataatcctgtgtcacgaagtggatattagagattagacttcatattaaaaataatccaaaatccctatgggctgaaggaatttcaaaggaaacttggaggatttcaatccttagaaaaaaaaaagttccctattagctcctttggatcataggaatgcgattgataaaaatcctttggaattgcttcctatgcctcaattccataggatataagcataagctctctttggaaccaaggaatttcaaagaattaaaatcctatagaaaattccctataaggtcctttggattgtaagactgggttccaaaatttctgtaggatcgcttcctttcctcctttgagaaggccaagacaacatgtctctttatctctcatattttatttattctaatgaagtatttcattcacaattcctgaggttttcctatggactaactaaacatgctctttagcaaatccctgaaattttactttctgtaggatttggcctagccatggcaatcaattcctatgtttttcttatcatgcaccatgattagccaaatccaaaggagtctgaagtcccatgcagtatccctttgtctgtctactatatctgacacacaaaacaacaacctccaaaaattctgagttttatttcctacaaaccatccaaatgcacaaaaaatctgaaattcctgtgtgtttaataccctataggaatcaaaagtatgtgacatgacatcttattcatatatttttcctatttgtgcgttttgataatcctacgtcccgaggagccttgtaatttgagaaaatcctaagaaattcgaagtgattttgggatagccatttgtttgttggaaagaatattttcgataggagcactggaaattgtagtgtgattcttaaatcctacaagaaaagattacagctctttgatagtgcgatggaagaaaacaaaagagagtttgcattcctctataaactttctatgaaacgtaaagcatatgaatacaaccctatgaaaagctttctttcttttcctatagggaaaaaattcataatttgaaccttatgaaaaccctttgccaaagaggcctaaatgttctcacctttgagttaacgatttttgagagagcgtatacaatgaaacggagggagcagcaatattctacaatgcagtatttttctctttcaaccaccttttcctggatgactaaattttgctcggactaacaaaatttagtagaattcgataagttaaagtttatcatttgaacacaaaagaacaaagacaaataaatgtgtcatccgaaagctcttatttccgatatttctcacacacacgaggctgtttattcttgagtgatggatggatgcatccgaattccgaaaatcgccaattccgtagtactactagtacattgcggagcgagcagctaccctagcctagaggtgaagcggaggtgttcgtccggcgcgccgccatggccggggacgccttggggcagcggttgtggccgtaccagacgccgtcgggcagcggcgagccgaagtagaaggtggacggcttctccccggcggcggcgccaggctcgaacacctgcacccactccggcgcccacccgtcgcggccggcgcggcggaggtagaggtagcagacgccgtacccgcactgcccgccgacgcggaacgcgtcgacggcgcaccggtcgagcgcccccgacgccccgcccgccggcagccgcgcgccgtacgcctcgttccggtacgcgtccccgaacgcgacgctgacaatgtccgccgtccgcgccggcgacgcgcagctcgtcttcacccgcaccgtgtacgtgcactcccgcctcgccgccgccgacgcctcctgcaacgaacacccacgcacgcacgcgtcagacgaccagacagagagagagagagagagagagagagagggagcaagaaggcaagaacggaccgtggcggcgtggcatgggtggagaaggaggacggcggcgaggagaagaagaaggggaaggcggcgggtggcggcggcggaggaggaaggcgccatggacaccattgttcacgctattgactccgtgaggcgtgaatgcgtgatgggcatgggcacggtgaggatatattcggcgacaggacaaagaggaggaggacgacgacgtgcagtgcagcaggtgcgggggccccggcgatctgcggcgtggcagactgggggtgggggcgtcgcggtcgtccgtttcgatgcgcgcgccgcggtggcagcagcgcggcgagtttgcgtgtcgcgttgctgttagcgggagtgtgcaggttaagaaaaaaaaagaactggaaaaaaaatggggcattccgagaattgaactcgggacctctcgcaccctaagcgagaatcataccactagaccaaatgcccgctgctgttactaatttatgacagatgttactttccttatactccctatttacacacggtagtagcacataataaacgagactattaaaaatttgtctcgggttttatttttataaaaaaaagaaatttcaaatgtgggtaatcctgtgtatctataaaatcatgctcactaagtgtggttaatactatttctctaatctcattaagacatatcaccttaatttttttagccgttagatgattgatctatggttcgaattatttttctccttttcttctcttatgaattcatattactttggatgaataatctatattatcttctttattttccttctgccacatcacattagtttcacattaatttaaatggtcaatctatatatgatttaaattgttataaaccattatattttttaaaaaattttgatcaaatatgaaaattatataaaatatataaaattatgtcatctagctatccaacgtgttatttctactattatcgtacaaaactcctgcagcaacatgcagggttcatctagttacattgcaaacttaggttgtgtttagatccaacggtgaaaaattttggcgtgtcacaccggatatacggactcacatttgaagtattaaatatagactaataacaaaacaaattacagattccacctgtaaactgcgagacgaatttattaagcctaatcaatccgtcattaacaaatatttaccgtagcaccacattgtcagatcgtggagcaattaggcttaaaagattcgtctcgcaaattagttgcaatctgtgcaattgattattttttagcctatatttaatactacatgcatgtgtccaaacattcgatgtgacagggtgaaaaattttgacaggggatctaaacatgcccttattgtctacatcgtaattttgatttctgtaccattagaacacatcgatatttgtgcaaaaagggaaaaaaatcacgtgttgcaagtttttttagaactacacaataccacgtatacactcacaacgcatgtatactcaccctacccctatgagcatcttcgaagacatggggacacgcacactcacataggtccattaaatcctggaaaattcgctcccatggggacacgcacactgacacatgtccgcgaaatttcgacgtttcgacatggctcggaattaagtttcaattggaatttcgaaggttaaacaatagatttggtctaaatttagttaaaatttatcgaaaattgtgataccgatgggactcgaaatttagtggtcaaccggtaatgtaaaccctgccacaggcacctcgctgttgacgagtacgtcgcctaccattgaaagcacaaagccgttaaatattagaaaattcgcaaagttgaatctaggacctaaggtgctattgaggcttgtaaccactaggctaaaggcccttgtccttccgcgtgttgcaagtttttaatactactacttatgtacaagtattccaacccgcacatattgtttgctatgatattgttttgcgaatttgctagtattatttgcttgtctgggcattgctgcgggaaaaactcttctcgaagaagaggactcttccgttttcgatcttttgatacagtgcagaaggtgtgctatggttgaaaaaattattgtacactccaaaaatcatgtaaggtagcagggttggagtgtttttttttaactaaaatctctccaaatcagttttgaggatgaaataggaggacctttggtgatgctcggcgagacaaactccagggcttgatgttccatgtcagcacgttggcgcggcgcaaccggggacaaaaaaaagaaaaaaaaatgcagcgatggatggatggtggatgcccggctgctccgctcccctgttgcctccgccgtccgctgcaacactagacttcctattttcggatgatcggatcaccttccctagaaattcctaaattaattcaccgtcctttcctcctcttcttcctccttatctcctcttctctccctgttccttctccttctgttcgatcaatcggtgcgttcgccattgcagataattaatcatctttattttttttcttatctgacggatttatgtatagattctagccatgaacttgtctatgatcgagcatgagattttgcatcatggtaaacacaatttccctttttgtatgtgtgcaggggtgatcatcgagatcgtgttgagggatagatagtttaatctaacaatggcgaagatcctgctccatgggacgatgcacgtcaccatcttcgaggcggaatcgctctccaaccctagcaggccaagctcccaagcgccccagttcctccgcaaggtcctttgcttgttccttcatcatggacttacttagatctcccatgcagtatatacttcctccatccctaaatgtttgacgccgttg

SEQ ID NO: 23783 - DNA, 17984 bp, Oryza sativa
cggcgtcaaatatttaagtaaggagggagtatattatttgccgtattgatttcaactttcaagtcgtgtacaacgaacgagttgtctagtgttttaccctgatcgtttgagacatggctgataagtcatggaaaaatgagcgaaagcaaccgaatataatttatggtgatgattttattttatatatgtgtgttgtttgtgttttagaaagcaatgctggaaaatagactataatggaataaaaactgaaatcaacgttttataatttagattttagctggtgcctgttttaacagtcataaccggaagtggttcttgccatccattcatgcatgaacgtgatttgctccttttgctacagtccaattctattccttttttttttgctaatcctctcttctctcttctatccaatggaaatgtgtgcggcgatattcgagtcataatcatattgaaattaccatcagtagcatcatcatgtgcatacattttcaatctataggacgagctagtctacaaacatactccatccgtcctaaaaaaaggcaaaccctaggtttgcgtgtccaactttgactgtccgtcttatatgaaatttttttataattattatttttattattgttagatgataaaacatgattaatactttgtgcgtgacttgtctttttaatttttttcataattttttcaaataagacgaacggtcaaacattgggcacggaaaccagggtttgtctttttttgggacggagggatgggacggagggagtactagtgttttgttgaaatttatatttttcaaatcaaatcaaaaaatagcttgcaatgctttgcctcggtaaactcttttgatccctcgagatgatgtctcttgtttgtcaaaaacccattcaaataattatgaaaaattcttttgacaacattcatacagcatatatacaacacttcacaaaatcaacttacaaactgagatataaaaaaagggtcaaatttaaatatcctcactcagaatctgttactccctccatttctaaatatttgacaccattgactttttagcatatgtttgaccgttcgtcttattcaaaaacttttatgaaatatgtaaaactatatgcatatatataactatatttaacaatgaatcaagtgataggaaaagaattaataattacttaatttttttaaataagataaactataaaacatatttaaaaaagtcaacggcgtcaaatatttagaaaactgtaggagtactgatgaagctgcatttgcatttgcgcgaatgtgacgcagctggtggaggggatcgaggacacggtgggcgtgggcaaggggacgagcaaggtgtacgccaccatcggcctcgacaaggcccgcgtcggccgcacccgcacgctcgccgacgacaccgccgcgccgcgctggtacgagtccttccacgtctactgcgcccacctcgccacccacgtcgccttcaccctcaaggccaagaaccccatcggcgcctccctcctcggcgtcggctacctccccgtccgggacgtcctcgccggcgacgaggtcgaccgctggctccccctctgcgacgacaccgacgcgcgcacccccatcggcgacggcggcggcaaggtccacgtcaagctccagtacttcgacatctccaaggatcggagctggggccgcggcgtccgcagcggcaagtaccccggcgtgccctacaccttcttctcgcagcggcaaggatgcaaggtgacgttgtaccaggacgcccatgtccccgacgggttcatcccccggatcccgctcgacggcggccggagctacgagccgcaccggtgctgggaggacatcttcgacgccatcaatggcgcgaggcattttatctatatcactggttggtcggtgtacacggagatcgcgctgatcagggacgccgaccggccgaagcccggcggcggcgtgacgctcggcgagctgctgaagaagaaggccggcgagggcgtgagggtgctgatgctggtgtgggacgaccggacgtcggtggggatgctcaagaaggacgggctcatggcgacgcacgacgaggagacgatgaactacttccagggcacggaggtgaactgcgtgctgtgcccgcgcaacccggacgactccggcagcatcgtgcaggacctgcagatctccaccatgttcacgcaccaccagaagatcgtcgtcgtcgaccacgacatgccgtcgtcgcgccacggcggcggcaatggcggcgggcggcggagggtggtgagcttcgtcggcgggctggacctctgcgacgggaggtacgacacgccgttccactcgctgttcggacgctggggacggcgcaccacgacgacttccaccagccgaacttcgcgacggcgacggtggccaagggcgggccgcgcgagccgtggcacgacatccactgccgcctcgagggccccgtggcgtgggacgtgctctacaacttcgagcagcggtggcgcaagcagggcggcaaggacctcctcgtccagctccgggacctcgccgagacggtcatcccgccgtcgccggcgatgttcccggaggacgccgagtcgtggaacgtgcagctgttccgctccatcgacggcggcgccgcgttcggcttcccggacacccccgaggacgccgcccgcgccggcctcgtcagcggcaaggaccagatcatcgaccggagcatccaggacgcctacatcgccgccattaggagggcgcggagcttcatctacatcgagaaccagtacttcctcgggagctcctactgctggaagcccaacgacggcgtcaagccggaagatgtcggcgcgctccacctcatccccaaggagctctccatgaaggtggtgagcaagatcgaggccggcgagcgcttcaccgtctacgtcgtcgtgccgatgtggccggagggcatcccggagagcggctccgtccaggccatccttgactggcagcgccgcactatggagatgatgtacaccgacatcgcccacgccatccaggccaagggcatcgacgccgaccccaaggactacctcaccttcttctgcctcggcaaccgcgaggccaagtccgccggcgagtacgagccaccggagcaggccgagcccgacaccggctacttccacgcgcagcagaatcgccgcttcatgatctacgtccacaccaagatgatgatcggttcgtatatatctcctgattgatcttaccacgattgtttttggatgcatttcttgatcgatttggttgtgtgttcatcagtggacgacgagtacatcatcgtcgggtcggcgaacatcaaccagaggtcgatggacggggcgagggactcggagatcgccatgggagcgtaccagccgcaccacctggcggcggcggggcggccggcgagggggcaggtgcacgggttcaggatggcgctgtggtacgagcacctcggtaccgtcgacgaggcgttccagcggccggagagcctcgactgcgtgcgcaaggtgaacgccatggcggacaggtgctgggacctctacgccggcgacgggccggagcgcgacctccccggccacctgctcacctaccccgtcggcgtcgccggcgacggcaccatcacgcagctccccggcgtggagttcttcccggacacccaggcgcggatccttggcgccaaatccgactacctcccgccaattttgaccacttaaagaagagctaaattaacctctctgtgcgctttatcgtcaatgagaagagatttattttggttttttttacttttgaataagaacaccacactagtttatggcttctgtatttattttggacaataacaactgcattaatgcagtgaaacatcatgatgagttgctatttgttatgacagatttgctagtttcacactatggatttgaactttgttgattttgttgcatttctgctatatactccatccgtccctaaatgtatgatgctgttgattttttttcataacatttgataattcctcttattccaaaatttagtataaacatgtaaaagtataagttaagattatagttttttttataaaacaagtcacaacaaaataaatgaaatttatatttttttaaaaaaaaattagacgaacgattagacatcacgtaaaaagttaacggcgttacatatttttgagactgtattgttgtctgtcatatcatcaattagactgcaaaaattcaatccaggaacagtttctacaccagatagtaatagtagcacccttgaaattgggattttattcactataacaataaacattttatttggtttcaaaaaagaaaagaaaataaaataaacatctagtggtgctaggttgaatagttggatagaccaatcattgaagcgccatccttctctcaacaagaagtaggacaaggacctcctcagcttctttgcttcatgttctcttttcaacattttcctttcaactttgatcttttttatggtgaatgtattcccaacttctcatccacaaaggagtcatcttctgttgactggctagtatggctgtcaattaccagctagagtatcaatccagtctggttcacccattaccaaggaaaaaaaacagagagagaaggttctacagtttcatggcctacaaaaaagaacaggcggaagatagaagcttctaaactttctttttgtgtgatgcaaactgtagtctgatctggtgagcattcagccaaattcaaaaggaatgaataaaaatccctactcacattttaagtgaaccagtaaaaaaggaggcaatattcttggacaggaatttcaaaagtatgtgccaaaattcatttctcttgagaaatcttctgacaatgttattttgttattttggtgccggtccatcactaccttcctgagaaaaatcttatacacaagcttctaagacccagacaagctggcaaaagacaaattggagagaagccaagtgattgcttggcggcccatttcacctcaagaagagataaacctgaatcttctagttaaattgcagctgtgtatgttgactcatgcagtcttagcctttggtttagcttttttgaacctagagtacaggaaaactccagctagagcaacgccagttcctgaatgcagaaaaaaggacaaaattcagtacgggtaaattgaaaagcgagctgttaggatcagttgaatttggttgtgaggttaccaagggcattaataggtgaaatcggagttctgaagaagagaacggatgagacgatgaccacaactcgtttgacacagttggcaacagaatgggtcacaggtgatactctagccaataaactataagaaacctgcctcagaaacaaaaataattttggttaaggtaattaaacaaaatccgaaagagattgaccatggtaattaaaaaaacttgcagatacactcatgtattactagccaccactagaaaatttggatccatgcagacaaaccataaaaattactacaaaattctaagaaccgttggacaaccataaaaactatttttatactggaatttagcccacctgttggtaaaaatgaaaacaagtgccagcaagagcagctttcatacatagttcctgtagattaactccctacatgcccaaaaagacagtgtttgaataaaacattggttagcaaagataatacagaacagcccaaacactcacgttgctctgcaggtacgatggggaaaacttgatgccttccacagacagcatcagtggggcagataataaaaatgacataacagtcattatcgagaagaggtttatatcatccaatgtttcctgcgatatgaacaaattgcgtaaaggtatacagtgcttcacggtatttaccatactgtaaatgtccgaatatacattttgtgctgaaaaatattcttgtaggaggaactacacaacttcatgggttgggaaaatcacctctttatcagccagaagtttcttgctgaaaacatttcgcgattgattggtaagattggaagccatggcactccaaaatcctatcctgttttatcaaaagttttgcacgatactacattacaacaaaatgcattgtattgcttaaacaaatacgaagacagaagtcaaagcatcaaggactcctcagttcttaggcattggaattaaagataatagataccactgaccagttgaaagaaacttcggtcatcgatgctagcacgacgccaccaacaattggcacgagggaacctaagaccaagaaagagggtgtctgccgaaacacacgatttgtttcaaagcataaaccgatcagtctctttggttatatgtctcctctttttaagacaaaatataaaaatcatgaacaaagcatgtacctccccaaggaacaacacggagagaaggacagagaagaagggctccatggccttgatggtgtgcgtgaaggaaacggcgaccttgcccaagctcatgttggtgaacacattgcccatcgtgtgcaccaatgccaatggcaggatctttgcatactgcactaacaacatttttttttaccacaattcattacatttctagaattgtattgtagtattccaatacacaaacttttgccacaatataagacatttctaataactaggaaggtggcccgcgcgtatgcacgggcacttatattattgaaaggtattgctagttaattatcatatagtccatctatatatataccgtgtagtatggccacaaatgaaaaatgcgagtgcaagatactcaaaattcttttgattaaatcgtctcatgaagacgtatgatataggaataaagggagggaagcatatgcatggtaaaaaaaaaagaaggagaaaaaatgaaaaaagggaggggaaacgtacgtacccatgtaagtaggtgcgtacgtatgccgcgggaggagaggtgggacctcgtagtatttagtttgttctaggatcaatttaatgtaatggtttataatattagacctaacgatttaagtgaaaatcaagaaatagatactttgatttttttttccttagaatttctaatatttgccctaatttattagagcaccacgtcgcagcttgagagcattttcatgaattttaaatgacttaacacatgtaattagaatattaactgtgcaatatatatgtatgggacatatggtaatatttgttccaacttcgtccatctttatatacatgtagagtgaaattaattttgtggcttgcaagccattagatgtctaattaatagcaattaattttgacacctatttacaattgttcagagtaactcttacatattaattttacgactttaatgatttatcaccatgactcgcatgaaaaaaaatatgtagtacttaaggttcaggatagctgaaattaatgaattatataatttatgtgatagctatttaagggtataacaaatgaattgacttctaaaaagttagaatattgtttaaagaagacactatttagaaacttggaaagtgtgcaaacaaaaatccaaaatatggaatcgggaaaaaaataaagggccttaaactccctttatcacccttatcatagtaagagttctattaatattcgtcaatattacgctcacatttataacataatgatccctttcacctttacgaacaaatagtacaaaatccaaatacgacataacacaaatacattataattattatataatcaactctcggtttcaacttaaacagagctaattagtgtggagaaaaacataacccatggtgcttaattattctctcgctgcatcacacctttaattttcttttcatgttattaacaaaattaatcatctccatatatgatttgatatatggcaaagcggtagctctacggtggttgtgatcaccttatatgtctcaaacactacaccttgtcacccatgcgaaaggcaaaggtgcaaatgtgcattgtgcagcgggcaaaaaaaaaagaatttcggacgctttatttattagcaaacaatagatacgatgattataataataagtccaccagttctagtgtaagtgtacattagttaatatatattttaaattgttaatttaatgggtacacaatataatggtgtagaccttattttgaaacagtgcattacttgagaataatataccaatgtaataaaaaatagatccgatgatttatataatggggccatcagtttaagtgcacgtataaattagttaatatagatattgtttatttaataggtacataatataattgtgtaaaatttattttaaaatagtgcattatttgaaaggaagattttttgttatatgatggtagattctttgttttgtaaaattatgattatttaaaaaatatatgcactatatatatatatatatatatatatatatatatatatatatatatatatatatatataaatggaaaagaaaaaaagaaaaaaaaaagaaaaaaaggagggaagcgtacgtataatgtatacgtacgtatatactccacctgccacctgccaacgtgcaggaggaagataggtgggacccatgatatttagtttgttttaagatcgattttatctaacggtgtataatattggactcaccaatttaagtgaaaatcaaagggtagttgtttttcttttttcttagaatttctaggattttctctattttattagagcgccacttggcggcttgagagcgtttgtagaaagtctcatggacttttagtatataatagaagattccattattccagttttttttgacaagaacagtgggttacctgtccaagggagagccttggcttggggtgaagattaagcaaccacatgagggtgatgaagaatgatccggacgcgaattggaaggtggtgatggtgtacgggaagggcaccgatttcagaacctgcaagccatggattccaacaagatccgccatgaacaaattagagacgaaaaagaacatgtcgagaaggagaaggaaattgacgaattgggggaaaaaaatatatgtgcagaccagcttgttgaagatgttgaagtagatgttgaggaggtaccagacgaggatcatggcgccgagctgcaccgtccgcgaaatgccgccggcgacggcgccgccgttcgccttcccgccgccttccgccggtggcgaggccgccgcggccgtcgccaccgccgccttcctcgccgcggcgccgctgttccacagaagtgggggcgcgagcagcatgcgccccccgcgaatgccgagcggcagcaccggcgcgcccgcgccggcgaccgggcatcgattgagagacgacgtagtcgtcgtcgccgtcgtcgtcggaggaggaggagaagaacacgaggcgacatgccgccgccgccgcggggaggccgcccaggctctagaggtcgccgccgccacggcctgcatctcgcctcgccacgccgcgttccacaaccacgcgtccacggtttcttggtcacaacaatggcgccgcctcaaatcaaatcaaatcgatcgaacgccgccctggagtcgcggaacgcgcgcgcggacacggacgcgagagcgcggtggaggagacgccatctgctacttatggaggaggagtggctgcggctgcggctgcggcgcgagtgggcggcgaggcgagggcgcgagtgagaggccactggaagccgcgggaggagagagggcgacggcgacctggccgtctcgctctccgcctctccggctccgcgcgcggggagcctctgagactcagagagagaggaaaaaaaacacttctttttttttttttgagactcagagagaggggaaaaaaacttctttttttcttctgagactaaagagagagggaaaaaaacttgttttatgaggggaaaaaggcttctttttttacagtgttttttttcaattcttttttcgtggtgggcactggcagagtggcagggaatgggcccggcggctatggcgttgtgggccccacatactgaatgcgacgtggcatttatgtatggagttgtacacctataccgggatctctgcaggagtactccattaagaaaaaaagggaaattacaaatattgaggaggaatccggataagtgctcatccaaattcattattaaaaattaatttttttctaaaatagatggcgtgttttggcattgcattaaaagaattctaaattctgagttgtacactttagaagagtacttattcaaattctgaaattcatcgaaggttttaactcagactaaacgcattaaggtaggagtaaatcatttttggttggcattgaaaaaatggatggggtgttaacagtgaaatttggtccttggacctgcactgaagctaagcaaatctcttagatcagtgtgtgtatttttttcatcaacatgaggccatcatcttgagccttttcaagcaagacaaaagagttgtctgttttgaaacaaaataatatgatggaacgttttatttttagtaaatttattttaggctacttattcttatagaatatttttattttagattagttaatttcataaaaggttcaatttcaatcataatattgatcccatcctgcttttctacggctcttctctgtgcttacattctttcctcttcatggaggaaaagatgccatcaggtgagtaataagtattaatgttctcagttctcactcctcatcggttgcctccccacgtatttatgatgtcgtaagttgagctatacacccaccaccaccacattttagcactgatagtggtaacatatttatgatgccttgagctatgcactaagagcaagttcaatagtatagccaactactagctccaattaatctatagctaatctaatagcttatttatacaatagttacatactatactattaatacctagtcccacctgtcatagacacactgcgtcttgaagtccgtgctacagctggttacaaatctgtagcccgctgctcttctctctcctgatttatctccttaaaatatatttgcagctggcttatagtctgttattgtacctgctctaataggcgttgctgacttgcttgagtaggagtatatctatgagtcaatcatatcactcaagttaggtcgcatgactaatatacttcttttattttactcccctccaaatctactcaaggttaagctcaggttaataaataaagattgtgcttgaggtcgaacatggtggcggggccaagggcagaacttgagtttggggctaattaacacatacgtgcctgagcttgagagtaggaaaggggcaaacctcaagttagaacttagaaggtgtcaacagctttcagatcaacaaagaagataagaacagtccaacgtaaaacatatgtacaattatctagttcaaagtctaaagatcgaatattcttgatctaatatacaatattggcaacaataagtagcccaatatgcaatatacctttcttttaacctaagtgtgtggttttaagaagtgatgatggataaactcattctatttcttaaaccaaatcttaaacccactgtaacaagtattcacttgatcatctaaatcatgagccaaccaaaacttaggctgtgtttagatctaaagtttagatccaaacttaagtccttttccatcacatcaacatgtcatacatacacaacttttcagtcacatcatcttcaatttcaaacaaaatctaaactttacggtaaactaaacacagccttagtggcattctagttcatggccatggtgagaactgagaagagaaccttctctatgatgcagacctccactttggttatttggtagtagtgtgtcatctggtctacaagcaggggcggatagttgtgaccttcatgagtccaatctattggacaattttattatcttttttttatcatggacattcacaaaaattgtgttacgcttaagggcaaatgtacttcctatattttactagtataatcatatatattttaaacttaaattagtttgactgcgtgcggggtaactagactgataaggttgagttaaccttgcctcctcacatggaaacacaaagtaaaagattggcgcaacattaattaagtattagtaaaaaaacttaaaaaatatattaatatgattttcaagcaactttcttatgtaattttttttaaaacacacatcgtttagcagttaaaaaacgtgaacgccgaaaacgagggatgttagttgagaaatgagtgggaagaacatgccggctgtgttcggtgctctaagttcccaacccctctccctcgttttccgcgcgcacgctttttaaaatattaaacggtgcgtttttttacaaaagaaatttctatatgaaagttgcttaaaaaatcatattgatatagctaatacttaattaatcatgcgctaacggactgcttcgtttttcgtgcggaggagatgggtttccaatcccaacttaccaacacaccctaaatctagccacataatcaaacacacaaaaagaagctaagagcaggtacaatagcaggctataagctagctataaacatactttaaagagataaagtaagagagagaagagcagcggactacagatctgtagctagctgcagtacggactccaagacgtaatgtgtgtatgacaggtggaaccagctattaataggatagtaagcaactattatatgaattgaccattacgttggctatagatgatttgatgccagtagtgggctatactattaaacctaacactaacagcatacaaaacatttcctgttgtttttctccgtcgatcgcaatcgcggagtcgtggctgcccctgtgcccacacccaaaatccgggatctttttcgtgcgattccaacatgtcgatcgttcttatctgatccaataatgacgcgccaatcgctaatccgcaccagttaagcccaaacatttcttttcttttcttttttttttctactcctctccctctcgtttcttggcggcgatggagatggagagagccacagaaatgggggccaagagcggcgcccatttttagtcagccacggcgagggaagaggagccaatcttggccaagccaccctctccaagaatcctcgctgatctctctgcgtgaggcgctcaattcgatttcttggggggtcgattcggatttcttgggatgcagtgggcggcgctgagctcgccgccggcaccggcggcgccggcggcggtgtggatggggcggagggcaagaaccgcgaggttgccgtcgccggggccgcgccgggtggtgctggccgccgcggcgtcgtcgtcgtcgccgtcgccggatgcgaactcgagctcgaactcgaactcgccggggagtggtggcggcggcgaggaggtggaggaggagagggaggacgcggcgcggatggagaaggcggcggccttcctgatgcggagccagaagtacgccatgctcaagcagcagctcgccgtggccgcccagttcgaggtaacgagacgagacgagctccattggattctttcaacaagcgaacttgcaatcgaatccatccgaattggggtttactgcgaattggaataatttggttgcaggattacaaggaggcggcgaggctgagggattcgctcaagtcattcgaggaggaggagccagttcttcgtctccgccgatcgctcaagaaggcggttgaggaggagaggttcgaggtattggacatccatagcaattgtttccttaccatatttgcttgtttcagttgatacatttccatacaagaatcttgtgaattgtagtctaaaaaaagaatcctgtaaattgtgatatccccattaggcattagcaaagttggattgtgagactgtcccaatccatccttgctaacgatgtttgtggattgacgattaatccaaagacgtgcagcctcagttagttgctgcaatgtctctgccgaaaatgccaaaagccgcttatagtgatgcctgatgtgtccttttgtcgactgcacatgcaacaattttgttgtatgcttgattcttttctctccgtgctgtatattgtatgataacatcggaaaatgagaggaaatctcaagtgtcaagaaatcatctcaatacacatgtttcacttacttccttcactgttgacttttctacttgtaatagttggagttgtgttttcatgaccagaactttgaattcatcattacatagtgctgaatttgggctccttacgctaatcatatgccaatagtgatttgtgtagatattttcataccccctggttgtcagtctagaaggcattctttcttcatcttttattcaccatgtttatgatttttctctgttttcatgctttccaggatgctgctaagtacagagatgaactgaagattttggctccacacgccctcctaaaatgttctagtgatgctactaccctggtatcttacaatccaatgatttagtgatgttatactacaactctggcatgtttctttcactcgataaagtatcatagttttgaatgaaatggtttggtcatttgaaaacttgaggctatgaaacattatcattgtctatggcagtatattagtgtttaaaacccccagctggtcacgcaatttcaccagggaacttgggtatcaagtagtgacctaaaaaaatagctaaggcaggatatggaaaataagagattaatacgtgaaggtcatcaagaatctatttgagttggttataactgtgtgcgttggcccttgggcaccacttcatttctttcatatgttcaggcgccccattctttttttccacgaaaatctcatgcactacagatgaaccacctccgttggtttcgtcacctgttctgtaataattctttagttaatgtagatcaaatattttctcagattcttcattgagcttaactagatttcctgatattttttaatgttgaatttaggggattagagttcaagtcaggagtgtttatattgaaagccggagccagcctttgaagggccagttcttctttgcctacagaatcagaatcacaaataattctcagcgccctgttcagcttctcagaagacattggattgtcactgatgcaaatggaaggacggagaacatttggtaagtctctattgtactctcaccttaccaaaagaaccgtatgttaaagctaataaagacttgctccattgccatgccaggggtgtaggtgttgtgggagagcaacctgtcatatttccaaggactggttttgagtactcatctgcatgcccattaaacacaccaaatgggagaatggtaacatctaaatcttccacaacctatgttgtcacacttgtaaataggttattgtaaagtaatttttagattctagctgtgcaagagattcgtatggttctaatatctcttgattgcatatagctggcatcaatttatgcccaataattaacatggtatctagatcaattgttttgattgaagctgaaagaagaaatagtaatgttcaattaagaaagactagttatatcctgcaatttatttattgtttaggttgtttgcgtgttgcatgtctgcaaagcaaacttacctgaattctcttttggatttaggaaggtgattttgagatgaagcacatcgacaaagctgggtcgtctacattcaatgtcgcaattgcaccattctctctgtcaatccttggagatgacaacgatgatgttctcctctaaatgtgattgggtatcagaatgagtttgaataagatgatgtcaccagcaaggaatttgcataatacacaaacacgagtagtgctgttagtgatgtggctagagttctctactggaaactcctgcgaatgcaaatttttgttaagctagctgtgaattgggaaggtaccaaagttcaagatcagagtatcagacaggcaaaacatggtttggtgaaatattagagttaatttagacacacacacaaaaaaaaactacactactgtaaattgaggtatatgatggacttgtgtgtcatctaacttttgaatgtacagcatagaactatatagagcttgttgagagtataagctgcatggaactcttgtattatctcgaaaaaatgattttgtaatgttatagtttcataaatatattgcactaggatttactggtcaaagcagtagcttggctctggcatttttgtcttcataaattcaaccaggttggccttaaatttgtctcaacagcatgattatgctcagggccagatatgaacaaagttcagagcaactgatcagtttatttttgttagccattgcctgttgcaaaatgacgaaatttgtgaaagttctcaaacggatcaattcaaatagtttaaaatagtgctttttatatctgtttattatcgaatttcaagttgttgtgtttagccttaagaatagctatgcttaccaactgaaccatttcaaatcatcattaaaccgtttgcacacatgtgtatacgtaaactttccttttgcatgtggttttgcttttcccaaaaaaagtgcaccttttttccccttcaataatcggtagattcattcaattgacccacagttgacactccgggtatcatcttagcataaaccacatgaaaaaaaataatccatacctagaaagtttcttacatgtattattaacctccatatccaataccatagcttgcgacaatttataacatcaaaactatgatgtcttggagcaaattttaccaaaaaaatacaataacctttttttaaagaaacaaccaaactataaccttgatgacttggtatagagaaaagatataaggttccttacaactcctctaaagacagacgtgtgttactgattttgtggggcccactttctatgggcccacatgcccctctgatgcctcatcactgtgctgtgtcttcactaagagacaattgagtaaaagatagagagatatgatattaaataacctactcactctattatcattttgtatatagcaaatttttaaaagtctcttgatgatagtatagacaacttaagtgaatacagtggactcaattggtgttgcatgagtgaaagattctaataattttttttactgtttaggcctacatgcatatgtggttttctgatcttccatgtttgacaaagaccacatttttatggttgtatgctcaggagatatctcaaaccggttttattcaagaaaggaaaggaatttacaatcttgatgagacattaaattttacattagaaaagatataaggttccttataacatgtacaacaacaataaagacgtttcttagctataccatgcagttgttttgctaacatgatgatagaataagtgagaaaaatgagcgaaagcaactcctctaacaacggagaagtgttactgattatgtggggctcactttctatgggcccacatgtccctctaacatgcgttagacgagtctcatcgctgacctgtctcttcactaagtgacaattgtgtaaaagatatagagatatggtattaaataacctactcactcaattatttttaaaagtttgttgatgatagtatagacaacttaagtgaatacactggaactcaattggtgttgcatgattgaaaaattccaatagatttttttttactatttaggcctatatgtatatgtggttttctgatcttccatgtttcacaaagaccacatttttgtggttgtatgctaagacaaaaaaaaaatatgatcttgaggagacttttttaaactttacattagaaaatgcagcacatcctgatatctcttcatgactgtaaatctgtcggtaaagtaacatctgtacagttgcatcaaaaccagattgttgcaacatctgaatgttttgacataccttt

SEQ ID NO: 23784 - DNA, 776 bp, Oryza sativa
ataaaagttcttccaaatatatcaatcttttcttgatatatatatattgcgaatttgcaactgaaaaattttcagttcttgctgcactcactcacccggtttttcttgctgcattcgcgtgcgtcttgcagcggaggcgttgctggccgtcaaggcggcgctgcatgacacggccaacgtcctcgccgactggaacgccggctcaggcggcgtggtcgtcgccggcggcggcggcggcggcggcccgtgcaactggagcatggtgacctgctccaagaccggccatgtgtccgtgctgtatgtgctgactagctatctagttgtccattttcttctgtgcttgtgcttgtcgccgccggccatggcgggttcgccggagctcggactgatggatcgatctctctccgtttttttgttcggttttgcagcgatctggctcaccggaatctgtccggcacgctgtcgccggcgatcgggaaactcaggcggctgcgactcctgtacggattgattctctctaactgtttactcgatcggtgcccgttccgtttgagacctagaaatttcaagggaattttgggaaatttaattttgttctgattcatctggaattcgttcttcccaaccgaaagtttacagaattttcgccgtgtttagttccaaaatatttcttcaaacttctaacttttccattacgtcaaaactttcctacacacataaatttccaacttttccatcacatcgttccaatttcaaccaaacttccaattttaacg

SEQ ID NO: 23785 - DNA, 1774 bp, Oryza sativa
ataggggaggacttattaaaatgtggtgtaatattatagattatggggctcagatgttactagtagggatggtgtgcaaatgaacaccaccaataccaatattttaagtagtataaattatcgatgcgattgttttacccctgtttggaacaagagaattttggacaaaatgtgaaacatcaattctcactgagcatgggtctcttttcgaatccagacattccaagacaaggcttttttcactgttatagacagataatctcaggaaatgaggaatttggtttgaattttgtgcaggtttttgcaacacaatgcaatttctggccctattcctgacaccataggcaggctgaaggtgctacaaacgctggacctggcatataatcacttcacaggcactattccaagcatactgggacattccaagggcatcttcctcatgtaagattagcatttatgattagactacttttatagtggtgtctgctggaagtataatcaatctagacattccatgttttttttttcatccaatggactatatctgtttctactatcacctgatctactggttgtagaataaaggtagaaattgtagaataattatttctaccggtagtagaacgtataaatcaacggctcggattgcttgtactagagatgatactggtagtagaatactattggtagagaatacggtaaaagtactcttatgactattgatttgaaggcattgttattttgttgcataatggctctgattgtttgtactagtgataataccggtggtagtacaatactaagaatgcctcaaaatactcttatgttttttgatttgaaggcattgttattttgttgttgcataacagatatgaacatgaattggaccacctgatttttttttctgcttgcctcattcctccaggagattgagccacaacaatttatctggatctatacctgattcactagccactgctcccagcattgtcctcctgtataattctccttgccaacttctacttattgcttcattgtttttgtaaactttttttgttgtgatattgagcttgagctgaactatttcagggatctatcctttaacaacctgagtggtccagcaccagtttttagcgcgaatagtgtattgtaagtgatttagaatgagtttttctttcttggtctaactaaatagtgcaacctgtctcaacattatctctcaggggttaccactaatttgccttctcttttctctgtttttctcacttgtcatacttgataagccttcgtggaaatcctttgatacaaaacttcagttgtgaaggaacctgtacttctgtgatagaagagacgattgctgtcccttctgcagcagaagaaccagttgctgtcagcatagaagaaccaatcagtaatacaaattgttcaccacccaaattctgggacatttaactgcatatgaaccattatttaaacaaatttgtgtgaagcaagcaagtttgggcattcatgccctcctgcatgttctaattagagtcattttctcttcccagttcacaggaaaggcttggcaggaactgctcggcgtgtttcattctacatagcagctgttcttctaatagttttcttgattgctggatttgtcgcgtctatttcgcagtggcgtaggcgacaccagatctttgctgatttcgatggtaatgacatctcaagtagtactgcatatatgtgcaagatttgttatgatatctacctgcaagggggcagtataggt

SEQ ID NO: 23786 - DNA, 25978 bp, Oryza sativa
  unsure (1)..(25978): unsure at all n locations
atggctggttcagcccttatgacagagcagatggcatgtcacaatatagtcttgatttgccaacgagcacccccccgcccccttctcgacctcgcgtttctagctaacaaaacccatggatgcacctttcgcctgtgtgaggcgacagcgcaccatatgctcatgggtcgtgggcctggttcaatataggtattatatatgatactagtttgtgggccatgggtggtaggtcagagcaataagtaccaaatcctagcgccgccatatatagtcgagaccgagcaggggagattggaggtgcttgtggcggctaggtgcggcggagccaaggagtggccggcggcacgtggcacagctgcataaggtgttcgccgttgagcgcccggtggtgcatgctagggcacgtggcacaaccacacggggtgtttgccgttaagcatcattgtggcaatgttgtgtcagccatcatgccttttttcagtttatcctccgccactgccctaggatgggtggcctggtcacgaggagctaattatggtgttgaagatgagataggtaggtgggggaattgacaggtggtgccgattgtgtccgaagagaggcatgagtgggatatgggtggccatggcatttttttatgtgctgaaaagtataggtgagggagagatccagagcttgttaatcttgatctgcagtaggacatttagatattagactttctagaaaaatatattataatctttctgcacctttttttaaagatattctatcatgtgcactgactcgaaaagtttgatattcatatttttgtgtggatctctttccctttgaccattgatttagctttgctaccatttggtacatggttaacaactggatataatatatgagaaccaattcaatgctgataagaaaatcctaatagtgcagaggggtcgaactgcattaacatttcacataactaatcatatttttgtgttgatactagtcatgcccatgcatggttgcttttcatatatgcttatgtatagttttcccatttttgtctttttagattaaaaacaccaacaatttctaagtatgatacaacatttgggctctagccaaataccgtgttttcctcagtttaggcattttaactatttcttcaatagcatgactatagagttatgttaattttactgtgcagtactctgattcctgaatgtgatcatatttatccaggaccagaaatatacctaggccatctgaagcagttcatgatcaaggagatcaaagaagctaccaataacttcgaccgaagaaacattttggggcagggaggatttggaatagtatacaagggtcgcttgcgcgatggcacaattgttgctgttaaaaggatgaaagattgtttttctgtttgtggggatgatcagttccacacagaagttgaagtaataagcttgattgttcatcgcaatctccttcgtcttactgggttctgtattacagacactgaaaggctccttgtataccctttcatgccaaatggaactgtttcttctaaattacaaggttagtcccatgcttcagtatattcttttgtcatttatgcatgatgtacactgacacacatggggcatgccaaagtcctatttttctcaaagtcctatattttctaatggatgtaaagtataaatgttaattatacaaggcagtaatatatttctcaaaaatatgtactacatgttagtttttttcattaaaaaactatagtcactttctgaatatataaagttaaagttggtgtgtacttgagatttgccttgatttttcaaaatgaaaagaaaatattgatagcctaccaatcaaagatggaacactataataacataatataccttagctaaccatatgtaaggtgattatacatgttgtccttgccttatttgcaaatgtttatgtaaggtggtctatattttaccatcacatttgttttcttggtctatgcatattatactgttaatggtacaagtgctaaaaactatgtgcatcttgtgtactgtcattattgtctccctccaaaggatgtataacaaaaggtatctattagttgatacatgatgtttctaaacaatcagatgttttttttttaagtgtccttgggattaaccctttctctgacagactgacattcatgtttattttcagtatttttagaccgaatataaatacattgacccggcatttgggagaaagccaaaagatatatagtacagagttctttattttcagttgttctgttctttctttagattagagtcatcatgtttgtttttgtttgttcctatagacttcattacatatatttgtgttagtatgaaactgagtcaatagggcattgactggtgaaaagaattatatgaaaatgatgtataagttcttcattcattgccacacacaaacaatgttttctgaactaagtattttcattttctatgagcaaattgaactaactgtttttcctcactttgtcagaatatgtgggtggtaaacctactctagactggacaaggagaaggaagatagcgctaggcgcggcacgcgggttggtctatttgcatgagcaatgtgatccgaaaattatccaccgcgacataaaggcctccaatgttctccttgatgagtattttgaagcagttgtggcagattttggacttgtaaaacttttggatcatggtgagtctcatgctgtcacagcagtgagggggacaatgggacgcattcctccagagtatttgatgactggccaaacatcagagaagaccgatgtttacggcttcggattcttgttgatcgagttaatcaccggtcggaaaacgatggagcttcatgaggatgagtatcaggagggaggaattcttgattgggtaaattactagctactccctgttttttttccctctacaagttcagcttattctgttccataattaaaanagtgtgatgttttgatttagttcatttccacaagttccatagctttaactcctaatattgtacatacttggttgtgttcatgccaatagaatacaatccaatggtacaaaatagtatatcagcaaactgaaatatgacaaaaaaacacatttatgaaaatattatcttggttgagagaaaaaatatcaatggagaaaaaaattgaagattaacatttgttaacacatataccagtgtgaaactttggccaaatatggaaataagtaactccactgtacaagatcttatttatgcacatgcacttcaataattctcaaaaacaatgtttcttagtttatttcaattgccatgaactgctattaatcacacacaatcgtgcatacctattgcaggcaaaggagcttcttgaaggaaataagctaaggtcatttgtggacagtagactgagagacaactatgtcattgctgagttggaggaaatggttaagatagctttgctctgcacaatgtacaaccctgaccaacgaccaagtatggctgagattgctggaatgctgcaagagagtgatggttcagttgtggagaaatgggagactctgaaagatgccgagagatcgaaaccgagcacgccggagttcatgctgtcatcccctgtaaattttgcttcagatgagtgcaattcaattcagttggaagctgttgagctctcagggccaaggtgatgaaatggcctgtttgttatgctcacatacaataattttcagaactccaaaatagggagatgaggatgaactgaggaagaaacggatgtttcagacattaactcagcttttttaactagagtattattttagttatattagttgatgacaaaataagttactctttgtgtgccctaccgaaatctctgggtgactctgatgattaaaaataaggaggatacattgctacaatctgggttgtactttgcatctgtgacttctctatcccctccttttttatcttttggtaagatatagtctgttgtgtcagagagtttttcttttctccagagtttttggtagatatgtttggtttgcttctgtcagaagtcaaatctggcttggtaagtttaatgtgtaggttagtttggagtaagtaacatgtttggttctggaagttttgtcaagtttataaaatgtatccaagaaagatgctaacacaatagcatgctacaaaaatataatgcaaaatttaaaccttaactttttactgctaaactggctcatctgtaatcagaggacctagagtcttagatgaatcttttgctagagacaataactaacaattaaacatcatgacaagaacccaatgcgtgaatctccatgcacagagccacaaacttgttaagacttcagactcttaactttgtctctgcctactatcctgcaagaacacaatcctgaattcctgatgcagcacaagcagcagagccatgaaccatgttcccctccttaccaccgaaggcaagctacagccctacacacacgatgtctgaacatgatgcatcagaaaaattcagagctagcaatgggacaaggaggatgcatttcggctagctaagctcaaaaaccaaaatgcgatgcatgtgttcaagctgcaggcttgcagtgaccagtgatggtgctgtcatgcagactttgtaataaccggaatttctgcgattttaatggccgtcagtagctagcctccgatttccagttctgggacagcaagcaagcagccaagcatatgcatgcagccatgagtcagctccatggactgcagctgaccagtgagactgaagctgcaaatgcatatgagaaaagtttggcagatgctgctgctgatggatggaacgcttcatggttgcattgcagctagctagctctgctgctgttgcaaaatgtgagctatctagggagagctctggatttggccggcacacactctcatgcagcaatgcattggtcacttgctaagttgtagtactcctcagtacaatgtagttctcactttgtgcagagattatgtagatcctcgcatcagcttcgctgttcatatacactgttgtagctcaaggggctctcttctaagcacactttgttactttggcccttagatcccaccccaaaattttacaccatgttatatcgaacgtttaaacacctgtataaagtattaaatataagctaaaaaataactaattgcacaaattgcgactaatttgcgagacgaatcttttaagcctaattgctccatgatttgacaatgtggtgctacagtaaacatttgctaatgatgaattaattaggcttaataaattcgtcttgtggtttactgatggattatgtaattagtttttttattagtgcccgaacattccatgtgacaccctatataatatccgatgtgacacgtcaaaactttacaccactcgatctaaacacccactttcttaaggtttcaaccaaaggagatgattataataatctactactataagacaagtcgacgcatgaccgggtcttcttaatcagacactgctggtatcgtgatgaagttgtcgtgatggagttgtgggtgcatgatatcctatccgtcaaagttgaaataacgagactcttaaatgagtgtgttgttagattgtgttgaatatgtgtacaaagtcgattacagtgtaaaacttgaagttataataggtattaggatagcaatagagttgtactctaccctaggctctctcttaaatagggaggtacatcagttgtaaccgcatggtgacttagcataggtgagagggaattaatggctaacaccggccaaggatcggggaaaagctcatgtaattaatgtcctagggatgaatgtttctgctgaacctcattaataaatatggtgcctctatatcatcatcagtttggatcttctatggtgttcttccacgttcggcacaccagttgtaaccacatggcgacttaaggtcataggttctctcttaaataaagggacataccggttgaaaccgcatagtgacttagcataagtaagaggaaatggctacggacaacatccgctagaggatcattgtaattctgatacgctataattatattggatcggagagaactcagagaggcataagcaattagtgcctccagggatataggttttagttaaaccttgttaacaaatattgttactcgatgtcgtcatcagtttgaatcttctatggtgtacttccacgttcggtttccgatgtactccctccatccacaaaagttagacatatttcacatttgagtttttctaaataagtagttttttttagtctttatgcattcaagacttaaaagaagagataaattaaatgtttaattagaatccaaggagtcatctaaatactcattggttgcatgcttgcattcactccttgattttgtaatatccaagatgatttaatttctcctttgtcttggtgacaaaaagtaatagatgtaacttttgtggatggagtatatatatgggccatgttaaatacatgtgtgtccataatgacattttgaattcttgatgattcagagatgccccaagcgtgtaagcatggtatttgtcctttgagtgcaaaaggcaatctgcggtgtactgttggagctaatgatcttgagagtttgtgggtcgggacagcttaggcccctattcctattcctagtgtcctttgatctttttttcttgattaagtggcgcgtctattttaacttgtcaacgtgggttgtaatgtattattggttttttatttactaaaatgacacgcagctctctgcttgtttaaggaaaaaaaaaagagaattcttgatacatacataagctttcttgacatacagcgagctggagcatatatccgttggatcactttgccgcgaacatccgttggatagaggggtagttggcattatcggctcaggctgtgtttagtcctttggccaatttttttaagaatgtgatatacatttaaagtattaaacgtagtctaataacaaaacaaattacaaattccgcctgtaaactgcgagacgaatgtattaaacctaattaatctgtcattagtaaatttctactgtagcatcacattattaaatcatggcgtaattaggcttaaaagattcatctctcaatttatataaactgtgcaattgattttttttcgtccatatttaatgctctatgcatgaccctacatattcgatgtgacgtttttggtaaagaaaaaaagaaaatgaatctaaacacggcctcagtcaattggttccggtaaaaatttcaaggaagggacggatcgaccattcatgagtcatcacacgtccaatcgatcagagctgttgcaccggcattacatgcattcattcaggaatgaggaggcctttttgtcagcagcaactagctatctagctgccttctttgttcgtttggcccaaccacacaacaaaacggcttaactctcacagccacattctctctccctctctcccctatttgagggctaaagatttcatgtttagttcccacgtaaaaacttttcaccctgtcacatgaaatgtttgaacacatgtataaagtattaaatatagacaaaaaaataattacacgaattgcgtgtgaattgccagatgaatcttttaaacctaattactccatgatttgacaatgtggtaaacatttactgatgacggattaattaggcttaataaattcgtctcgcagtttacaggcagaatttgtaatttgttttattattagtctacgtttaatacttcaaatgtgtatccgtatattcgatgtgatacgtcaaaacttttcacctctgatctaaacacagcctaagtagttggttagtagtgggtgagaaaagaaactgagttgctcagcttttggttactactagtttatagtgatattatgatagtttgtactgatagtattcaattgtgtaagtatgttatcagtcgaactgattttaaccgttaattttatacattctactatcaatagttcagactataatataaataaattactaataaaaagatgagccgactaaatttatttctactaccggtaaagatctttgtaaaatatcttagtaatggtctcgaaatttggacgtgagcatgatctaggccgagtttagttccaattttttttaaaaaaaaacttctaatttttccatcacattaaaactttgtatacacacaagttttcaacttttccgtcgcatcgttctgatttcaaccaaacttctaattttgccgtgaactaaacacacccctatttatgtagttggagattttacgagtagttacagaagctgccaacacaaagaaggcctatgtaagactgtatccatcattgccgagtatttcatggccacaacgacgaagtagctagcacataatttgctatagctccatttctatctcttctcgagagtgtacgtgtgtgagagagagagagaggctaataattaagtaagagagagtgccatgaactgcatcaagattgccatggtggtgacactgatcatcgtccctctcgcgctgaggggagcctcgcttctcggcaatgccgtcgccgccgccgtcgtcccgtcgtcgtcgccggagcagcagcagcagcagcagcggcggccgcggccgcctcccggttccaagaacggcgcctcgccgtcgtcgtcggctcatgggcagcactggaaggatcagagccgccacgccgccttcacccgacggcggttcggcaccggcaccggcggcggcggcgacgatggcttcttcagcgacgacaagaggttctcgccgactggatcaaatccgctgcacaacttgtgagcgttaatttgagtacttaatttctctctcttttgctgtacatatatttgtgttgtttaattactaattggcaataatcatgagctgagcttaattatataattattccgcgtgtacataataaggttggtgatcgaaattgctaatagttgtttcatttggtgaacttgaaagaagggtaaattttcgtctggctgctcatttatttgtttgtttgtttaatttgtcttccttttgtgttcaggagcagtttgtggttgttgggttatgtattagtcgcttccgatgctacttaattagtgaatctttattggttccagtaataatcttttgttacagatccaaattttaattttttaataatggattaaaatctcgcctctacttcctgaatggatgtacacgggcaaagttacagctccaaattagaagatgcttctgagtttcaagtttcaactaattctctgaatccaaatccaaaatgagttggtgcttttgaaaccactacgatgccaaattaattcttaatttatggttattaaattggttcgtaaggttgtgaaaaaaagttattcctttcaattaataatactcgtcattcattttggataagaatgatgtcaactttcaaatcttttagctatgaataatttgtaaaatatttatcctagaaatatgagaagcatatgtatagatgatggcatgcatgtcggtccaaaatggacacttcggtaaattaatattggtatggtattttctaaattccttgatacgtactatatgaccgtacaaatatgtatgtgtgccttaatttgacaatcgcttaaaccagtattttcagtttcttatgcaaatagtacagaattatatatgtaagcactgggaatttttatactgaatgaaagcacgaaaatactggaattttataaacaataaatgagtatcactgggaatttttattattaaaagaaaaaaattacaataaacatacacagctcctgaatgaaatttccaggactccacatattacactaattttataaattcacccacatcaaggaattaacttgagaaattcaccaactttttgggcctgatttacatgtactgattttatacacaggaggtgacgacaaggaacagcaagtgaacaaaacagttccatatattggaatccaaagtacacaagaccccatttaattggctgaatgcatatccaggtgacaaaatgcaaatgacagccagaaaaggctggtctgcatactctgcaggtaagtaagcaggagaaaagattggcctccaaagctacatcaaaatgcagccatggatgaaatttctggtcaaaagaacagagaggaagcatgcaacaatctgatgggtatagcatgcaatgcaaactcatgtacttctgctgaaaatgctgctctgcatatgccatgtgaaaatgtatggatctctgtcaggtactgcttttgagttttgagcagtcacgttatactgacacgcagatggtagtagagcaaaagacaaagttcttggtgtttttttttttttaatctctgatcatgttgatattgttggctagctaggggaacttttttgtgttatcctctgaattcttgtggggaattcagttattgtgcttgaaattatctttcatttcaaatgagtgggactagcgtagatgtaatatggtgtccaatgtaatctaaactcggcgtgcttgatttaatttgtaggtaaataatgaagttgacctacattgttatatcaattaagctcttctcatatagaggcttcatcgggtctttcaagttctctggcatttttttttatcatattgatttacatgccccaatcagttcactttaaaagttgaaaatgataagaaaagatgaaagattcacttatattctaccacataccgttagtaaatttaagaaaaaaaaaatccatggtaccaacttgatcttatgggctactgaagctaggttcgattcgagctcgacttagagcttggaatgatgctattattttccgttacccctccccttttgttaatatgatgaatatacattactttactctttatattccgctaactaagtatcctgatgaagataaaaattaagttaacacatgtaaaatgagaaagccattagcgtatgattaattaagttttaattattttgccttgataaattgatttatttcacatttttaactaactttgatatagaaaattttcgcatgaaccactctgtttagtagttaacagagtttgaaaagtatgttaacggaaactaagagaaaatataacagatcaagtactacacacaattaagatttggcaaaatttgctacaggacactcaaaaaacgtgtaattagccgcgagacaccgcaaaaacataaattggctgtaggacatcgcaaaagagtggtaattagctactggacactagagacattattttattattttcggtagaaacggagagagaaagagcgttaaaagtactgaaatgtccccggccgcaagcactccctctccagcctcctcgccgccctccccgccggtgctgcgcacgccggccgcctcagcctcacccggcagtagcacgtcgcacgctaccatcgtcccgttcactcccacttgcgatgttctcggcggcgacggcgacagcgacgcacccgccgcgagtagagcgcactccaccggggcagcatcgcagccacggcgggagcatgcaacctccggctccgccccggcggcccgcgtcgaccgttgcaggaagcgaggacggcagggaggagaggcggggacagggtgaggtgagctggcgctgtacgcgacataccaggtgttggcgtgggtgcgcgtcggcgggcaggtggccggcaagccgcagaacacatcaacgtcgccatcgccgtcgacagccagtggctcaacggcgggcaggtcctggcgctggacgagatcggcaggtcgttccgcgtcgagtccaagccggcttcgcgtgtgatgctgtacgtctagggccccgaccccggcgtcgacctcatggttgctgtgggatatttctcccaaacggatacggccaaaccaaaacaccttggacgtatctcagaattaaaagggggattagaaggtaaaacacaaacaaatctaacaccactggatccgtcatccaagcccacctcccaacgctgcatcgcggagggggacaccgtcgtggtgtacgagcgccacgacgccatgcgcgctgtgggcatgcatgctccagaaccgcttcggcgtcttccgccatgatgactggatcggccgccccttcggctgcaaggtccacagcgccgccaccgccggaggcaaggggaagggcgggttcatccacctccttgcgcccacctctgagctgtggacgctcatgctcagccaccggacgcagatcctctacctcgccgacatcagcctcgtcgtctcctacctcgagctcgtccccgggtgccacgtgctcgagtccggctccgggtgcggctccctcaccatgtcgctctttgaccaagaaaatagaggagaggctgacatccgtggcccacatagggtaatctggtcttttttgattgtttctctctccgttttcaccggaaataataaaataatgtatccggtgtccagtagctaattaccactcttttacgatgtcctatagccaattcatgtttttacggtgtctcacggctaattacacgttttttgagtgtcctgtagcaaattttgcattttggaatccttaatcacacaccttgtacatgcgactgttcatccctgcaagtaggcatttttataagaaaaggtattactattacttcacctgagaattgagacggatagatcgatcgattcgatcctgaaaccctggcgaatatgattgtgtcgtcgaaattacgcggtgaatccactcgatgcgttcactgaaaactaacgaccttctgccggggccgggaataaaagaactcatcattggaaagcgacgacagcaacactagcttaggtcgatcgctagctatagctacagctgctgcggcgaccggtgacgaagacgacgacgtacggacgtactccggtcgtacggttgagcgcatttgcgatttgtaatgaatgatgaatcaatcaaccagcaagctagagtactggtagattttatgagtagtagtacatgtatgcatgttcgcagtgagatttgccaactagtgtccgcagtgatctctcttagtgttcaacatgtattgataactgataagtaaattaaatgcaccgacagaaaaacatttcaacacgatagttggccataaggcccgaggccggatggtccggcctaaggcacgggattttagcctggctcaggcacgccacggcctgatcgctgtcgggcccgtgccggtacggcccgatcgctgtcaggcatgtgctagcacggccctgctgttgggccgtgcctgggcctatgcctcagcacggtgggccggcctggcacggcacgaacttcagggaggtgaaatagacttatttcaaccatatgtaagacaggacacaaagaatagggaggacaaatagacgtattatatggaacggcccaaggagtagagatgtaaaatagacttattttaactatatatatgtcacaacccaaagagtagggaggggaaatagacttatttcaaagaaaccacgatgggctacccgtgccttcgggtcagcccggcatggcccgacccttattgggtcatgcctaggccgcaggtggagcacgtgggccggcacagcatggcacggtccggcatgtaggtcgggctgtgtcggcctgacaaatcttggcccgagcacaaccgggcctgagctgtgccgggcggcccatatggccaactataaacacgccccgcctgtgtcgtctcattggtgacccgaacggactcccgggacaacgcaaccgcctccctccttcccctctcccctcgccgtcgttgaagaagcctgctggtaagctgagcaactgcaagaatagttttggcagggctcttttctccttggaggcgctatatatgtcaatggaggcgactagggagacaatggttctactttggatccaccccttccatagatctaacatgttatggccagcagctagtgggaggagggacaatagagcgcagcggggtagagagtgtggtagcaacgacgaggactatcggatccaggtctagtgtgtcatgtggttgcggccgtggacgcgatgggtaactatcgcggggggattgcggagcggccagtggcgacagggagtgatgcttactaaagaagatggtcggcacgccgtcctaaggcaacgattatgtggcgacctgcgtagacggatctggcaacgatagtcatggtggtggaggtagtggttgaccgtggcagcgacggatcgatctggcgcctctaagagcaaatctaccgtaccgtgggtgacatctacgttggaagcacatggtggtggcgaaggagatggctcgagcttgtgctggggcggctcggtggtggccaaaggcacggcatgctgccagcagagatgatcgtgagtagctagtcaggctgacaccttttgcatgagggcgtgtcgacagcggtaggcatgcagctgtgacgtgaggctgtgggtggccgtgagggagccaactggtggtggtgatggccgcgtggtatatcaatggttagttagaggtggttgaggatggtggggttgtggcaagaaggggaaggtaggttccacacgaaagtctagaccgacgttaagcctgggcaggcaacagtgtagagatcgggcgccatggccccctttgggagcattgtcgaggcatcttccacctccctgatggaactttccaggtgaaaatcatgtccatgaataggcgacagcatcacgacctttttaaggacgtcatctcttgaaagtcatgtggctacctatgctatctttagacaatttggactgcgatgacgcttaggatgttattatggcggtggccggtgggtctatacaaggcacgagtggatctttcttctctgttgccctctccctctacaacccttcactgtggtgttatccgggcgtgcattgtgatcagttatttggaagtgttggcgataggtggtgtgttcgtggctctattgtaaacctggcggcaacatccagtcacacatagccgcatccgacatagtgttaagtttcttcctcagcggggtgtgtgcacaagtgttgttggcacgtagtgtgttgttgttttttttttccttttttttctgattgtagtattttaggttgtagtttttttttcaaatgtatattaatagtaatgatgtgtcacctagtgttattcgtcaaagaaaatacaccgacgttaccatgtgacatgtatttaataacattcatactcttaaaacaagataaatgatttgttggtgcaaattttaaatatgtcaaactaaattatatctgctttttaataaattgggatattgtcggggcaatttaatgaccgagtgttgaagggcgcacactgggatgttctctcgtacactttttaaaattaaatttaatgtaaatgggtgggaaaattttaaaataaaatgagtatattgatattcatcactctaccaaaaattaagtttaaacttatttgagaagggaaaaagatagtgaatagcactcgcgttgtttatacgttgtattttttttatttcttgatatgtgagttaagtttatatttaagattttatagagggatatgtatttgctatatgaatgtcgttgaattcttttcagaaatttttgtagctatttgaatatttaaatatttttaacccgaattgaaagagttccccgcttacagggtgttaataagttaattgataagggtgctgatggcaaattacgtacacacaccgtaaaaggaaaaagaaaaagaaaatccaatcctaacttacgtatctaaacaaatacatgtataaattaataattagtattgaatgttttttttattttacggatggagtatactccccccgtctcataatataagggattttgagtttttgcttgcaacgtttgaccactcgtcttattcaaaaaaatttgaaattattatttattttatttgtgacttactttattatctacagcactttaagcacaacttttcgttttttatatttgcaaaaaaaaaatttgaataagataagtggtcaaacgttgcaaacaaacaaaattcaaaatcccttatattatgagacggagagagtaacccacgtgaaccaactcgccgtcatatgaagacgatcaatggagagatcgagcgtatatatacaggagtagtagtgcacatcgcagcatctgcatgtcagcatgagtagtggccgatgtgatgacctggcattctggcggcggcagcatctggtcggggacggatttcaggtggacgaggcggcagcagcatgcaccggccacgatcgatggcaaccaagacttgcatcgcagctgctgccctggccctccctgccatttggattttggagatgaattctgatatggattgatggacctgcgtgtaaatgtaggattacgcattacatggttgtaagaaaggtactcccatataataaatggcctcatcttttcgtttatatttatacttatcagccaaaatttgaattttcaattttgaatttagagttgattttgagtttttttttatcgtggtttatttttccacctttgtttttagatcattaagaacacatgtataaaagttttaattcacaaattattttttatttgtaaatataccgtttcgcttatgcttataattagtgaaccgatgggaccaaaaatatcaataaaaaagtaaatcatgcatgatactattgtagaaatgtctataacaaacgtgcggggcatctctaacaggtcaacatgtgatccatttaagacaacctcatctacgagagggattgagaactagtggcaacatatcatacgtacataagctctcgcgtgtacacacgtgcacaccaactaaaaaatatcaccaaaaaatatagaaaaaatcatacacgtactttcaatagtattacacctagggttaaaatcttaacttcaaattcattacattttagccgtaaaaaaaaaacaaaaaatctgacagttttaaggttgcaattttgtcagaattttatcttttttgttattctctatgtagaatgaatttgaagatgcgactttgcacgtagatgtaatactattgaaagtgcatgtatgatttttttagattttttttttgataatttttagttagtgtcactgtctgtacacgtaagagcctgtcaccccacgaaggagaaaaaaaaggcagtgcaagcccgaccatctaatggtgagaagacagtagcaatgacagtaatagaggatagatctggtcgcctcaatcttgggagcaatggataaggtgactcctctttgggctccatctaatgtctccccttgctctccgaattagcatcaccgccatctcctcctcttctctagcaccacagcctcgcccctgccccccgttagatccggtctccacacatctttagagtcaggctagcgagtgtggactggaaaatcttcaagactaggactggacttgcttatacaaattgtatctcgaaattttcaaaaaaatttaatagtatctaaataatgtgaatcctatatacttatatagttcatccccaccaagtgtagttaatgatatctctctcttctctcattaagccacatcaccccaattatttctagcctttggatgaaagatctatggtctaaattgtgtcttctttcttctctcataaaacataccatctcaattatttttaggttcaaaattgtatcatattgttttagtttcgataatcaaattacattttatttgtacatattatgcaatttaatttttcgcagcaacacagcggggtattcatctagttaagaagacaaacctagttctcaagccctagatgcactatgtatgtcttcgccccttggatcgaagtatcatgcatatacctgaaaaggttgatattgtgagttttatcggctggatttgtatttagaagtgttaattaacaaataaatcaattatcaaagtttgatattttatattttaaactggaaaaaaaaatacttctcttacactaagtcttgtgagttaatttgtacctctcattgtctcatcataattggtctatacccaattcaatgtttagtgaataatatttttaataagtggctctatcttcttttatcgcaaagagccaatgtaatttccgttatgtaaaaaaaaagagttaatttgtgcattttggaagatttgtttactgggccgaccctaaggcgaacacgttgggctgctaaacttagacccaaaataccaatgggccatcatcatggatcgtcatggaacagagcaaaccaaaccatcagacaaaaccaaagctgttcttcccggctaattttgcttcgctgatcaacaacacatgacaataacaaaggcaaggtaaagaaacaacaattaacaggaagaagatgagcttgaggcgatccatggtgggtcgtcgtcgtgttcagcacttgctcgccggcttcaccgcgccggcgccgccaccggccgcctccgccggcttcccgtgcagcacgctggtcgtctccgacgacgccgagctgtacttctcttcggcggcggacgacgccaccgacaccgacccgaccttccagtacttgccgtcgccggcgcaccacttgccgtgcgccgccgccaccgaggacgccgtctcctcgccgtcggagctcgacacggaggcgacggccctccagttgctccacatcctgagcattatgtacagcagcgcgacgcacaccgcggccgacacgacggcgatggccgccacgatggccgacacctccgcccccggcagccgccgcggcgccccgcacgacggcagcggcgcgccgcagagctcgccgttgcccgcgaaggacgcggccgggaacgcggagagcgcgcccgggatgccgccggagaggaggttgtcggacaggttgagaaggtggaggctcgtgagctgcagcagcgagggaggtatctggccatggagctggttggaggagaggttgagcctctccagcttgacgaggtctccgagcgacgccgggatctcgccggagagcttgttccggctcaggtccagtatcacctgcagctccggcagctgcccgagctccgccgggatcggcccctccagcgagttctccgacagccgcagctcgtacagcttgttgcatcgccggagctccggcggaatgacgccggtgaagccgttcttctgcaggttcagaacgttgagtgatgtcagcttcccgatctccggcggaatgctcccggagagacggttgccgctcagggacagcttgagcaggccggagcagccgccgagctccaccggaatgccgccggtgagcgcgttcgacgagaggtccagctcgccgagcgaccggaggcctccgagccatggcggtacggcgccggtgaggctgttcccgtcaaggttcagatgggtgagccgcgagcagttggagagctccggcgggatgtcgccggagaagttgttgttcgagaggtcaagtatcttgagctcggtcaggtcacccagctcggccgggatcgcgccggcgaggcggttgccggcgagctgtagccggaccatgcccgtcgaccgcgcgaccgccgccgggatgacgccggagaagctgttgttggtgagggccagcacggtgagggagctggagccgaggagcggcacgacggcgccggtgaaccggttgtgggagaagttgatgaccgtcaggttcttgagctcgaacatcgactccggcaaggcgccctccagcgagttgttgtacagggtgacgacgctgagctcggcgaggcggccgaacgactccggcagctcgccggagagccggttgtccgccagcgccagcgcctgcagactcctgcattcgccgaggctcgccggaatcgggccagtcagatcattctgccggagctggagcacggcgaggttcttgaggttgccgatgctcgccgggatcgggccatggaagtggttgccgaagaagtcgacctcctccaagctcgagcagttggtcatctcatccgggatggctccggtcatctcgttctcgtagaggaacagcagcttcagcctctgcagccggccgatctccggcgggatgccgccggtgaggccattgtggtacagagacagcacctccaggttactcaagttcccaatctgcggcggcaggacgccggcaaagctgttgttgtgcagcgcaaggttgacgaggcccggcagccggtcgatcgccggcggtatctcgccggtgaggctgttgttcgacacgtcgatggacttcagcgaggtgcagctcagcagggcatcaatgctgcctccgaggtcgttgccggcgaggaacaggttctccaagctcgagttgccattgccattgccatcgccattgcagaggccttcagggatggttccctccaggagattttcagacagcacaaggtacttcagattcttcagctgtgatgcagagatggcactgatctctccggacagattgttcttggacaaatccacaacctgcagctggctcagccggttcagttcttccgggatgccgccggtgaggcggttgccgagtaagttcaggtatgtcaagccggagaggttaccgatctccggcggaatcacgccggagaactggttgtttgcaaggttcagagactggagagagctcaggccgccaatggaggaaggtatgacgccatccagcttgttgtcagccaccgagaggacacgcaggtttgcacagccggcgagctgctccgggaggccgccggtgagggtgttgttgtccagggccagctgctgaagctgcttcaggttgccaatctggtgggggatggcgccgatcagctggcagtaggccatgccgatcgtctccagctccgagcagtcgccgagctccggtggtatctcgccgcgcagcgggttgttgccgatcctcagtaacttcaggttcttgaggccgccgagctccggtgggatggcgccggtgaggaggttggagtgaagcagcagcgtcttcaggctcttcatcgtcccgagctccggcgggattgcgccggtgagggaatttgacgacagatcaatggactcgacggatacaaggccggctatcgccggcgatatcgtgccggacaggccgtaccccgacaggttgaggccggtgacaatgccctcccctgtcaggcacgtcacgccgtgccatgagcacacgtcggcctccggcgaccagccggagaggacgccattagggtcagtgaaacctgacttcacttgcaggagagtggcagatgttgtgtctactgtggctgcttcacatgatggtgcaagcaggatgccacagaacagaggtagaagagcaagaacaatggaggagctgatcagcttgccagccattgctaagaccaatgataccatcaactgagcaactgaagcagtgttctaagatgcatatgaattggaacttacaggatgctggaactctggagatgacaaggtgagcatgaaactatgaactccatagctgaggtttggaggctcatcatgtgcacaaagtaggagcctaagctgcaaaaagcagaaacaaagttgtcaaacactacctgctctgtgcatatcactcagggtaatgtgatggattcttggtactgaaaatgcaacacaaagccaaaggagaaggtatagcactgtacactatctcttgcagacatggagtttacaataatcagcctagacttgtataatgcagggctaagtatgaggtattttaaaggctaatcttgttgctttgacttgttagctcagcttcttctgcatggcaactggtgacaaggatgaaaaaagggcaccgggaatcagtaagatacactgccactttacagagtgtacgtgcgtaaacagttcaaccactccccatgatttggtggcatgaggacaatagcatgacgcttccatccttattccttggcttaatagttttctaactcaggtttagtgacagaaaactaataagattcgtgcttaccctgttcatcgattccgaagtcgatatttttgctgaccctgcaaacaagtacacggcatgaaattttctccttgtcagcctaatttggcaccgatccaccatgggaagtactggcagtggcagacagtctcactacaagaaaattcagaaaattgaatgtgcaatcaaccaagagagcatacagtaatacgattatgatcacataacagaaggtaaattcgtatatagatatatggtatttgtatctgaatagaccacattagcagaactacagaaaaggactaactaatcaccaagccagcgagacacacatagtggcattgttttcaattatcaggtagagggaaagtgacttttgcaggggagtgacaatgacaggaacagaattgcatcaataaaccacacgaaacaaaggcgaagggggcggagaaaaaaaaaagaacagaactcacagtaactaccacgatagttgcatatccaggcccccatcacaggcagaactgcagcagcagcatgcatgggacgcaccagctcgcacttttctttgtttccttcagttgaactgcacatagcagagattcccacgtttaggaaacatccaaccagatagagacatcaatatggctatccggttatctactattgcctactggcttctaaatcctcatgatgcacaacgacacactactttctggttcagattttcagagttcagaccacattgtggtacccagaatttgtaactaaagaactccttttccaactagattatctactcatttagctgtaaaaccacactagttagcaacgcatgattgaaatttgagtaaatattagtcgaaaggccagcagatgattggttgtgactcaaagcctacacaactacccgtcgtttcggtaacatgaggacagtgatgtgctgttggtgcaatggttgcatcattggtctacgattgactttctttgacattcaaacaattttagtactgggtcctgattgatctgggtttgacttaagcctgcctaatactgtgctacttgcttgtacgcttctaacctgcctaaccacaggatttgagatccggatgggacatgagtcaaaggacaaatgtgggtgtagaataaagcgcccctttccttcttgctcatctcaaatgaactggttaatttatttagtattagaaagagtatcacttcaatataagatgttgaaaaacgagatggtatatttaagcgaaaatcacggacgccaggacaaacattcttggacaaatggacatgtccatcatgctaatacatcactgactacttggacgtgcatgaaccttaccctcgtaaactcagctaaagaaatactaatatgactacattcactagagtgtggacatgcgtagcattgttagtatatttggatcatgagaaagaaaaggttagtgttcatgatctttatcaagatgtaaactgatgttcctatgttcctttttacttgttgtttcggatattgatacgttctccaatacgcatactccgtatttgattattacttttttattatatgttcatacttcataataactatcagaaacataatggtgtgtgtttttcatattggaactacatgttattttcatctgacaaatccaaaaactatttgcatacatttgcatctaaactatttaagggttgactatacgcattttaaactggcacctattaagaacaggagtataaccgattttaattaatagaaacaaggcagggagtttggagacttaagagactatctttttaattaaaaaaagcaatctaaaaggcacgataaaataagacacttaaaattatgaaacccccagaagcacgacattcctctgaatcttgctctaatttctccaattattcgactttcagtcattaaattaaacttcgccggggttcttccggacagctagctaggccccagcataaccattttgtcttccctttatttattcataactttgttttcaatatggaatgattaataatttgagtaaagatcggctaacctctgcaatggcgagcagggatgcagtgcagtagggtagtttgcacgacaaatccgtggacgctaaccttaaccatgtgcataggatatagctcatcagtctcactttttcccatgcaaccaatcagatgcgtgtggacaccctttcctgtaaaaagtccgtctcctttcaggaatctgccggtaaagctatgcttcccgggatgccgatgattaaccaattgacttgagaacattcatagcagaagatgaggcaggctcctgcatgacgatcaatcgcttgcaatgcaatgcatggagagttgacagtgtgcagtgcaggaagggaaaaaaatgaaaagctcaagcatttaccaacctgtggtgcgtgcctgctcctatgacggctcaatcagcggcatgtaaggagacaatcgagttcggcagagctgcgtaggcatctgacatttcgtcgaaaaccatgttgagtttcacacagaggcagctcccatccatcagcccggtttcattgtgaattccgcaaccctcatcatgcttgcgtggccaaatgccatctgaacatgcgccaatcttcatctcactcactcactcactgcctagcaagcagtgtggaatagcagcagatcagttgcctaatctgtggaacactggaactcgctgtgaacccatggccaaaagtgagcttgaggttgagcttggggtcaatggattggcgagttgtcaagtgacagacttattccggttgcacttaaattggtgaattggtgcttggtctctgcagtgagcactcagctgccaaaaaaaaaaactccgacatgcatccccggccatgagctgaaggattccatcgacggacaacggcacagacgccacgctcgagcagcgcgaccacccccacgggaggagaaagggaagtgctttcgcggtgctcgaagcctccgccacacacgccggcgcctccaagttctggacgctagttggatgggcgcgcgcccgcttcgcttcggcgccataaggtcgaacacctggcaggcgtcaggggcaggaggcttcgggtagtccaccagtggaagaagaagaagaagagccccctctcctcagacaacaccggctcaaaacaagcggaacccgtcgcgagacgacctccgtgctgccgccgccggacgccgagctgaagccgggaaccatctgccgtcgccgccgccgcggcgccgcgtcgagcagaagaacggggaggagacgacgccgcggttacaggcttgcagtgttgggccgggccgagacatggtgtacctggtcattagattacggaataagttcatctgtggtccctaacatgtcaactaatccgattttcatccttcaaccgaaaaatcaggtacaacgggtctctcaactgtcaaaacaagtgcaaaataagttccaaggtggtttggacagtggtttaagctgatgtggtgcctgcatcgctaatttgactcggactttatctgacgtggcattgacgtggcgcttacgtgacaatttgatttgaaaactttaaaaaaatgtgtccctacatgtcacttacaccaaaaatttaattaaaaatggtgtggcccacatcggccccacatgtcactcacatccctcctattcttcctcatctctccgcatctcccctctcttcttctctctccctgtccacgattcatagactacccagatccatcgtcgccatcaccatcggcgttgaaccta

SEQ ID NO: 23787 - DNA, 5040 bp, Oryza sativa
aggaaggtaggccgaggaatggagacacctctaggttcaacgccggcgggtctgggtagtccacgaatcctcgacgtgaagagagaagaagagaggggcgatgcggagagaggaggaagaagaggaggggtgagaatgacatatgaggcccacgtgggcctcaccattttaattaatctttttggtgtagctgacttgtgggggccatagtttttattgttttccaaattaaattgccacgtaggcgccacgtcagcttaaattgccgtccaaatcgtcttgagacttattttgtaccggttttggcagttaagggatccgtttgtatctgtttttttttattgaagaacgaaaatcggattcgttaacaagttaagacacctcagatgaacttgttccttatattactttgattcggcccagccagacgcactcacaagtcgaagctcatctgactgggctgtataacacgtaggtcagaattcagcccgtcatatgtagggttgatctggggattatcatactcactcacttatgcatacgctttcattttgttatacatttgtcgacaaaattttcttctaaaaatttgtttgatgtaattacattataattatagtgtaataagttacagtgtaattacatcatgattatactataattacatctattaaatttttaggagaaaatttgttgacaaatatataggtctatgcttttacgaaccacttattactaacttaaaaaataatttatagtaaattttttatatacgtgtccatttattattaacttaaaaaatagcttatagtaaaatttttatatacgccatgttagtgattataaagcaaattatataaaataaactatgatgaaaaaacataaaattaactataaaattaaattttaaaatttaaatttagtttacaaacgtaaacataaacgaaatgatggaacgggtaaatgactttgtccttgttcggatgagcctgaatccatctcaaagacacaaaagtctatatactttcgtaggaaatagtaatagaagtatttttcgctttcttaggatagagaaagctgaaagcatcttctagcttctacaccgattataattaagcacgcacatcgtttaattatggatatcagaattttaaaccgaatgatagattcgtgtatatctacagctgcaccatcacacacactagctagaattttttgttcaacgactgatcgatccaatactttcacacataactatccatccctttcaaaatataaaaacttaaaatcagaatggtctagtgttacaatatttgtaacatatatattcttataatttgggacgaagatggtacaacattaattttgctttacaaaattattacaaaagtacagttttaggaatccctttttttttttttttactatgcacaagcagtcaagcagagacagtcccagactcccagtcacacagcaaccgactttacagctgaccgagacatacgtggggaaatcgcagctgatcagccatcagtagtagctcgccgccgttgcgacgggctgcggtggctgcggcggcggcggcggaggcggcaggttctccctgacgacggtgacggggcaggtggcgtggttggcgacgtacgtgctcacgctccccatcagaaccctacatatatatcaagcaacaaattaattaaccaaacaaattaaacaaattcctcgccgtgtaattcagcttaccgatcggctacgtactagtactttattagtagtacttcctccatttctaaatatttgacattgttaatattttagcacatgtttaaccgttcgtcttattcaaaaacttttgtaaaatacaatatgtaaaattatatgtatacatataagtatatttaacaattaatcaaatgataggaaaagaattaataattacttattttttttaaataagatgaatggtcaaacatatttaaaaaaatttaacggtgtcaaatatttagaaacggaaggagtaggtactatcatgagatgattgatactcatgatagatatatgtcccattatttcctaattaagtttccgctaacacaccttttaacttgctaaatactctagttgaaaactttttatataaaaaagttgatttaaaatattagataaattcaattttaaaatatataataactaaaacttaattaattatacgctaatatattttcattttttatgtcctaattttatcttctctttaatagaaacaaacaccaccatacagagagagatagagatgcatggatgtgcttgcctcttgacggcgccgaggcctctgttcccgacgacgagccagtgcaggggaatcccctgcgccgcctccgtcagcttcttcgccggctcgccccagtacaccttcgccaccacctccacctgcatccatccattcatttctccagtgatcatcgatcgatcaccaatgggcattcaatatatactactaccacacaaggattaacagacgatcgaacagtaaaccattcagtatatatacccctttctggttggcggcgctggtgaggattccgatcgtctccgcgtccggcgcgacgccgtagatcctgctcacccgcgggtcggccagctccaccagcgggatcatcgctgcactccggccggtgaggaatcgccattagcacgcgctagaagaaagaaattaaatactccctctctctgctctctctccgtttggtattacaaagtcgttttaaatttgtttctaattaattattggatttaactaagtttataaaaaaaatatattgctatatctatagcactaaattagttccattaaatatgttttagtgatacgtttgtttcgtatgttagtattttttttatatataaacttaatcaaatgttttaaaaattagctataaaaaaaattaaagcaatttataatactccttccatctcaaaataagtatagttttaccctgttcatgacgtttgaccgttcgtcttatttgaaaaatctttaatttgtatttttattgttattagatgataaaatatgaatagtatttttttaaaaaaaattcataattcttttttaaataaaacagacagttaaatactagacgcggatatccacggttacccatatttgggacggaggtagtataggacagtggtagcagtaagcttacgtgagccttgctgctcccagaggtgggcgacgccctgctcgtactggaacgagggcttgacgtggacaagcaccagccggtcgccggggcgtgccaggctcgccgccgcccaccgcagcgccgccttgctgcacgccgagaagtccatcgccaccccgatgttcctcccgccgccgcccacgctcaccgccgccatcctctccctcgctactcctcttctcgatcgatctctcatacaaatcataattaattaacctctcagctggttgttagctagctagcctgcaggtgtcgttgcagctcgatcgcccagccatgaagctatatatatagagagagagagattaattttgagctagatgattcgcacaatctctcctagcttagctagcttagctttgattccaattttccaagattccatgcatgcactcacctttaatttacggctttaccggattccctcccggcgccggcgtttctagttccgcggcgacgtggcggcgaaccggcggcgcgctcgctcgatcgatcgccaagtcaccaaattaaagcggaattgagcgaaagatcgagacgggtgtagaggataagcgaagaggtcaactaattaatcggcaatcgagatcaaacagctgaaaattactcccttatttacttaaatgttcgatgctgttagatttttttaaacatgtttgaccgttcgtcttatttaaaaatttttgtgaaatgtgtaaaactatatgtatacataaaagtatatttaacaatacatcaaaggataggaaaagaattaataattacttaaattttataaataaaataaacggtcaaatattttaaaaaaaatcaacggcgtcaaatattttatataggatggagggagtagcttttgcggcgtcggccacgacgtggagaagaagggacatgagttggccgaaggaaccggattcgatcttttcatggagatgagaatgcaaatatgcaattggatgatgtaatggctgagctttctgagaaaatctgaattagattaattggagatgatgtgtaggagatgagtacgtgatacgtacatgatccactatgtaggggtgagatgagattcgaattgaattcgatcgacacaatccgctggagaagaagattaactagctagggcctagctaggagcaacaccaccggcggctcgccgcaaagcaaaaaccagcgtgcttgagtgagaacggttcatacaagggcaattcgtcaacgaaaaccgctccctagtgttttttttggggggacaaaaacagtgaaacttgaacaaaatttactaaattttgaattcttttttgaacttggccaatttatcgatagtttctaaacccgagcagttatggtcgtatttgtaaacctaggtgtgtgtaattaagtgtgatgtgcgcgcgtctaaaagattgttttaaaaaaaacagaatattgtgggctcaattatcaatattaccataccggcattttcacgtggaataagtttaccggaggtccctcaacttaacagcgagattttttttgaggttccttaaccacaaaaccagaaatttctatgtacccctaaattcacacaaatcgtgcactcaaggttctatggcagtatatatgggtgttttcgctgacgtggcatcctagtcagcaaaatatttttaaaaaatacatagggcccacatgtaagctgcacattttttttcttctccttctattctcttttctctcttctcttttcagtgagggcgcgggcgcaggcaggcttcttcaccacccctatggcagacgcgggggggggggggggggg

SEQ ID NO: 23788 - DNA, 37396 bp, Oryza sativa
cccccgcggcaaccgtgagaaggttggtgcttcggtgggcgctggcgcggcgggaggagttggagatgagcggggagtagggggcgaagccgaaggagggcggccgcccacacccactagtcgtcgcacacccggtgatgcggcgcgcacggagcgaacccccgccgcacgccctgtcccccattgcctcgccgtccccgtcgccgcaccgtccttgtcgtcgcgcctctcccctcccctatttcctgccgactgcctcccctttacctcctcctgtcacggtgctcgaggcgacgccgcattccggccgccattcctccatccatagctctgcccgccaccggcctccctcactgaagaagagaagagagaagagagaaaagagaagagaagagaaggagaagaaaaaaaaagtgcagctgatatatgggccctatgtactttttttaattttttctgactaggatgccacgtcagcgaaaccaccaatatatactgccatagaactttgagtgcacggtttatgtgagtttaggggtatacagaaatttctagttttatggttaagggatcttaaaacaatatcgctgttctgaggttgaagtagaagagaggatagagttgcaggaactgctacaggaaattcaattgaaggaggggagagataaactgagatggatcatctgttttttaagtgcgcttcggctagatttctttggtgctgcttgagagacatttttgggatggagcaatgttcccaggacaagagctgagatgattgagaaattgaaagaccctggcacaaagaacaatttgccttacatttgttttttttctgctgtttgctgggccatctggcttggaatgatttcgtctttaatgataaatgtctttcgggcattactatgattgctcataaggtggtgatgttattgtaacagtggagtcctttggtggcgcagaagtctactggagaggtggagcacttcaaggacttgctgcgtgccagaatcaaggagttggacgagaaaggaacaagctgatgctcgggacctgttcaaggaagaagatgcattaggagtacagagtagacagcagtttcgtttggatccaggcgatgcgttgttgttttctaaagtttctttttcctggaaggtgttagggtgatcttttgtcagttatatgttgatctcatcttcagttggaaaccccaactctactacctcccctttttcttttgagatcttttaaggtgcttgggaggtactcagcgtacctttcaaactattgaatatcaaccgttgattgctaaagatgaatttagaaatagaaaaaacacgacgatgggtaatttagtaattgtttccagttctaacaacttctaacttcttcctgattgtttgccgctagcccctactctattaactgttgctcttgtattactttcgctcactaattctcatctctcgctgttgttgcttacattattacttttttttcagggacattataatagttacttattaggagataggaatattacataaatctatggtcattcacagtatcacatctgctagtcttttgaaggcatttttcttctctatcttttagataacctgagcatgccggtgtcgaccacgtcttaattaatccatgaatgagctaccaaaacttcaaataatatgacattccccgttctgtgtagatcaattttcataacaaaataaatccgtaattgttcacaatttcatgtaatccatattaaaaacttcgtaacgaaacaaattcgagaagaatcgaagaacttatatatgttacggtcatttccttttcatatctgatagattgatataataccaggggacaaaattacctatataccctcccacttaatctctatttttatacctgcccacctttttttaagtaactttctatgggtaccttgtatcgtaaaccattggattgtacctaatcaatggttaacgtgattttcaagtaccggagaaagtctcttttcttttttctttttcggttccagtctgtaatgaactctgttatgctttgttagtaaagctgggcggaaaccctttgatctaaaaaaaatatcgctgttaaattgaggaacctccggtgaacttattccttttcacgtgaatggaccgggtttcgtgggctttcaaatcgaggcctagacgtgaagagagtgtgggcctaattgagtaaatatcgtattgggccagtgggagaaatgggctggtcaagttaggtcaattggagacgggcgctttgggagtcgggacatgtgtgtgctagaatagtcggtgcaaatcatggaaacttcacgtgccactgtcagctcacaacgtggtcaccctccccggcctcttgctccctgctcatcttggatctttgattttaaccttggtttatcgaatggtttgttaatcacttttgctaaatcgtgtggtattattttacatcatcgtattaatctatttttcaacttttttatgttgatatttagggcatgtttgattggtaactaaatttatcacataaaatcttaggtaagtcataattttaggaaatgtttgtttttttcctgccacaactcgatccacatgttatagagtggactatatttttatctaactttatataagtttagtttgttactccctccgtttcaaaatgattaacaccgttgacttttttaaacatgtttaaccgttcatcttattaaaaaaattaagtaattattaattcttttcctatcatttgattcattgttaaatatatttttatgtaggtatataattttacatatttcacaaaagtttttgaataagacgaacgatcaaacatgtgctaaaaagtcaacggtgtcaaacatttcaaaacggagggagtattttgtttatcgtaaaagtacagtaagactaaggttgaatatgtgttaaattaattacgcggtaaagggaagttattgaaacgatttgatgaaaaagttggaagtttgtgtgtgtagaaaagaccatgtttagattttaacttttttttcttcaaactttcaacttttccgttacattgtttcaatctcttcaaacttacaattttaacgtgaaactaaacacatctaaagtttgatgtgacagaaaagttaaaagtttaaagaaaaaaagttggaatctagacaggctaaagagtcggttctgttttccctgtcccagctttgaagctcctcgccgaagtggccaaccttctcgcacggtacaccgtacacatcgccaccgtccatcttccgatccgacggcccagacaccacctgtgatctcccccgaccccgagccgttgccgcgcggcggatgcggcggctgcgtcgcccctcccgtgccggtagctggcgcgtccacacttcagacactccaagtccaacaacttaactttcacttcacttgccttgcctctgccgcgcttgctcggcacggcaacccacgcgaaatcggagattccttcgattcacgagatcaccacgagtccaccaccctcctcctctcgctggattcgatgggcgctcggtgagatccgaatcccccacggtggtcgccggagatgaagccgccgcggaggtggatgtacgggcggggcggcgggaaggggaagccggcggggctgctgctgctgggggtgttcctctgcttgtcggtggtgctgctgctgctgctgcacggctcgtccccgtcgctggagggcgaggggaggaagcctgaggcggtggaggcggcggggggagggggagaggaggaggaggtggcggtggcgcgggcggaggtggaggaggcgccgctgccgccggggaacgcgcggctcgccttcctttcatcgcccgcaaccgcctcccgctcgacctcgtctgggacgccttcttccgcgtaagcgcgcgcctcgcccggatctcccccttcctctcgctcttgctcggatggctcccaatttcagcgaatgctggtttaatttgaatcctgattgcattgcgttttttgggggtgagtagggtgacaaggaagggagattctccatcttcgtgcactcgcggccggggttcgtgctcacccgcgccaccacccgatccggcttcttctacaatcggcaggtcaacaacagcgtccaggttcgcgacctcgtccccacttccgttggcaatgtgatgtgatccgtcggtagcagcatccgttgcagtccacactgggttcctgatgagttgggcatgtgtgatttgtccttcaggtggattggggggaggcgagcatgatcgaggctgagcgtgttctactcgcccacgcgctcaaggaccccttaaacgagcgcttcgtgttcgtctccgacaggtatggattatggaattatgatgtgtgctagtgtgtatgcttggataaagtattactgactttagatactaagttgattggcacaaaattttggcaatgcccaaaaaatttagtcatgtgttctgtttatagccaaaaattaagcactactaaattatttgtcttggttgaatagcaaatgcaagtttagtagaagcaaatgaatgcctagccagtttttgccagaaaatttggcaatggccagttcttgccattgccaaaaaaattggtaaggctatgaaccaaaacaagccctaactgcaatctgtgttggcttaatctcttgttcagcacaatgtgttgtttctaggttctgatcataatgaattaagggaatgttcctgaacataatgatatgtccttacatttttataaatgtggactgttatctagtaaagattgtttgttttttttaatcatcgtttggctaactaatttttttttccaatatgcaatgctcagatgataagtagtttctgtccgcgattttaagctcatgctaaaaatgtggtgcgatagcagtcctcaatcttaaattccatggaaatgaatcttgtgttatactgttagtctgtttctattaagtttaacgggactccacatgaagctgtactgaatttaccagatgccttggtgcaattttaggtatcgtttacacggttgtttttctgacagctccaaatttgaacttagtactacacatctttttttataatcttacaaagctcgttgttgcaccattttggatcttaattggattcatgcttactaggatcttctctctctgccagctgtgtgccattgtacaacttcaactacacttacgactacataatgtcttcgtcaaccagttttgttgacaggtataggcatcacaatttcgtgttgtgtttcctgatgatggttaagacttaagaatgaattctgagttcatgacaagtatcagctagtaactatgaatgttaaagaaaagaaagaaaaaaaatcatgttagcctttctcattttccattatctaagtatttccatgtaccttgagcttcaaaatggttcctgtagcaaactgcagatttgcagcttaaagcacctttcatttagcttgtataatatcctgggtattaacagcatccaattgcatatgctggggacagttttgctgatacaaaagcgggtcggtataatcccagaatggacccaattatcccagtggaaaattggagaaaaggctcgcaggtacctttctgtttctattgatgaaagataggagaattttgcttgaactgtgtaacagttagttttgataccttatcaccattcatttgtgccatacagtgggctgtgttaacaagaaaacatgctgaagttgtggttgaagatgaagaggttttgccagaattccagaagcattgcagggtatgtgactcaatatttatgcactctatgcagataaatttcagtattgtataacatagtttactcatgatcataactgaccagtgaactttttcaccttgtacctttcatcaaattaaaatcaggataacagaagttgaaaatttgaatattatcaatatttacttttttatgacagttttttgcattcgcaagtgaatgtgctctcaagataatcaacataggacacaaagaaacttgtagatttatgtaaactgccacgtatggtactgacattctgacaatgtttacgacaatgcatgatatcagtgatttattttattttattttttaaacctttttaatttttatttttaaaaataaatcattcgaaaacttatttccaagatctaaaccttttggccgtagttggttggcaaaacaacattgccacaccggtctggctggcatggcagcgttgtcttgccacaccaccgtggctggcaggacaaaactgtcacgcccgttgcgggtgacgtgtcagtgttgttttgtcacaccaggcaggctagcttggctaaaaggttcagattttggaaatattgtaaaattgtcatgcccattgcgggtgacgtgtcagtgttgttttgtcacgccaggtgggctagcttggccaaaaggttcagattttaaaattaaaaaggttaaaaaaataaaataattcgatactagtacctttgccaaatgaatagaagatccaccggatttttctatatcatcaacccaagttacttaactcatgtctctttcctatcaattagcttagagttgtctattcttgttcctattaaatgtacctttttatttattgcagagaaggcccttaccagagttctggcgggactgggatcgtcctattgtaagtgaaagtctccaataaaatactgaactgtcacttagcttgttgaacttgcttttatgtgtttatttttgaactgcagctggcacattgagtataataatcacaactcttgtgctatttcttgtactccataaaaagcttaattaacagaattattatctatggcttcaaaatttaccactgaactctatatctctatctaattgctctactgttccagaacaaagtttaattagtaattctgtgagactaaatgctgctcattttatccagcctgcggaggcatggaaggcacataactgcataccagatgagcactatgttcaaacattgcttgcagtaagtcaacaatcatttacagtatcccttgcagctgttcctcctcacaaagacatctgaccgttcaattatttttatcgaatgcagcaacatggtcttgaagaagagcttacacggaggtcagttacacacagtgcgtgggatctatcatcttctaaagatcgtgaaaggcgtggatggcatcctgtaacatacaaaatctcagatgctactcctgcacttgtaaaatccataaaggtatatgtttctttgcaatggcacattttttgttacctgaaagtggtgattatatagtatgtacatttaaaaaggaaattaagagaggctttacttttttttcttttatttgaaaattctgtcattattaaaatatttaagtacaaagcaacaaccaaggtgaatgttggaacctctgttgggtaatggcagacgctatcaattcatctgtttcaaagctttaacaaatgtcagtttggaaatgtgttgcgtctgataaggaatgtcagcttttgtttgtcatgtatacagttctgccaaaacaagctgcccgtacgaaatgcacatgacattttctaactattcactgagtacctatttgttgaatttttaggatattgataatatatattatgagactgaaaatagaaaggagtggtgtacaagtaatggaaaaccagcaccttgcttcctttttgcaaggaagtttacacgagcagctggtctgaagcttcttgatttagtaagttcaggacctttagcttttcatttcatatcgtgatgcaaacacaggcattcctaaacctaatgtattgtctaacgaaatcacattgtgatttgcttatagtttttgctctctccaaatttcccttttgcagtctttgatagcagcaaatggcgcatctaccatgtaaagtttctccgtcaaaagcagaatactgccagcttgcacatacgtaaaggaaagtggtggaggggacagaagataacagcgaattttttttgggcatcttcattacaatttgttgcactctgaaaagggacataggtgttctaaagcaataaagtttgtttcttttagcacctaggttagtacatatgttaacccactacttagcattataactgtaactgtaagcaaccacctgcagttggattggcaagaatcacctcagttcttttcacgacaaattcctttttcaaatttatagagaattggcatgtcttatacttgcatgcatactgtagtcattccatcgaaggcaatgcgtgatctggttacccaaacattaatcaagcatgttgaactcaggaactgcgtatttcacatggatttatactctcatagcagatctgccgatcaacatgcatgtttggcattctgttccatcagaaacatgggaccctagtgccgtggcaatggttatcccctacccttaggacctttggacttttgatggcctcaatttaaaactgtgctggctggagatgcagcgatggtgtagccaattcaatgattctcatcattgttgttcctccaattgatgtgttacttcttgtactcacaagctctggggcaattgtgactgtactggtatagacttaaaacagtattcagatactgtactctctactgcatactggcagtatcaatgtggggccatccatgcagtgcaacgtcatcaggagggttgctggcatggcacctgaggtggtctcatctgcacacaaacactgctatgaactctagattcaactctagattcatcagactactagctttggatccaaagagactatcaaatccttccatgtccagtcacatttgtccgtgcacttctgcatgcatcagttccatctgcttggtgttttgcttctcatgtcagattcccccaagtcgcacattatatcatgaagcattttattttttttcagctctcccttttctgcatagatctagtgcaatgtatagtatttatgttataatgttgtggtgccaaatgacaagaaaaggaggagaaaaaggtagaatgcgagcatatgcatgttagttgcttgagggtaagcctggtgtccctttcaggcattgcattgtcactgtcaatgtgctgcattgtccatgctgtctgcaagtgcagttctattgcaaagatgtaggagtactcgcattgtgttcacaggatttttgaggaataatgtgcatagaaattcttttttcctatcattcggattatggaaactggtcgtaggaaatccaaagaaaagtttcctttgatgctgattttacaggaaagtacaggaaaagtccatccaccttagaggtgtccaaacgggcggcacggcccggcccggcacgggcacgggtccggcacggcccggcacgggcacgggtccggcacggcccgtttcggcacggcccgttaggcacggctgatgaaacgggccgtgccgtgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgttttttttaaaaaaaaaaagcaaaggaaatgtataaggaaaaaaaattaaaaatggaaataaaatgtttaaaaaaaagtaatgatttactaatgttaaaaaatgaaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatataatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgtagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaatgttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttaagaacaaatagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttaatgccacgtggcgccttcccattcgaccgccgccagccctgtccgcgcctgacgggccgccggcgtgccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctaatccacctcaagctctttctttgcttcctgcgtgcaaatcctaggcaattgacttcctatgatccgaatgctctcaacttttgtattcctttgtttttcatttcattcctctttttcacgctttgattcttttcctattcctatacttttcctatcctatattttctttccctatcctatgatccgaacgagcccttaggcgttaaaggaggaaagggtttaacatttgagagtaacaagggatggcgtgagtgtggtttcatggtttgtggctgcccatgttcttttgttctgaactttggaagcaggtttcagaattagtctgatgatgagattttaaccagcacttattgcagtgcctcttttttctggggatggcacaaaaaagggagtagagcctcttttttttcttcgtctttttaccggtagtatttttctgacagaagtgaaataacctggagtttctgccccagttttttacagcaagaatacaggcatcaactcaagttttattgtctccaagtcttcaacatctgtgctaggtaagtgacagcgaagtttatgcagtaccttgacacctgagaagttgatagcaccattggttttacctggacttttgctcattacagttaattaaaaaaaccattgggttttgcaagtttatatggacaggataacgcaaaaaccagaaaaggaataaaccttgaatcaactgaaatacatctaagatggaactgaacttcagtttcattagttacaagaattagtttgcatatttgaccttccaatagtaccttcactgcaccagagaccagactccagagtgatcccctagtttgcagaatttccttttgcatactccaacaattttacacagctctgcaccgacataacaccagagacccagagtgacagcctgacactcatggacttaggagactaaacccaagcaactaagctagtgttccatttttttattaagaacaagaagaatattaagttaagctagtacttctactggttttcaaatgtatatgctgttagggataaggtacagcatgccatgaagttaacaccagacagccgttttagccatgaaaagaagttaagaagcatacaaccattttcaagacaaaaaaaaaaaaggagggatgaaatggtccgatggatataagtatgcatagcgaacatcactgcattctaaatccattcttttgatctgtacagaatcttgttggtagaaatagaatggagtactgctactaatcttgcaccccccacattggcatcaacaattggtatcaactgaaatacatctaagatggaactgaacttcagtttcattagtacaagaattagtttgcatatttgaccttccaatagtaccttcactgcaccagagaccagactccagagtgatcccctagtttgcagaatttccttttgcatactccaacaattttacacagctctgcaccgacataacaccagagacccagagtggcagcctgacactcatggacttaggagacttaacccaagcaactaagctagtgttccattttttattaagaacaagaagaacattaagctaagctagtacttctagttttcaaatgtatatagtccacctataaactgctagggacaaggtataacgtgccatgaagttaacaccagacagccgttttagccatgaaaagaagcatcgagccattttccagagataaaaaatggagggatgaaatggatgtgttatgcatagcaaacatcaatgcattctaaatccattcttttgatcttgtacagaatcttgttggtagaaatagaatggagtactgctactaaacttgcatcccccacattgacatcaacaattgctcccactgataagtgagatagtatcataatatttcctccacaccagtctgtccaaaaggcagcacagcactgcatctgcatgtgcagtttctgtatgcctacatgcattgcctctagccatgggccatgggcctctccctccactaaggctccgtttagctccccaaaaacttttctcaaaaacatcacatcgaatatttggatacatatatgaagcattaaatatagataagaagaaaaactaattgcacagtttgcatgtaaatcgcgagacgaatattttgagtctaattaggccatgattagccataagtgctacagtaattcacatgtgtcaatgacggattaattaggctcaaaagattcgtctcgcggtttccaggtgagttatgaaattagttttttcatttgtgtccgaaacccctcccgacatccgttcaaacgtccgatgtgacacctaaaaattttcgtttcaccaactaaacatgccctaatagtgtgtgtcagagtgtgtgtaggcaggttagcaggtaggtgtaggagagcagccaaaagagcaagatgaactgtagcaaaatgagcaatagcaagatcaagtggtgcatcagactgatgataatggagtgcaggaatggtcctacctcagttacctgtcttttcctttgaagttgaaccatggtcaatttcatggatgatgaaaatgtgtgttgttagtagtagtagcaacagtagtagtactcagctatgatcaaggttactaatgattgctgttgttacaacagtgttgtagatactactcctaattaggagtactagagggtttttcattgagtcaactagcaacagagattttgtgaaatttctttttcctggttggcaggttcttagctaatgaaagtcttacttctgatgaagagaaggtagtaaaagggagaaatcatataaggcatatatggccagcatgtccagattggattctatttgtgcctattgtttctggagtgatagtaccggtcaatttttccaactaaccttcttttctgtcggaagataaatgattcaacattcttttcgattgtaggtgttaaaatatgctcgatcttctgggactttttttacccactttgaatggcggttactattaggcttcatgtttaatgtgtttttcacctagtgcatcatgcttcatatgttcctacgcagggcatgttttgcttatttcataccataaggattcttgtctcttattgagctttgcttatttcatctcatagaggtttttgtctcttattgaggctttctttaacaataattatgcctatgttcatcctagatatagaggcctaggatgtaatcatcttccttatctaaaaagttgttaaactaagcagtcaagcctgttggaatacaagaattccaccacatgctctgtagatgaaccattttatttaatatactgtaattttccaacgaggtaagttttgccaatggcctttttttaagagaaattttacgattcttaagaattaacaataagcagagcttgctcctgttatatcaatttcagttttttcttaggacagaagtaacattgtactattctgactaactaattttccatgcattgtcacagtaaaaagaaaaaggcatactacattaatatcagaatctcatgacaatccactgacgttataaattgttgcagggaatgatcatatgcatccatatgatccacaaagcatagctgaacagttatcacatttactcctactccaataatcagagggggcaaaacctaccatcctcatcatgaactacagctttattacatagtaaccgtaaaattcagatcaattacacatttgtaccatcatgtatagctgccatgccgtaccacttacctgaagtcagtaaaagatttcagtaacttagtaaaaaaaaaggagtcactgttcactgttggctagcaaagcaacaaacatggccacagatgaatgcagctgcactcatcagtgaccagtgacctcactatctagtcacatacaccaacccccaccatgactgactctaaactttcacaaggaaaaagcaatgagcatcatgaagactgaagaacccagcaaacctggaaatgcaactgttgcatatcaatcatcaagaatctcttcagaaagaggagatgatacttcagagttcgaagactactcctttaagataactgaagctttttatcccactcagtcaatttcatcaagatgatacaatttaccttaattacactcccgacctctgcataactaggatgaacgcatggagaaaattatactgaagcttcaagtgctgaacatttggtccaaaatttaggaatgccttgcaccttggccacatggagagcacacttggaaagcttcactttagcatcttacgctggacagcatccaccaacatctctctctctttctctctagaaagttactgggtgacaccacacagaaccccactgagagaggccagccaaaggtcaccaatggattctggagagagagaaggagagagaggggacatgaaaaacatatggctagtaaaatgatgtaagcatggagatgtggggtgctcattttgagacaattatgctggtccttgaaacctaaaagctgtgctggttggtgaagatcactgcaattcgcagccatttcccattgctaattgctaccactccaacatcacaacaactttgcattgttagttgttaacttcacctcctactctcctagtttatttttagcctcattttcacctgatacatggactatctttctactactatgtggtaacaatatccatgtatttatagggaggagaagaagaagacaagagcaccaatgtgtggcagatacagacagttttcaggagagagcacaagaagaggcagcagcagaagttgcagcagctagcttgtcattgatcggaaatcggatcccactacaaaattcaggcggctccaaaaacccagatcgatgagctccactctgatggcttcttgctgcttcatcatctcttacaagaggcctcgcccaatcattgccacctttgtccccttcctcctcctcctcttcttcttcgccgtcgtcgtcgccgcctcgtcgtccagcaatggcacggcggcggcgctccaccccggcgaggagctgctccggcttgagagagtcagggcacagctcgccagggtcaggagagcttccgtcaagacgatccaggcatgagcatgattactcaatcttgattagctaatcttgtttgatgttcttggagttcttggttgatcggcatatttgcggatgattgtgcagagtcccgacggcgacgtgatcgactgcgtgccgtctcacctgcagccggcgttcgagcacccgaggctgagaggccaaaagccagaggtgagcagcggcggcggcggcggccatggctgccgctgcagaagcagtggagcagtgacctgacctgacctgaccattgcgtcgctgtactcaacgtacggtggcgcgtgtgctgtcgcgtcgagctgatcaatgattgattggtgtacggctctgcgctgcaggagccgccctcggcgaggccgacggagacgacgaggaggaggaggaggaggaggaggagtcacgcccacggcggcggcggcggcgagcaccgggaggaggaggacgacggcgagcacgggttgcggcaggcgtggtgggccgccggcgaggcgtgcccggaggggacgataccggtgaggcggacgacggaggccgacctgctgcgagccagctccgccgccgccgccggcggccggttcgggatgaagcctcgcggcgtcggcgtcgtcggcggcgcggcgcggcgcgactccaccagcagcggccacgaggtgagtgccacgtcacctcagcttcagcttccgctgccgacggattcagacaagccgtactgccgtgctggagtgcaccggcgctatagatggccatgtgggccgcccggcacggcacggcccaggcccggccgtgcctgggccgaggcttgtcgggccggcacggcccgaccgacgcaccgggccgtgccgtgccagcccacgtgccgcactcacagcccaggcacggcccaacacgcctcgggccgtgccgggacggcccgaaggcacgatgggccatcgtgcttttcctcagaataagtctaaattttctccctcctattgggctgtgacattgtatagctaaaaaaaagtctattttacctccctcttctttgtggtgtggtatataaatagctaaaataagtctatttaaggtccctattctttagacattgacatttatatgtctatttttagtccctatactttgtgtaccgggtctggcctgccagcccatcgtgccgggccggcccgaccgtgccgggctagcccagcgtgctggtggggaggcccaggcacggcccgacggtcgggccgggccggcacgggcccgacccaagtcgggcagtgccgtgcttgggccgggccaaaaaggcgtgccgtgggccgggccttcgggcctcgggccttatggccaactataaccggcgcggcaggtggacacgtcagcgtgccacgtgggccccaccacagctgacaagccctgtgcatgctcaaaagtttatctatctttttcaacaaccagggttaaaattctcttttgtgaatcatttgaaaaaactggattctgaaacaaatgagtttcttttactgtcaaagggaaactacaatgatttaaaatcgagaaagtttttttaattcggataataaattaatttctttctttatctatcataggtcatgtcaaatgctactatctccggtaataaatatttaacgtttaagataatggtttggttaaactttaacatcaattttgtgttagaatattttttttagaaaaatgataaatttatgataatatcataatactttttaagaaaaacatatgcatgcaattttttattttttaagactaagtatttaataaattatcgatagtataactataaattttaaaagtttgattgaatcttatcttaagcgtcatactaaactttgagaaacttcaaataaaatagacaaatttgattttctttttctcggacattgttttattattacgtcctttccgagataattttttttattttttatttcattccaaaactctaaatcatatgagaaggaaaaatctaaataaataatacttcagtagtaagaagtctaaagaagtacttttgtcggtaagaaaatgttactgagtacaactttactgaattgagctaaaataacccccatatatacttgtatatggtagtgatgcgaagtttgttaactcgtgtgtactacctccgtgccaactcccaaaataagtttattttaatatattaatttagacataacttatatcaagattaatgtccaaaacaaaactgaacttgatttgagatggagggagtgcttacttgttactaccgtcattgtttggatgttgtcttctcaggcacagtcaaaatttgaattataatatttaattttaaagttaatcttaaggtttttccttcattgtttatttatcagtattagcttttaaatcgctaagaatacaaatataattgtttttacctgtattttttttcctgtaataaccaacaaggttttgtttgccaaataaactggcgtgtgtcggtcagatgccgatggttaatttacacgcacacacgccttacggcctcattgtttcacttatttgtggaataagccaataggtatatttgcaaacgaaaaataatttacatataaaacttttatataaatgttagtgatctaaaagtaaatgctgaaaaataaacttcgacaataaaaccctaaaatcagctctaaatttaaggttgaaattcaaattttggttgataagcatagggataagcgaaaagatgagggctttaatttggttgcgttgatactgacattggtgagcaaaacaaatttatgcatatgcagcatgcggtggggtacatgagcggggggcaattctacggggcgaaggcgagcctgaacgtgtggccggcgaaggtggcgtcgccggcggagttcagcctctcccagatctggctcatctccggctccttcggcaatgacctcaacaccatcgaggccggatggcaggtgctacattttcttttctttctctcctccttttctgaaacttgttcagtcaatcaggcctagctagctagtagccagtttcagagattacattttactctcagctctgcatactgatcattcggattttatcggtttatcgacggattccgtggataccgctcgtgagcggattttgatccggtatcgggatcgttaaccctgaaaccaacgctacattttcttaaacttattcaggcgtagccaatttcagagattgccattgctctcaactctcaactctgaatactgatcgtatctagctacctgtatctttctgatgaattttcaggtgagccctcagctgtacggtgacaacaacccaaggttcttcacgtattggacagtaagttctttgctagtaaagtagtaatctgttcctagtgtttcagtattagaagagagatagatcagtcagttcaaagaacaagttactgaagaatgatgcattgtgcagaatgatgcgtaccaggagacgggttgctacaacctgcactgctcagggttcgtccagaccaacagccggatcgccatgggcgccgccatctcccccatctcctccttcgccggccgccagttcgacatcaccctcctcatttggaaggtatgttgtgcgcacttttctgtgaatttcgaatgaaatttgacgaatttcaaacaaagcttgaaagccaagatttgaatataaactctcccgatgatttgcgatcttgaacgaaattcgaatatattgactggaaactgagattgtaaacatataggtgtataagaagttagttctctcaaataggctcaataggccaaaagtgatgggcttatatagtccatgaagtcttttcctttctaaaaggcaaaattttcatagatggagatctcaaactacatataataagttaaacttttttttttgaaaatttactatactacttagtactacaaatgccatggtatttataggaatttaattcaattcttattttctattcaaatttgaattttcatgaaaccattctattcccatcttgagctgtctcgaaacaccaaactttgcggaattcactcgatcgatttttattgggaatgtgaacttagctttgtcagcatatactctaacaacattatcttttcgcttatacttatacttatcagctaaaatttaaattttcaatcttaaatttagatttaattttagggtttatttatcgtagtgtatttttcaccctttgcttgtagatcgttaaaaacacgtatataaacgttttattcacaaattatttttcacctgtaaatatgccgttttgttttttcctccaaacaaccaaacaatggggttgtaagaatctccaccttctcaaagcagttcgaatccttcctccgaattcaaactatgaaaatacatatagaatctaagaatgaacaggtagccaaaagttgccaccgtagcttttccatattctcaccagctagttacatatcaattgttttcttcaaacagagcctcagtttaagcactgcgagatttgaacagtttttttttgtgtgtgtgcttaattctctcacaatctgaacatatttgaacagctaaactccaagatgatatttgaaactgcacgaaacgcaccgtttagtagcttgaaaccgagataaaaagtctgaataagcgcacgaatctcaacgcaggacccgaagcagggtcactggtggctgcagctggggtcgggtgcgctggtgggctactggccgtcgttcctcttcagccacctgggcgcgcgcgccgacatggcgcagttcggcggcgaggtggtgaacacgcggccgtcggggtcgcacacgccgacgcagatgggcagcggccgcttccccggcgaagggtacggccgcgccgcctacttccgcaacgtccaggtcgtcgactgggacaacaacctcatccccgccgccgccctccgcctcctcgccgaccaccccgcctgctacgacatcgccggcggccagggcgccgcctggggcaggtacttctactacggcggccctggccggaacgcccgctgcccatgagatgatgatgctagctaattcaaggaaaatatacgatagagtaaatcttctctttgttttttttgctttttctttccctctcaatcttcttcaggttcttgtgtgactgagcatatgttcatcgagttttagcttagtttgattatttatgtatatttttgcattcaaatttacagtcttacatcttctctttgttgcatgtgtaatgcattcgtcttgagattgcatggattaatcggagagaagaattgcaaattttgggggaaaaagtacgccggaggtccctcaacttgtcatcgagttacaaaatcatcccccaatcgtaaaaccggatacaacgcatccttcaactaacaaaaccagtataaactaggttcctcagcagtttgaccctgattttatccgacgtgatggctaaatcaacgtaggacccgtgttggccccatatgtcaggtgccacgtcaacagggtctctcttccccccctcctctcccttcctcctcctctctctcactttcttctctccgggcaggccggccggcggtgggaaggaggtcgccgcgccgtcgcgggaggaacctggcatctgatgaggcgcgctgccgtagtaggagccgggaagcggtggcggcgtgcggcgtcggagccgcggcggggcgtcggggaggcggctcggcgtcgtcgtcggacgggaaacagatgtatgtatgagcaagtaaatcggcaatggtgattagtgatgcaatgtcacatcgagctttcacgccatagccgccagaatctttggaacgatatataagagcagagcaagtcaagcagtcaaatcaatagctcaagcaaacaagcttgctcggttcagttccgacacaatgcttgccttgagctgccagccattatggccgccggattcgtggacgacgaggggcggcgccgggagggtcatggcgttcgtggcactgtcctgcgccacggtggtgatgggcggcgccatctacggctacgacatcagcaccgcgggcggcgtgtcgtccatggagtcgttcctaagggacttattaccggaagtgctccggcggatggcgggcgccggcgctggcgcgcgccgcgtcagcaactactgcaagttcgacagctagctgctgacgctcttcacctcgtcgctctacatctccggcctgctcacctccgcgctcctccgtcgtgggtcacggctagccgcggccgccgcgcgtccatgatcctcggcggcttcgcctacatcgccggcgtggcggccagcggcaccgctgtcaacgtgtccattgccatccttggtagggctttcctcggcgttggcctcggcttcaccaccgaggtcacaacactgaaaaaatcaaattattctcaaattcttgatgtgccatttggacaaatcttctgcaaagttttttgaattttgcaagttcttgaaacattttgctgtctatgccactctgcatggctgaaatggcaccggcgcgatactggggagcattcagcaacggcatccagttcagcctttgtttcggagctctcgccgccacgaccgtgaactttgccgtggagaagattaggggaggttggggatggagggctctcgctggcgctggccggcgtccccgtcgacgacgagctggacgagatcatcgccgcgaacgccaccgcggcgcagggagagaacgccctgtggctgttctatcgacgaggagccatggcggcgggatctggcgcccgcgccgccggcgacagtggcggcggcggcgttgggaggccctcctgctcccacgtcgtcgcctcgttgccgccgccgcctcgccgccggactcccgcctccccactggcctcctcctcaccggccgccggctacgctgctagtgagagaatagaaagaggaggaagagatgtggagagggtaggggaagaagaggttgacacgtgggacccacatgggtctcacgctgagtcagctgccacgtcggaaaaaaccggagttaaaaccgctgagggagctaaaaccgctgagggagctagtttgtactgtttttgtaaattgaaggatacgttgtatccggttttacagttcgaggacgattttgtaactcgatgacaagttgagggaccttcggtgtactttttccaattttgggatatggtgatgtgggctgaaatttgattttgattttagagaggtaaatgggccttgggaagttgggatgtgcacactctagcccaagcccaaatttgaaacgatatgaagcccacaatgtcttctttcctgagatgaggcccattggcctttttagcctttgcacaaaacaaacttgttcttttttttttcttcggggacacgcaacacaaaacaaacttgttgcactgaaaaagaagaaaaaaaataacttggtcaaatttagaaatgctagggagctagtttgtgaccaaatgcatagtggtgtgcttgtgtgtgtgtgtatctactctacactctcttatcttaattctgatgatagtgccccttttctaggagacttttatgccaacatttttcaaggatgtgtgaatgtatggttttgagtgtgtcaagtggaacattgcgtccaaaaattgataacgataatactcatacagaaaaaaaaaaggggggaaagaaacactaggcaaacatgatccatgcatgactagggtttaatgtttcggtttgctgatttctattgggggtggccgaaattctgaaatttcggtccgaaaatttatgaattcttgaataaaatttgatcaaatttgaacaaaatattaccaaattcatgaaaaaaatgaaaaaaaatttaaaaattttgatcgtattgggggggggggtctccgatagaaccgaaatttcgatccgaaattttgaaccctgtgcctgactgctggagcaattttagtattgtcgccagtagtttctaacaggcccccttttagaattttttttttgtatataatatcactgaagtttgggacatgcaagtcctaagtgaatgcaatggcatattggcatcggaaaataggactattgttgatgagttggctgtcatcgtccttattaaatgatttaatcattggtggcacgcttccattaattctgattaatgacccatgttgctctacaaagggccctaaactattagctggttcaaaaatgtagaccccatgtacagactaatccacatctaaaagagcatcttgctagcttacatatgcagttgatagcacaaatcaagattggaccactcaagaaagaaacaaaagaaatgggacaatatgaacaacaagaggaacatgtgctctctttgacaaacatcttcacccataatatggctagcaattattactttagtgggataatttacactaataatccattgggcgcattatgccccaatttatggtacaaaagattattgaccgtcatatctcctatgatcactaaataataaaaccctaagcacaaagataacatattcccaatctgtacccacaagggtgcacctagcaaaacgacacaccccctacagtctatggcaagctgggcccaccagcaaacagtaaaccatccttttcttacaggtccccgtgagtgcctacacccatggttgcatggtcaacatcaacaatcatcaccctcacatcacactgctagtgggcccccttcagtttgaactatctatattactgtattactcactcctgatcgttgagcaggcccaaggaaccggaattagcacgggcttggagttgggcttgggcctgggccggtctagcaagggccatgagtttggtcggtgaaatgggctgtctcgggtcagcccgcttccttgtctctgcatcagtaccaactccattgccggcttttcttgcctcgacgccatcatcgtgtcgaatgccacgtagcaacgccgccacatccttcatggtcggtcgatcctcaggtcgtgggcttgcgcatagcaatgccatgccgagagcttgcagcatctcttggacctgggtatcgggccggccctgcaacctcacatcgatgatctccgccgggtctcgcttccggcaaaggtggtcgcgcacccattgcaccacgctttgtccctccccgaatgccgggtccagtgggcggcgcccggtgatcatctcgagtagcaccacaccgaagctgtacacgtcactcttggttgtgatcttggtcatgcatccatactctgcgttgatcaagatcaaatatcagccattgattaatcttgtgcttttctttttaaaacaaattcaattaaactgctgaaattttgtttgaactggtgaatgtgtgtgagtgtgagaaaaggctcttaccgggagcgatgtagccgtaggatccggcgaacggcggaggcgatgagctggcaccgtcgtcggcgacacgggcgaggccgaagtcggcgaggcacgcctcgtagcggtcggcgaggaggatgttgtcggccttgacgtcgcggtggatgatccctggaacgcagtcatggtggaggtaggtgaggccctcggccacgccgacggcgatccgaggcgaacctcccactccaccacggcggcggtggtggtggcgccgccgcccatcgcgccgccgtggagcaggccgccgagggtgccgttcgggaggtagtcgtagaagaggaggcgcgtccggcggttcgccgcccagcccagcagccggacgatgttgcggtggcggacgcgcgggagcacgctgacctcgccggcgaacgcctcgatggacgcctcgtcgcacgacctgaacttcttgacggcgatggtgacgcccgacgacggcatgctcgcgcggtacacctcgccggaccacccgtggccgatcacgttcgccggcgtgaggctgcgtgccacgtcggacacgccgatctccagcttctggtacagcgtcacgtcccacggcggcgacatctcgccgtccttgtcctcgccgccgcgggcgccgccgccgcggcggtgccacccgaagaggacgagcgccgcggccgcgaggaggacgacgagggccgagagcagcaccgccatcgcgacgcgggcggcgcggcgcgcctccacctcgcgctcgctggcgtcgccggagcaccgcgagaggcacagcgccgggttgccctcgacgtcgctcgtcggcagtctcgcgaagaacgccgtctccggcagccggccggtgaagccgttgaacgagacgttgagcgccacgaggttctggagcgcggacagcggctggaggtcgccggatagctggttccgcgacacgtcgagcaccccgagcctcacgagcccggcgaactccgccggaatcgcgccggagaagccgttgcagctgaggttaagcgcaatctccagccccggaatcttgccgatgctccccggcacatggccggagagcgagttgccgccgacgtcgaggagctggaggcgcgtgcacgagccaatctccggcggcatcggcccggacagccggttgccgccgagaaccagcttagtcagagacgtcagcatgccaatctccggcgggattccgccggcgatgacgttgtcggagaggtcgaggtactggagcgagagccagtcccggaacagcctcggcggcagctcgccggagatggcgttgtcgtggaggtcgacgaacgtgaggttccggcaccccgacatctccggcgggagcgcgccggcgagccggtttgacgcgaggtcaaggaagctgaggttcccgagcatgccgatctccggcggtatcgcgccggcgatgtggttgccgctcgcccggaaccttacgagcgccgcgcagctgccgatctccggcgggagctcgccggagaggttgttgttgatgagcagcagcttggacagccgcggcagccggaagagggagcgcgggatggcgccggtgagcgcgttgctggagaggtcgagcgcctcgaggctcccgcaccggccgagctccggtgggatgctgccggtgagctggttggcccagaggtagagcatgcgcagcgccgggaggcggccgagctccgccgggatgccgccggtgagctggttgttgtcgagctcgaggtcggtgaggttgctgcaccgggcgagctccggcgggacggcgccggagagcttgttgacgctgagctggagctcctgcagcgacgagaggttgccgaacgacggcgggatgtggccggtgaggccgttgagcgacaggtcgacgacggcgagcgcggcgcacgagccgagctccggcgggatgacgccgaccagctggttctgccatagcagcaggttcctgagcttcccgagcccgccgagctgcgccgggatggagccggacagcgcgttctcgtagaggtagatgttctcgaggcacccgcaccggccgagctccggcgggatcgggccggagaggagcgccgtgtagatggccagcgtggtgaggttcttgagccggccgaggctcgccgggagcgggccggtgatgctggtctcggcgaggccgatcatggtgaggctggagcaatcgccgatctccgccgggagcgcgccttggaggttcttgttgccgccgccgcggagcacctcgaggctggacatcttgccgatggacgccgggatcttgccggcgagctggttgtcgtagacgatgagctcccggagcgaggtgaggttgccgatggtgtcagggatggcgccctcgaggcggttggagttgaggtagagggtctccagcttgctccccggccggcagagcgccgccggtatcgtccccgtgagggcattgttgctgaggtcgaggtgcgccagcgccggcagctcgccgagctccggcgggatcgggcccgtcaggttcgcgccggtgagcaccagccgtgtcagcgtgcgccccacggcggcggcgaggttgcccggcacgccgccgaacaggtcgacgaactccaggctcagctccgtcacgccgccgtcggcattgcacgtcacgccggtccaccggcacggcgacgcgtccccggccttccagtccgccagcgcgccgccgtcgccgcgcagcgtcgccttccacgcgagcagcgcggcgccctgctcgtccacggcgagcacgcagctcacgcgcagcaccacgaccacacacgccatgaccatcgccgccgccgccgccgccggcgacctcgacgccattggcgccgccctccatctgcttctgctactcatcacgcatatacactaataaccacactctttgtacctctacttgtatgcaagtatatccaagaacacacactactatgcaaagtgtagtagctaatcctatagggattctagtgtacttgtgttaattgctcccaaatcttggtcttgcttatgtcgcaagactagtactaagtactactaacctctaactaatcaatgaagtcctaataaagttttagtatgaaggagagagagagagagagagagagagagagagagagaagagagaccatctcaaatggtacagtttttatatgcttgtagggaagaggtgagatcaagaaacaagaatgaggtgtctaaataggtaggagaggttgaagagtttttgagtctgatgagatcatgaaggtgaatgaagcaatggagacttgtccctgtccctgcagaatctctggatccaaggccacagagcacagtactaacactgcactctgtcccttctatgactactttagtagcaatctcttatggcctctagtagcaatgcacataatcaccatggttaatgctgctgttaggattggtgattgggtgtataaatttttgacagccatcaccaacgactaattgctttgcaatgcagtgcaatgccccaattggagcttaaagaggggagtgagagaggatgcagaaattttttaactgaagcaacagctttgctggcttgagagtaaaagatggtgcccccagagacatggcaatggcatcaggttaagcaacttcatggaaaggctgtgtgtgtcaagggggatatgattaaataagatgcagttagagcaacagctttaacagactgtgggtaaggacttggctgtagattttcacatctcagggtggtaattgaacttactagtatgaattaagaacatcaagagttgacaacttggaaatgggaattagtaaattcttacttgagaaaaatgggtcatcggtacttcagaaatgcagaaaaaaactctgaatatatgggcagcaaagtctcaagtcagtaactcaaaaacatagatgttagaaagaatagagtcatgttgattggaatataagacaacaattaactgacctttttgccttgtttgattacatattaacagccatttctgaatgtgatcgtgtaagtagacagtaaagccctgcactgtaattatgatcattgcagggtgagaattgaactaactgcgctggtaagaatctccagagttgaaagttgaaaaataagaataaaaagggacatcacagctgggtgcttagtggtaacacatgacacacagagagaagaacacagttcattccatgcagtaacaattatataaaccgcatggcagaggctgtttcttgtcaggataaacagaaaggattggatcttaaaaaccccagcagaggctgtcacatgcccctggttagatctaatctcacctttccactgtcaagttcatagttaattactactgcctcttgtactttgtgttaatggtgaggaagccgccatctagctagcagctggattatactagtaaaagtacaggaaattttgcaggctcgcagatctagatctaccttcttctccaaattcccatcggtaaatgggcagttcggattgaccaatgctgaactactaatcccgtagaagataatggaaacttgcagagtatttacattggggttagaacttccatttgcagtgttggtcgttttacccgaaaagatagggtacatgcttctgcctttgcagtaaaaagatatgtttatgatgtgtatttaactagcatgtagaagtagaatgcttacatgagtgaacattctagcatgttcaaatacagtgattgacaagtgtacatgaacaaaatgaggagtaaagtctaatgataatttggttaccggttattaccaccagtaaaaattcacggatgattcttgttcataccttacagttctcatgaatcatcctgagattagtgttcattaacttgtaacaattcatcagcagcgaagctgcataactgcaaaagctaaccaagttatacatgaatggaagggaatggagggagagagagtcgtacttgcttaattactgataaaacaacaagtaaacaaataccaaagagtacaatcatttgtagggtgcacagtttccaaggttttcaccacatcatcacctagatctaccagcctaaacatgtttacccaattcatttattgtgtccttagcatatggcactgtcagtcttgttgacaaattcctgatcagttcatctattctcgtgatgcttgtgcatgcaattcatgacagtattttaaccagcgtttagttgaaaggcatctcaaagagccagcagtacatatcatttttttgacactagcagtatatatctttgatttcactaagcaaaagtgattaacctgtcacgtgaggcagtggactcttgagatacttgccgcgtgactgtatccaaccatcaataatattccaattcgtctgtagctcctcctagacatggtgtgctattgctactcatgtggctcatcttttgttagtgtggtgcaattacatgtaaataattcaaactgaaatgaaagggaagttttaagaacaaaagcaaagatcacacttataacagaaaggggggaaagaaaaggaagaaaggcaatcaaaatcagaaatattttaaagctaaactgcaacttgctagtaacaataataggcacaaagattgcattgtttaaaagaactgaaatggtgttagtgaggggaattgaggaggagggaatctaggcatgagatgtggggaggtggtagggcacatgcaggagtagaagacatgaagaatacaatagcacagggcctgcctaggataggcatcatgtgagaaggagatggtggaacaagtatacatagatgacagatatcatggggggaggtggccatctgtttaactccagtgctccaggaaactaagggcatgaatcatgatagacaagtttttttttttggatgaaaaatgatttttctttttgttgaaaacgcaggaggaccacacttcatttcattaagaagaagaaaaaacacacttacacaggagagaccaatttgatgaaaaatgataaggaagctattagcaataaacaagtggaattagtgccttaagtggtgcttcgtactctcgtgatgagcaatgcacaaaaaagaacagccatggaggtacagggtggggcggctaacaatatgcaatttcttgtctttacaaaaaagaaatgtgtttttttgtcgcttggtgaggcaaagacttaagcagacaaacagactcacctagtccattgtacaactccacattccaaagaggatatgaagataagaacagagaaaacacaattggttgctatgtgtgattgtgtgatgatctggatttttcatagaagtgttgaagtgcagttttgctacataggttaattttcacttcatctccaaatggttacctgatgaaatatttctcaacacaaatgcatctgccactggaagctaaaatcgtaaacctctcccaagaatatggtttcctactgaaatcatgaatgactcaatgaacgaaacagtttacctgccaacagagaaacttagaaggtttagtattagtttaaacatatactccctccattctcttttctttattttataaattttctaagtcctgtcatgtttgaggataatgccattaccagttaaatcgaagttgcagaaatgaaagaaccttcaggtatgaagcagagatttttcttttggatatctcattaacaaatgcgtgatacaaattttgtttatgtgtaccaaaatttcacataaatacatagcatgtgcttcatcaagactattacatatgaaacttggtcaacactaacatcatgaggtaggtattttttaaatcacagtttcatgtattagcatcacagtgtttccatcaacaagttggcaaataaggagctttactacttttgcagttatcaattactccaataaaactttcaattagtaacatggtgaatcaatcaatacaaagctctcagggggtggacttgtagaccacacaaaaatcaatcagttctttagtgcatactgtgaaatgattagattcaaatatagaactggtagggggtcaattaacacacccaaactataatctttagctattatttaattgacaaagataatatagttctttagagaaccatcttgggggcagtgcccgggttttgagggtagtggaattaagtcctttgatctctttcggctctaagcagcaattaaaccaaaagtactcatataagcacaccatagctgttaccatctacctctactttctgacctcatcaccttttatcatgtgcacctaattatacagtatattcgtttcttgttcatcatcagcttaaaccttctcctgaaattttcaaattattaatggttcccaagaaagattagctttgcttttcactgcactcctgttccattgtaaagaggttacttgtggaatttgctaactacatatgaagttaaatgttcctgaatgatcatatgaatttatatcgaaactgtgtggtgacaaaagtcttttgcactcaaccagtgtcaaataaaacgcatcacacttttctttgatatactactttcattaaatcctaagtttgtacttactacattcatttccaatatcaccttatgttactttcaggagtgaggttccatggtcaaatcaaatgacatcaagacatagaacaatgaagcaaaaatccaaggtgcaatgcttccaaaacagatgctatagcatctttgcattgaaattacaaattgaaagggaatgcaactacagtaaaattgacctaagaactcatgatcaagaaccaataggtaggagagaatccacgtgcattacaggaacacataaatacaaataagtggattcccatttttccatcgcttgaattggatagataaatcacccaggacaactaatcaaataccgcaccagctaatccaaaatagaaaattgaaataattcagtttacgggaagcattacaatcaccaaatgtgacttcttattattatacaaattgtaaaactgtgtgggaaggattgcatcatctcatagtgatcccttcctcaatttaagggaactgctacattgcattaattgtatagcaacaaaaaagaagcaaaaaaggctcaaaagctcaagggcacttacatttggacggtgtaaaaagacagagaactatggcagtaagctatgatccaaaaatacagacaaaaatgaagtcaagttagctttttgcaagtccaaggaaaaactgtgtagtatgtcatggcacaaaaagacataccaaaatgatgtcaccattttgtttctctaaacactaattcataaggaagttgttttctgtagctcaatgtatggacctttttacacggatagttcaccaactttatgccatgaatcttagccaagattatttcaacaaaagtagagtctggtgagaatacagtataccacagtccacatataaaattagttttggtaaaaactattgttctcttcagcacggccactaattgcacagcaattgcagagcaacaaggaccagaaactttcacatcgatcttccatcagtttgtttcacaggcataactcttcagcacttatattatgtgatgtcaccatcattctcatatttatagggaaaacgttcagcaaaggtaaatttccaaatacttaagtgctaagacaaaagaatggtctcactgcaaaaagaagaaaagacaaaagcatggtttcaaacggtacattctaatttatttccggaaggaggccccgaatgttaaaaccaaaaaattgtacatttggcactaaatggtgagcccattaacaacggaacaagggccactttcatcttctcacatgggcaaacagcacattgactgaaagtgatagcacgaagtagaactataattgaggaacttactgatacagaaggaattgaggcaaatttcataacaatttgtagaaacaaaaacttcttgaaaaaaatgaagggatcttcatgattctcaaatagatatactgcgattaccattttccctatcaaatcaaatacttttacattattacaataaacacttcaactaagaataaccaaaatcttcttcattagaaaaaggagaacatcaccacacgtaccatttcataacaaaataccacttacaacaatagaagaagatttcagaatggtataacaaataacatgttatggccatataaattttgttcctgttttatatagaaataattgtgccaaaatcaaaccacctagaaaacttctttacttaggtttaagcacatagctgaatagttttgcttttaatgtccgaatcataaatattttggggtttcaaaaaaaaaaagaatcataaacatttcatgaagatttccttttttcctgaacacatttttctccaacatggttttcaatcaaattggattcatcacgaaatttcctcttccttcatgctgcactcttgaaaaatgcacagcaagtagcagtttcaaaaatagcatcagcgtgatacaatatccagaagaaacacaaaggccatcacagggaataagaaagcgagtgcattgcatatgcttcctgctttatccatataataggaactccttttttcagcagcctattagacaatgtttttgcctatcatacggatacaaaacaaaagatatgaaataaagttgaatggaacaggatgtgcagaggatacaacacaaaagacatgaaacaaagttgaataaacaggatgtgcagcaaagcggagatgcacaacaagtgaatcagacagaaaatgcagatgcccaagtgtatcagacagaaaatac

SEQ ID NO: 23789 - DNA, 14904 bp, Oryza sativa
  unsure (1)..(14904): unsure at all n locations
atctgtgtaatggaacagcaagcaagcaagcacctccagttcatcagaactccaattcccaggcagctctctatatatatatcactatatcagaatctggtgaagcctctgaatcatgctgtaattgcacagtcaaaaagatcatacaagctatgatgatcgaagaattgactgaacgaatgatggtaccttaatcttaaagcacactccaaatgacacacaactaatgaacaaaaccagcgtgaaaaaaaaaataatcagaaaccccttctcgttttctctgcataaccagtagcgggaggacgagatcccgcgctcgcgctcgcgcgatgaaccattcccctttcgctaactcatgcagtgctacgactacgagtgatttcccccatcccgcgacgcgcaaagcggagtgatggtcggagtcggagaagacgagcacaaagagagggaggagcgtgttgggatccgaacctcgcggcgacgacgacggagcggcgatcggcggcgctcccgccggcgtcgaaccggcggcggcccgcgccacccaccctacccgcggtcgccgccgccgcgccggcgagcctcgcctccctgctgggccggatcgggccgatgctatgctggtctactcataatgggccgaaacaggtgggacccactcttaaatgggccgaatcttctccggcccaacgaactcccaagcggaggactagtcgtgtactccaagtcgtaagtcgtctcctccagtgaagaaaaataaaattaaataaaattaaaaaatattttattttattttatttttaatttgaagcccaactttaatttccttcctaaccaagcagtcaagcacttcattcaccttgctcccctccgcaagccgccgccgcagcaactccggcgaaatccccggccgccgccgccgccgcccgccgccgcgatgaacgcgtcgcagttcatggacaaacagatcctcggcctcgcggcctcgggcgccggtgcggccgccgccgccgccgccgcgtcgtcgtcccctcccgcggcgggaggaggtgggggcggcgggctgttcgatctgatgagccccgacccgcaggaggacggcggcggccacgcgcgccgcgggcagcagcaacacggcggcgccgacgaggtggtgcccagctacgacttccagcccatccgcgccgctcccgccgccgcggcgccggcctccgcggcgagcccttgggggtcgctcgactccaaggcggcgtcctccaacctcaaggtatcatctcccagccgagggcgcctccgatagatctgctcagctcgcctcgcctcgcctgcttcacacacgaattgaacaagcgaaatttccaaacattcgtaagcttgtgtgcttttcttagccataggaatgtccagttctaggtgattggtaatactttgtgactctgcgctgtagtgatgtcgaattgattgtgtgaagttgtgattgctcgtttgctattacatgattcagatatagaaaggaaagtgacattttagtattcgatgttggtgaagattgatgccttatctgctcataaaggggagaccacagtgctagttaggatactactagttagcttgatttctacatttagcagttcaatgctatttctgtggaaataaccctgagcccctgactgtaatcaccactgtattacgatactgagcagttcaatcagtttgttttcctaaaaccatttgaggatattttcagatgctactctgttatgggtaaatcatgctcttatcccaagaggcaaagacccgaatatgtcaagtgttcactttgctaggcttatacccttgtcagggaacgatggatatttgccagcattgttttaattttgtgattctaatactttatcaatggccctgatttgttttgattcctttatttagttggttctgattgttcaagcctttaaggtctaggttagatagtttggcactttgcccaaataagaaaaaagaactatcgtgaaaaatatgtaggttttatatgatattttttatttggcaattttgtgaatttctgatttaggtaatatagcaatacaatttgttgccaactcatcaatcattaacatggacaataattacatgtatcttttcatcccaagtccagcaaattacctaattttttgatactttgattcatggtcatttatcaattcatacaagtgatctgcctctcttcccttgtgatatattgcttaacatgtttatcctctctcattgtgcaaagagtgctggcatgttggagtctcatgtgctcaagaaggtcagtcacgaagaagaaaggggcaacttcagtgcagtctccatagcagatattgatcgcacaatgaagaaatatgctgataacctgctacatgcactggaaagtgtaagctcaaggctatcacagctagagggcagaacacaccatcttgagaactctgttggtgagttgaagctaataattggtaactacaatggcagcactgatggaaaactgagacaatttgagaacacactgcgtgaggtaagcttccctctcttttactgttagacaatatgctgtaatatctgaattggtaaccaatttatggatttgattatcaagaggtaaagtaagtaaccaatttatggatttgattatcaagaggtaaagtaatttagttttctattgagtaacagtagtcttttctttaccttcccatgtgaaatgctgctatttttatttttatccttttgagagaaaaaagctgaagccagtattctaagtttttgtcttcttttttgtgtatttatatgaatagtaaaatgtacagcttctactttaccctgtcttggcttatttgattattaatggtccatagcttcacatgccctagctgggttgcgacattggttatagttactatttgtgatttaaaggacaataacatgagcagggagctaatatgtaccttaactgagtttattctttaactataagtatatgcagtttgcctggtgttgtagtctttaagttgtgatataattgtcttgaacattactaaaaactgcttatttggttctaatttgtattaatttgttttataccattgtgagggcatcccgtatcttactatggcatgtgctacgtgtaggttcaagctggtgtgcagattttgcgtgacaagcaagaaattgttgagacacaggtccaactttcaaagctccaattgtcaaaagcagaggatgctcaatcagaaaaggctggtgttggtcaggcagattcaaggcagcagccaactctaccccaacctcagcatcaagcccctccgccttcccatccaccggcattgcctgcccttcctgctccaaatgcaccacctccacctgcaccccaaagccaacctccatcacaattcccaggccatttaccacattcccaggtgcaatcagtcccacctgctccaccgactccattagcaccaaccataccacaggagtcctactatcccccgtcagcagtacagccaactgacaccacacaccagcagtatcaagctccacccgccccacagtcgcaggcacctccagcaccaccacagcattatcaaacaccacctcagtatgctcagtattctcagcctcctcctgcaagtgctaacccctcaactgcagtcccaccgtcagtgcatcagcagcctgaagaagtagcagcgccgtatggccctcctcctcagagctatcccccaaatgtgcgcctgccatctccttatgtgccaccacctagcgggcctgcacctcctttctatggtccaaaccctggcatgtatgagcctccagcagtccggccaaactccgggccacctccatcctacaatactggatacaaaccacagggtggaggcggtttccccgagccatatggttacagtggatctccatctcaccgtggcaatgctggaatgaagtcgccctcgccgtttcatccaacaggctctgcgggaagcggcaactacagcaggctccctacagctcaaatgctgccccaagccgcgtcagcgagctccaccccaagcgcctcctcgggcaacagggtgccgattgatgacgtggtagacaaggttgccacgatggggttctcgagggagcaggtgagagcggccgttcgccagctgaccgagagcggtcagaacgtcgacctgaacatggtgcttgataaggtgatgaacggcgccgacgcccagccccagagaggctggcacgggcgttaaaagctcagctgctatccagggccatgaagcgctctcccatcaacctgtgcatatcactgaacatccaatccacggagtcattttgtgcattcgcgtgaacgtcagattcggaattcatattgtcgatttggtggggaacagaccaggtctgctcgatttgctgttggtgatcttacagcaagtgttctttatctctttgattcgcctggtgttggttggtactagcagtagtactaaaacttggtatctgatctccaaaaacgagtttttctagagatggtgttatggttgttatccactgatgatatgttaatgattcacgggctgcactgttctgtttaactagtcacgctgctaagctgccttccagtttccagaaacacattctgccggactgatgattgattacccgatattgtgttgtgatagcgtacgttgtgatgagtcgctgggagagctgtttgttgtctgcccaagacggacagctcgggacgaaatacactgaagcagaagggaaatttcgataatcgaaatcgtctcgaaactttggaacgacatttcgagaacacaacagaaatttaagaaaatttggctagcatatgcagcatgcttgatgcggatgcatctgatctccatccaagctgtcttccccggccggatcgatctctcaccacgaccttggcttcgaggtggtaaggttgtttcccaccgaaaaatttcggatatttcggaaaccctctcgaattatatcaagacaatcgaaatttcggaaatatagttcccaccgaaatatcggatatttcggaaaccctctcgaaatacaatcgaaatttcggaaatttagcgcctacggtttcccaccgaaaatttcggatatttcggaaaccctctcggaaatatacaaccgaaatttcggaaatttagtgcctagggttgcgttgatccctcactttgccgccccaacctcgccatctatctataagcagcctggccgccgacggcggtggtcgacggcgacgccgtcaccaagcacaagcgctccaacgccggcgccggaccgggcgacgaggatccatggcgccgccgccgccgccagcgaagaggagggatatatatacgttcgtgaatctttgacgaagaggctggaccggcccgatcatcgccgaggtcttggggaaagatccacactcgcccattgcttgacggccagcctattcccaacgaaaggctggaatctctctcgaatgcgacgcttggaatctttggatagataaattatggacttggatatgcgttcttcgacttcgtcgaccagcaccgcgccaatgggatcgacgacgagggggttagcggctcgatcgccgccggcgacgacgaagacgacggcgaagagaggaaaggactatgtgggccggccggtgtggcggtgccagcagtaactgacatcaagcgcgtgtgtagatgaatggagacaaagttatacgcgtattactcaaacaaatccacgagagaaattttgggaattttcgaacaggatttatattcaagcaaattctatataatcaaacatgaaatttagtgcagtgttttcgattcaggcaaagcaaattttgcttgcttgcttgcttttgttctagtacactacaccactctgcaatgcatatatcatgcacgcacggagattttaattaagcttctctaaatttctgagcccaccgaaatttcgggaatttcaagatcctctcggaaatttcgaaagatatttgtcatactttcggaaatttcgggaatatcgcaatcctcgcgaacgaaatatccaacagaaatcgaaatttcagaaattccgcgccgaagaactagcttgcgcgcgcgagtgattctgccgccggccgccgcagacggaactcctcgatgctgctctcgtgtttccaccggcgggccggccggctcggacgccggcggcggcggcggcgagcatcagaacctcaccgtcactataccacgaaacagcccgatgtaccacgaacttgatccacgagcactagcagaatctcaccgtcactataacaagggtgggttctttccctagttttctcggcttctactctctcgtttttcacatgcaatgcttcctaaagtgctaaatgatgtgttttttaaaaaaaattcaatatgaaagttactttataaaattatattaatccagtaattttaagctactacttactacatccgttctaaaatgtgatttgtaccaaaatgaagctattttttcacctgccctcttatctcaaccaatcgcaaccattctcttctccaccaatcataacccttctttaattatctatacctactttcttaatatctgtgcctacctaaaaaatgtttatattatgggatggaggaagtatttgggtgtagctcaattctattttttttttttgagaaaattgtaatccttaatttgtataggcaaattagctcaaaggatacactcactaattactatgaaaaatttaattacaagcttgttacaagcccaaggcgcgaacacagggcgtctctatcctttccattaaattaagtttagaatttaagtgtgtgcttcatatgtatccaaacttatatgaacgttagtgaaactagataatgaatggagataccaaaacgtcttataatatagaacaaaagaataataatatttataaaatatctactattatcgatacctatatgcatgttaaaaaaaatgcttaggataagattttatttaacttttaaaactctaacaaataatgacttctcaaatacttagttttcaaaatataaacaaaaggtatgttcgtggaatagtcttgaaaagtacgataataacagcgtaactttggaatgtttcataaatttctatattctaacataaaaatcgatggtcaaattaaagttttaaaatttcggccagccttatcctaaaggttatttaggagagtggatatacagtgtaagcgccagtattaggtgacatcgaccactttcgataaaatttatggttaaactacttatcaacatattataacattatggtttaagtataattagtacactatgacactgataggcacgttatgacatcaagaatattttttttggcccgccactatatatttatgaaaaaaaaagagtactagtttcctttcctggtttttccaaagagcggtcaggcgcataaaaggaagttctcgtttctcaagagtaggaaaaaagaaaggaggattttgaaactctatggacacatggaaaggctaatgggcgggtgatcgctcccctacccgcccaccctctcccccgtactactagatgtactcctctctcttctcccccttcctcctctccttctcctctttctactgcagtagaccacataaaaatttttgaaaaacaaaagttagaaaaatttatgtataaaaatattatatataaaaatttgaattcaaatttaaatttgaatcgggtatgtaaacttgcgacttataaactttgggtctataaactttaggtgtataaactttagatgtatagaaatactatatatagaaaatatttgaattcaaattcaaatttgaatcagatataattcaaattcaattttgaatcgggtatataaactttaggtctataaactttaggtgtataaactttagatgtatagaaatactatatatgaaaaatatttgaattcaaattcaaatttgaatcagatatttgaattcaaattcaaatttgaaacgggtatataaacttttaacttataaactttaggtctataaactttagatgtacagaaatactatatataaaaaaatatttgaattcaaatttaaatttgaatcggatatataaacttttaacttataaacttttggtctctaaactttagatgtgtaaactttaggtgtataaactttaggtgtataaatttactaaaataggaaagtaatgcggtgccaaaaaaggaaaccaggtgaagggagagaggggggaggtggggagcgaatctgatcgctaccccatccccacggcgatcgatcgcccattagaggtacccatggacacaatgcatgggatatatatatggaaatgaacatgcatgagataatccaagctctttgcggttgctgatgtggatgatgagcctgaatgttgacacaattaatggcactgtcagcgattattccacagctgaaatatctttaaacagttcaaaatatgatcaactaaggccctgtttctttcagcttgggattattataatccaaattattgggagtaagctgaaagaaacagacaacttattgaagtagcttattataatctggagcctagcttattataatctgataaactcatttaggtgagctttttccagattattgggtaaaaaattacccaccatgccaccccactccctctttagacttacaaacccaataatctaggctctaataatttaggaaagaaacaactaaccgcttatgctactacagattataacaatatagtttatagttatctgagtcaatgatctagattataataatcccaagctgaaagaaacagggcctgaatacattcaaagtaatcctataaattatttcacgaacgcaaaaaaaaagaaaagaaattacacgtcattctattagaagaagtaaattaaggaaattaagtttttacacgacgcacagccatatcgcccaaccatctacttcccaaatcaagctcctacactacaataaaaatgctttgtagagacatttttctagtactatagaggtacttatcaaatgactttacaacaatgtagaggcattttaaaaaatgtctaataagtgtcttatggtgaattgtctctacaaacgaaaagacattttataaaatgtctataagatggtagaggcattttctagagacattaaattgtaccgcaaacatataaaaccaatccaaaaaagataataaaatagtttccttggttttgacaagtgttgaactcatgatctcttgattcaatcattttaatcttcaatacactaaccaactcaactccatgtcattacttgtatgcttggtcctctagttatttatatttagtcctttagtacatattatcattctaaaaagtgtctctacatagtttaaaatgtctcaacgaaatgcctttatatattagacgcattttatagtgccgaaagaatgcctctacgagataaaatctaacaaactgatctaaaaatgtctctagagtaaaagttttctaggcaatttttaaagtgcctctataaagtgtctctacactataaaacttctgattttagaagcaatttgcaaaacgtctctacaaaagtgcctctatacgaggtttttgttgtagtgagctagaagaactagatgcaattaaaatacaaaaacaaattaaaattaagtagcagattacccagccgcgcgtattttcattcacctaattaattaatcgcaagccagaaaatcacaacacatatatacttaattatgatccatattgatatccaaccagccacaaactcacaaattaaagtctcacaacacaacatcgaaattttaagagtcgatccaaaattatatagagttttggactaatattaaccaaagcacattaccatgcatgcaccccagatcgatatctagaaccgaacttgatgaagcaaccaaagacgacgacgataactaattaagcttgatcttaatcctcgcaacttaactgaccatctcatcgtcgacatcgatcaagattcaagatcaagccctagctggggcgagctcgctcgctcgatcgaccgatcagttcatggcggcgaggcggtcgacgaagatggcgaacgcctcgtcggtgtcgagcatgctgatcctgaccaccctcccgtcggcgccgaacttgccgccgccgcggctgatgatcttgcgctcgcgcaggtacccctccaggtcgtccaccccttccttcccgcagcgcagccacgcgaacgctgcacccaaatcaaatcacatcatcaatggcgatcgatcgaacacaaacatgtcagcaatggcgatgcgatcgagcttcgtgtgtgtgtccgtacgggggtaggcggagacggtctcgttggcgaaggtgcagtggccggggagctcgtcggggagggtgaagatgccggaggcggcgacggcggcgcggagcttggcccagcgagagaccatcttgcggcgggcgaagtggaacagtcggctcgagtcgtcgtcgtcgtcgccggcggcgggcgcgcggtcgtagccgtcggtgatggccttgaggatcttggcggcgcggagctgcgagtccttggagacgccgatggtgttgagctcgatgaacttgctcatcttctgcgccaccgccctgtccttcaccagcgcccacctgtgccaaaaaaagccaatcacattgagccaaaatttgttcgaatttcaaaagtattcgtacgatgaaatttgtgtgtacgtacccgaggcgggtgccggcgtggccggtgcacttggagacggtgaagagcatgatgtcatgggcggcggcgctggtgatgggggtgtactgcggccagtagtaggcgaggtcgtggacggcgacgccgtcgccggacttgagcacggcctcgcggatgccgccgtccgggttgctcggcgagcagacgagctcgacgtaggtgtcgccgtcgaacatcttggcgtcgccggcccacctgtacagccccgacttgaggaaatccgtcaccgccgggtacgactgcgccccgccacgccgcatccacacaacacaaaagatatattgtgtcaaacaaaaataaagattaaatcatgtcaagatcaatcgtacttcctccgttttacaatgtaagtcattctaatatttcccacagttcattaacattcatacttccttctagatagatatatgtctagattcattaacatcaatatgaatgtaggaaatgttagaatgacttacattgtgaaacggagggagtatttaactttaccatttctatcatttcgagttggtaatatcagtctatcttgttgatgtatttcttttaaaaaaaatcgcaacaacttagatgatatgcgaactatgagagaatgtcacctctcgagagtttagaatagtttccctatcaagatcaatcagaaaagagtaattttactatatttgagaatgtagttagaggtatcacatttactagcataaaacttatatttgtacttatcaatttttaatgtgaaatttaattaggtacttctcaaaacttttaatgtgaaatttaggtatctcaagacactttctcgaggaagaaattttacggatactgagaaaatacctcgtagtacctaagttttacactagaaataagaattttggtaccaagttttataaaataaaacttggcacctccatgtactttcttaaagatattaaataaatctacctttctcaaggacactaaaatttctaatgagaaaacgaaaaactacctttttcaaggatgaagataccactagaaaacatggcatctccaagtacttttccaaaaatgataaaactacatttttcaagaactgtaaaatttctcatctggaaaaggaaaaaacaaatttgattgcaagtgatgaaatcggattgataaattacggagtagtatggtgcgggggagacgacgttcatgggggcggaggggcccggcggcgagagggcgtagagcgcggcctggaagagctgggtggatccggtgccgacgagcacgtggtagccgtcggcgacggcgttgccgacgaggcggtggaggcggcgcacctcccgctccaacccgggctccaggaaccagcacaggctgcccacgtcggagaagtagctcatcgtctgccaccccgggatcacgatcgtcgccctctccccggcgccgccgcgccagaacgcctcgtacatcgtcgggtcgccgctgcgccgccatcaccacaaagagatcaagatcggaacaaaactcactcgccacgccacgccgcgccacgccgcgccgcgtcgcgacgcgaggcgtcacgtgtacagtgccatgcatggacgaacaggtggtcgagatcgatcgatcgatccatcgatccaccggcggcggatcagacgagaacacttactggtcgaggttgatgattgagtccttggtcaccggcggcttcccggaggacggcgcgacctccgcctccgccttcttcctcaccgcggcggcgtcgtcaccgccgaagtatctccggcggaggtagaacgcgagcgcggcgaggttgaacgccacggaggcgaccaccccgagcctcccagcctgcgccgccatcccgccaccgccgccgccgccatccttgctgcccatcgccgccatgaccaactcacactcactctcccttctcctctctatttatagataggggaagtggttggagactggagctgagataggggtcccctatttatatctaaatcgcgtacacgtttcttcctatttttagcaagcacggcgtcgccggcgccggaatatttcctccgccggcgccgacaaggctaccggcggcggcggcggcggccggaggagatctcgccggcgagggagcacgtggggggagcgagcggtttcgatcgagatcacgaggagcatggagagtttgttcgatttgtttggttgccccggattaaggaaagaaaagaactccatcgatcgttaaacctcggtgattaaggttaatgacagtgcgcatcatgcaataatgacatgtgtacttgatttatttggaaattttaaaattggaaattagagttggtgtaaaaagtatatatagaaactggttttatttggaaaattggaatgcaggcacagtcatgcaaccggggttaattaattggatcttgttgagtgctaacctgtgttagaggcgatgactgcatgcatgcttttgtttggaacttttctttatttagattagcatatgactcagatctattcgcgtggataagtacaattgccatattttaacttaggcccttattatatatagagtaaatttcacaaaactacatatatattgaccaaattatcacaaaactacatatttaaggagttatatcacaaaactacacatttagcaccaaatttatcacaaaactgcagattttaggttaagtatcacaaaaatgcatatttaatattgaacttatcacaaaactacaacttttggagtttaaatccctagcaccattgttatggtggagctataaacattattactttgtgattaaattggttctaaacctgtagttttatgataatttagttactaaacgtgtagttttgtgacacttcatcttaaatgtggagttttgtgataaatttagtgctaaatatgtagttttgtgatacaactcctcaaatctgtagttttatgatagtttggtcatagtatctgtagttttgtgaaatttactcttatatatatatattggaagaagaaattaaaatagctgcatatgcaagaacaatatacagagaaaactctattaatttgatctccctgaaagattatgcatattattgttatagaaacattagttatttttttcttgatgaaatttatatatcgaatcttagacgtcgattgatcatatcaacaacttacatttgcttgggtcattagttttttttttacgaggagcagaggtagagttgcataatatgttgaaaagaaacacgtgagtatatctataaacggtttatagttaaatagatatagtgaaaaccgacaaacggatgtcgccttgcgcattttccataattggaaagaatgatatgttttggttgggtacgcgtttaacgttttgtatattggaaagtaacctatattataaggtggtgtgtgtgatatccttaaactatactaaaatagattgacaacctccatcgaaagcgacaaaaaaaccgttccacaatttcaaatacaacaaaagcgcgggaaagaatagaaagagtgtgcttactcttacatcctgtaattataagacctctacatgtatggtctcatccctatgcaaataaccttgggtggtttttccatcggttcagtgatgctagcaaccatcaatgaaatatttttattttgacaatgcatttagcaatatatatatatatatagtctggcacccaattatctactaagatatatgggataatggttttgtttgttcaaggaataaatatccaatatggagtgataaagcaggtaaagacattgcacattgcgtgacataatttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23790 - DNA, 502 bp, Oryza sativa
caatatacacagtgcttcgagccttattatgacgattagttattctacacacacagaaaaatatgcattggtttataaaagagtttggtgacttcaattaatcaccaagttgcttatttttcagcagcaacttagattgcaagtttagggctcatttgacattctgtttgtagctatgagcctacaagctccgtttaagttggtttgtatatattgcttctgttaattgttttcttagtaatgtctgactatagttaccttaactccttactctccttattgaagaataacatccatgagtgatacattgatactttaagggctccacatattctctctgagagagagagagagagagcgtctgtattcaatgattggtaaaaaccacttctgaggaattaaaaagttaacttaccattgtagatcagcctattgttggtgtgcatcccctgctaactttcctactgtcgtattaaattgtgcaagcacatggcattttttt

SEQ ID NO: 23791 - DNA, 603 bp, Oryza sativa
tcatgttgcctttaaattttgtatatagatccttcaagtcctttttttcagaatctgaccctctgtacttagcttcaaattcttcaatatcagcctcagtaacctgcagaagtgtaggtcatcaccgatcattgtataggtgaacagatagcacaagtttttttgttgatatggaccaaaaagatacctttttgtaaacagctctgaagtactcttgaagattgctgcagcttctccaaccagtgcctacaggaaaagacaaaacttcagaaaatctactgggagtgaaaggttggaaatcacactacttggaatcaggtgctcacatcatcatcagcaattccagtctcatcatataatgcccttttctcctcatcccaagaatagatatcaccttctgaagctgctgaaatttctccttggcttcctgacatcacataacagctcaattgagacaaatggcacttaatccatggaaaaaatttggaaacaagatcctacctcatctccaggattcttgtctggatgaagacgtaaggccaacttgtgataagccttctttatttcctgctgtgaagctgtcctctcaacccctaagatctt

SEQ ID NO: 23792 - DNA, 757 bp, Oryza sativa
ccacgccatcctggtaacttttctttcagctgctaaaatttacatttttgtgatatttgatgatattctgaatccagtagtattcatgtaggaccataagacatgttggaggtgccatgagaggtgctggtgcagagcaaatctcagtccttgtgcggtcaattgtagagagcaaagccagcaacaatgtattgcgttacttctacggtatagggtacaagttagatcatgaagttctgaagggaggatttgcatttcgtttccaccgaggtgcccagataactgtgaccgttacctctgttagcaagatgacaaaactccatgctaccaacgaagctgtgccaatcactcctgcaatacagctagtggaaatcacggcccctgctgctgctgacaattacaacgatgtcgtttcagccgtcacttcgttctgtgaatatctagcaccgtaagtaactaagtgttccttagctatctcaagattattactagactggcataaacgaattttctcacttttgactgcaaaacacactgcaggcttctgcatctctctaaaccaggcaattcgactggaatcgtcccgactgcaggcgctgctgccgcctcactcatgtcaagtggtggtggtggtggtggtaaaacgttgtgatcggtcatatgtgttggctgcaatgccatgatgatctccattgaccatcccacttaaaacattgttgccatctttagttctgtaacttttagtcagtagcaccat

SEQ ID NO: 23793 - DNA, 788 bp, Oryza sativa
cgaccacacacacacacaaactcatgcgtgagcttgagccactcagaatgtcgtagatcagctgaagacgaagatgatgagatcatcggagctaattaagttaccttgacgacggcagccttgccgtccttcccggaggccgacggctgatcggccggattattcagcctcgacggctggccgccggccgccgccgccgccggcggccgcttggaagagccggcggcgatggcgagggcgttattggacggcgccgagttgatagccgccatggatgatgatcccttgggagaaggctcgccggcgtgcattggctgtgaagggaagatgttgagggtttctgcatccatgtagagatcagtaaagtagcgattcagaataatactgagaaacatatgtccaaaaatatatgcatgttgatgaactaaattgtccaaattaactatatgtaatgcatggcattaattaatatattaacacatatatcaaatggtgtaacagcatgtcaacatgcatgtggttgtaagttctgttgtttcacacttatggtcctaatgtaaattaaagtatgaaaaagtgaacaaaagggagagaatatatatgtgtgtgttcatgtttgatgtcctagatatgtaaatagctagctagctagcagtagtatatatacatatatatgcaaatcgttgttgcaaatgtctctggatgattaaggttaaaaatgcatatatctagcttgctttagcattacatatatgtgtatatacgataatcatcctagcaagaacgac

SEQ ID NO: 23794 - DNA, 571 bp, Oryza sativa
tactatactgaacatttatgccttccttcccttagtcatttaagccatctgcattcttctaaatcactgcaacaacaatatttatatagataggcaacacagcaagttgagctgttaaaatgccagagtaagacaataatgagtatcatatcatacttttcattcgttctccagaatgccccagcattgtcgataaccatcttgagcaactcaagagacaacaccttcccgcgcagcaggacctgatcttcgggattatccggcgtcgagaacttcatggacagcttgcacaggttcttgaacagtgtcaacccatcctccctgatcttgctcatgacaacatcctccttcccatccgtctcggccggctcaaccggggaccccggctcagggacatcgcttccctccatcgtctcgtttatgaagctctgcgccgcatggacaatgctggagtcattcaggttgcggtcagacatgtccatcatgtcggtgatcgacaccgtgcgcacgcgcacatccatggagtccacctccacgcgcgcgaacacgatcaccagcacctgcgccagcg

SEQ ID NO: 23795 - DNA, 711 bp, Oryza sativa
acgtgcaccgcgtccgcgagcgcccggagacgacgctctacggctcccgcacggtgttcttcctcaccggcgccggcacgctgtcgccgctcgccatcgagctggcgcggccgcagtcgccaacgaggccgcagtgaggccgccttcgtccacgggcccgacgccacggcgtcgtggctgtggaagctcgccaaggcgcacgtcctctcccacgacaccggctaccaccagctcgtcagccactggctccgcacccactgctgcgtcgagccgtacatcatcgccgccaaccggcagctcagccggatgcacccggtgcaccgcctcctccacccacacttccgctacaccatggagatcaatgccctggccagggagagcctcatcaatgccgacggcatcatcgaggagtccttctggcccgggaggtacgccatggagctcagctccgtcgcctacgccgccacgtggcgcttcgacgccgaggccctgcccgaggacctggtgcgccgcgggctcgccgttcgacaggaggacggcgagctcgagctcaccatcaaggactacccgtacgccaacgacgggctgctggtctggaacccatcacagtgggcgtcggattacatcgacttctactacaagtccgacgaggaggtcgcctgcgacgaggaggtgcgggcgtggtgggaggaggtgcgcaccaaggggcac

SEQ ID NO: 23796 - DNA, 1303 bp, Oryza sativa
tgaacatgtgctccaagtgccacaaggagatgatcatgaaggaggagcagcccaagcttgctgcctcctccatcgatagcattgtcaatggttgtgacggtgggaaggagcatattgttgctgccagtggtagcacggcggtggcggtggctcaggtcgaggcgaagacgctcgttgtgcagcctaccgatgtcgcgggcaccagcgaggaggttgctgtagtccccaaggtcaaggaagggccgaaccggtgcgctacctgtaggaagagggttggctgacgggattcaactgccggtgcggtaacatgtactgtgcgttgcaccgctactccgacaagcatgaatgccagttcgactaccggactgcggctagggatgccatcgccaaggccaacccagtggtgaaggctgagaagctcgacaagatctaaggcggctaggggcgtggaatggattgcaacctacaagatttcaacatccacctttgctgctctatcctccacttttcttgtcggctgctacatttcttaaattgttcaactttgtgatgcacactgcatcctggcagccgaaagaattcatcctctcagtcaagtcaagtggtttgcgtgttgggtatgttgtgtaatctttattcttggtggctttcggtcagtattgtggtgtctcatttagctagctctgtgatgtactatgtcccatgcttgctacatttcaatcagtaatagttatcagcaatggtccatcatattgccaacatgtccattattcatttttccttaaagattatttatgtatgcacctttatctggtgcgcattcaaattcatgtatgttcaaagaagtttgccggattgtgcttggttggctgggtctactctagattgaaaatcggatctgagaggaaattgtgacaaatgaaagttagttctcaggttattactctatccccaaatggtcattctttaatgctactgagaatagttgggattagatctgcaacatgtaacactgaaagttcagcatgtgaagctgttctgtttcagtaatctgggatgtagttaataatctgccttaaagttcaaacatctattaacttgtgatctgaaccagcatacatattgttgtcacgaagataaccattttgtcgattatttcctggtgcaaggcagctgcagttctgattcgattgataatttcacagattctgacatctgctaccaaattctgccccccttatattatccaattgaaatccttaggtggataatttcacagatgcttacattttgttatatcact

SEQ ID NO: 23797 - DNA, 178 bp, Oryza sativa
tatgcgtcagaaaatcccaagaaggatacaacttgaggaaaatttgatggtgcttaaaacaacacttgtatacgatgctcatctcgatcgatcggcttgactgcctacaatcaatacctgttgttaagcttatcagcgttcctaaaacaaacaaacaaacatacaaacaccaactcca

SEQ ID NO: 23798 - DNA, 12464 bp, Oryza sativa
  unsure (1)..(12464): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacgatgtggttggcggcatcccggacccgcgcgcgcgcatcgtcctcggtcccgggggggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgtcgggcccaatctcgcccgccaagcgaagggcctcggcctccccggtggagaagtccagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagcctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagataaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcggcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagtaagaaaaaacttccttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgctgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattacgctcgccgaccgaagcggcgttaccgtatctccgggcgagaccaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaatttgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcaccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggaactagggtgttatctcttagagatggcacgttagccctggtcagatttacaccaggcttcatcctaaccattacaggcaaggtgttacacgaaaaagggcaaacatgcacgttgttaagctgacgcgtggtgaacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagggggacgggacttttttcccttttggaaggctgaggggaaagggagttaatcctttgtgactcgtccatacacaaatccacaaaaacacaggagtagggtattacgcttcgcagcggcccgaacctgtatacatcactgtgtctcgtgtgtcttgcgggcgggtgatctttccagatacagagagagagagagcttgagatctcaccctaagcccccggccgaaccggcaaaggggggcctgcgcggtctcccggtgaggagccacgagctccgtcataagcgcactccctccatccaaatatatactcccttcgtactccgacatgattttcgagatgctactttgaccaacaatatctataaaaataaaatgttttaaataaaaagagttgcatattatgatagtttgtttaatgataaatctagtaacatcaattttacgtgattaatcttttttatttttttgctattaatagtcaaagttaaaaatgtttgacttatccctattctaaaaatgtttatattttcggacggagggaataagatattaggactagatgtgatacatcataatactaccaatctattcagattcatagtactatgatttgtctcatccggttctaatatctaatgttttggaagagagagagtaattattcatgtgttaattagcaactccattttatgtgtcgacggggaatggttcctaacccattcaaaaaaacaacctgatgcctagttctaaacttctttaattcacagttttcgtaagcacacttctcgaaccgttaaatgttaaatggtacatggagtgaaaaattctatgtagaagtttttcttaaaatcaaataaatatatttttaaaatttataatagctaatacttaattaattatgtgctaatgagttatcccattatatatgtgccactaatattctccttcattttggagtttcgaacgagcctttagaagccgtatttttacagatagacaaccttgcgttgtgacacctagtttcatatagataagttaaaaaatagagatatattttgtaaaagaatttgtaacatatggtggtgttcgtttctaataaaggtgaaggtgaagctagggcacaaatcaagaaagccattagcacatgattgattaagtattaattattacaaattagaaatttggatttatttaatattttaaagcaacttctatatagtatctaatattttaaagcaacttttatatagaaaatttatcggatgaaacacatcattcactggtttgaaaaacatgctaataaaaatcgaggtagaatttgtatcttagataggaaagaacgggtggtactttggaacaaagttccttaaattcctttaaaattgtttgctctcatgcagtacaagcgtgatcaatcatccttcccatcccacacacaacttctgtccaataataaatggatctaacatgagatttgatattatctatgacaatgaatcgggataggtgactaaacagatgtatattcattatagtaggtagcattacatcttatattagattgatttattttaggacggagtgactaggcaagtattattcatgctcctacattatacatataagtattttgaatgcaccaacaggttattactaaacaatgtctttttttagattggaaatggattacatctccggtctctgctcgtgggcatacagcaaaaaagtctcagaagtaaacataaaagaaattaaaaaaaatacatgataggataaacccccaacttctgccaataagatgatctaataaaataatgtttccaaaatcaaatagatgtatgacaaaattctgtaggtactacaccatctaaactgtaataaaagttccttggctataaattccaaacgtgtagcatcattgtacatagtatcttatctgttgttcttgtgaaagtatcatacaccaagagtgaagccagttggaacacatgaagataacatgcatgatgctagacatttttttatggttaaaaattacaacattacggcaacgacagattgaccaacatagagcactaactccaaataaaatcattttttagtctaggcactccccttagccagttaccaaaaatatcttttacattttggaaaagggaatattaatgtcaaagaagacatatcatcaagaaaaacgtgcaacatgacagtaagagaaaagatattggatggtcttttgtatatttaaaaaaaaaacagattagattgcttgttttccctccattctctctttgtgaggttatctttcattaagataacccaactatacatctcaaatagtgaatcgcatggatttccattttgtaggttaaacaatggtgtatgtcaaatgggctaggaaatccaaacgtggcttaaccatcaaagtactgtgtccacaatgctagcttgcatgtagcctttttttttttaccatatggtcaaatagattaaggctgtatttagatccgggggtgaaaagttttagcgtgttacatcagatatacggacactaaattgaagtattaaacgtagactaataacaaaacaaattacagattctgcctataaactacgaaatgaatttattaagcttaattaatccatcattagcaaatgtttactgtagcaccatattatcaaatcatggactaattaggcttaaaaaattcgtctcgcaatttacacgcaaactgtgtaattagttttttttttctctacatttaatattctatacatgtgttcaaacgttcgatgtgatagggtgaaaaaatttgccagaggatctaaacaggccctaatccatcataactaatgaggcaaacattatatccctatacgttattgacactgtttaatgctaatggtatacaaatataagtatcatgtacatatatatcgactccatgtaaaatattcgtcctatgtttttttttaagaaatattcgctctatgttattgttgtgtacttgtgttctgtgttctcttttatgtaaaaatgtttatgccttttatcttcatcgtcattttgccaccgctgaataataagcagcctcctctctttacatccttcttatttatcttagggaggaaaatttattataagaacagtgagaaacttttttatatatgcactgaaatatgctgaatacataaatcattaggtcccttcaccaaagcttgataaaaccacgcggcgtaacgtacaagtgaaaatgtgaaaccaaggtggtttttgtcttaaagcggggtgaagcaaatggcattgaaagttcagagattgaccatcatgtttgccatgctagctgctactccctccgtcctataaagcaacctagtaccagataaaacacttcataaccatgtctggattcgttgtacttcatagtagtgcaatggttctatcaaatgaaagcaaaacactgttttctgcgtataaatcatgaaatcactgcgatatattcgaatgattccctgctcttctgcctcaaataagtaacagagagatattttacatatcttgcctaccagtaacaatagattggcacttaggtgctgatgcacacgtataaccaagcatgaagatacaacccgagatttagtattgaattttttaccagctgaaacaatgtgatgacaggtatccgatatgaataagcaagcacagaagatgcctaaacaagaatcctggaaagttacattaacatccatcgatctatttttcaagtgcaaagatgaccatattgtccagcaacaaacacagcatgtatattcttatgtgatggtcatgacatgctggctgaattgagtcactctactgcaatgttctcaatatgctcacaagcaaagcctccacccaaaaaaaggaaaaaaaaaagggttcctgtttctccaaaaatatgtagataaactgtgaggtcaaaacacttggaacttccattgggtttccgaaacgggacttctacaactaccatccatcagcttcctcattcgttaaaacacctcttcagttggtttttaagaaatctgaatcaaacaggaaacattaggatatgtttgaatagaatgagcggtataaaaaaaatgaaaacataaacaagtaaatggaaaactatgatagtccatctagccatttctacttaagaaattgaaaagagagcatgttatcttttattcaagtcctgattcagtactatattacacaacaattttattttatattcatgtctttattcagcagaatacctaattatgatttttactatcaaatcgtagtagcaagcttcatcatcttagactcttaggcttgataagagataatattttaggaccaaagaatgacagtgactcagcatgattacaatgcagggaatcctttcagctcttacacaatactattatgttttataggcaaaagtttctagtttgcacttaatcacatctactgcttaccttccatcaattttttttatcccagcaaaaatattacatgaagcttttaagtggttgctcataatattatacacaatgcaacaaactataattaactcttatgaaaatagatacttataatgatgacaagaccaaacacctttaaggcttttatacttagtgacttggttacctacttcatattttattggccaaatttggagtttgctttatgcaatgctgtttaaacaacagctataatctgcttttttatgcaaagtcaatactgaagagtaaaacatgactgataatttttagtgtactttaccctaggatgcaccttgtattagggatggatccaggagaaaatatcatctaggtcactaatcaaatttctttaaaaaataatcgtgccattgcagattataagagaaatttcttaatctaaagaggacttatacagtgattggcaaagagtaaccggtgtcaaatgacagtgatgaatgtgtgctggatctgccccttcgtctaaagtgctaccacaagacggaagaaaaagcaatatttgctcaaatgttatgctaattcaactaaaatatccatcttatcttataaaatggcctttcatgattcggagcacacacttcaagaaaataaggaatacaagcagtgaaaagtggtaatcgaacggcatccatgtatggtgaaaagaattaacaagacgactgattgaataatagttagcttaatgaagtacctgctgacccatttgctgtttggtctcaagtcatcttcttcctatctacacgaaccaacatgtctgataaactcttgcttttcgcatccgccttgttccttgaaagagtttcttcaatcacaaacagaaggattttcaaaattttacaagagaaaacaataatgtaagtagatacacgtttccaacattgcatattgaagtgacaaaacaaatgatactaccagtaccactatgcacaagctaagcctcccactaacattataccgtttcaagtttcaacagagatgtaaaacgaacaaagtcctggatctatctaattaacacttaataagcaaatctggtgtgtcaagcatgcatgtacacgggagaaatcacatgaaagatgatcacctgcacgggggatccggcacgatgcaagccacggagggagcaaacatggtgtaagtgtatccacggatggatcacttccacctcccagcgtgcacccaagcaaatccccattgtccatgtctatggagacaacctgcctgccaactacgaggtgcatgcagccagcgttcagtgggtcaatggctgcgatctgcggcgtgttcttgcagaggttttggtcatgcggccagagccggctaagagccacgcggtgctccagcgtccacccgccgccgtcgtcgtcgagggcgaacgaactgagcacgtatggctcctcctggacacctcggcgtagcgcagcctcccctcgctgacgccgacgcggcggaacctgcgcagctcccggcgctccttctccatgggctgtgtcacgctgcctctcggcagctcgacgaagcggagctccgggcgatcgctgaaagggtcggcggagagggcgccccagctcaggtcgacccaccacagccggccggcgaaggccaccacctcctgcgtggatgtgttcatgcgacgccggtggagcgggagcgaggacggcaagcccaccagcttgtcccacttgcccgtttgtgagagaaaccggcgcatggcgaaccgttcgtccccgccgcggtagcccaccgagtcctccctgaacaaagcgacggcatacctgtccggcggcccgtgcgggcgttcggattgggtgaggatgccgatgtcggagaaccacgcggtcttcttggtgccgtcgatgtccgggaggccgaacagctcgccggagatggggttgcacacgaaccgcgtcatgtcgggtcgatgctgatgccagtcagcgcgcgccacccaccgccgccggggacgaggggggccgtgccggtgacttccatgaaggtgaggaggaggaggccgtcgccgctcgcggccttgacgaagccggcgaagaaggcgttcagctcgtccgtgtcggggtcgggcacgcgcggcgcgtagccgacgaggtgggcgggggcgatgagcctggagccgcacgggggctccgcgagccggagggatacgcgccgctcgggagatccgaccgccacgtacttctccaccatcgcccacggagggcgccgcgacgccgtggagagggcgcggcgtacgggcgcggacgcggcggcggacagggcgcgccggagcgggaggcgctgcatctttgggcggaggcggcgcgcgtatcgtggcgagcgtagcctagcctagcctaccctaccctaccggagaaggcgaggcggcggggtcggttgttcacggtgggtgaggtccatggaaagaagtggagctctgacacgagcagcagaggggcagggagccgtgacgtccggccgtgggctcggtccaccgtgagccagggcatttggagccgagagggtttcgcaacggtgtggcccggtgcgcatagactcggtgcagcattttgcgttgttctacttggtgacgttacctgtctctatccatctgctcctgcctctgtacttgttcatcctttttgaacgatccgttgacagctggcctacaaaaagcatggcaacggtttcccgccaaaatgctcaggttgtgtcggcctgggagccacagacggtgttggcccaatgggctgtgatcctcaaggtccaacgtaacaatatgaagataattcttcagttagaattagccttttgatttgtgtactactctctccgtctaacgaagactttttttttgtctgcgtccaacgccaacatttggttgtttatcttatttaaaaattttataaaaaaattagtcacgcataaaagtactattcttgttttatcatgtaataacaacaaaaatattaatcatagaaaaattttaaataagacgaagagtatattcaaaaactggaaaatgaaatcttcgtgggatgaagcctgaagggagtacaacgtatctcgtttttcataaccacgatgtattttttataaaaagcgggctgcagga

SEQ ID NO: 23799 - DNA, 56747 bp, Oryza sativa
ttttataaaaagctttttatatctttttataaaaaatcaaattatagttaacaattaattaatcatgtgctaataattttgcattccaaaaaatcccacccgttcagccagatcgaacaaagccccccccccctccccacgtcggtgtgttttgctcaaaagagagttcagagcaacttttgcattcgtctcatgaaaacactactacattaaggattttcccgtatggatgaattcaattttcgcgtgtagagaatttgaccgtctggaaggaagtatctgcgaaaatcgcgactttttcgtgcaggcgacgcacccgcgcgtgcaggcgcttaagccacccgcacgggaaaatgaaaaatcgaaaaaaaaaccaaagcctaaccctaatccagccgccgccaccgccaccctagctgaggtccgccgctgtcgccgctgcaagcgctggcgacggatccgccgcccgctcccatcgccgccggggaagggaggggaggagccgcgggctgccgtcgttgtcgtcgccgccaccccctcccccatgcctcccctccgccggatctgcaaggggaggggccacgcgccaccgtccgccgccaccgctgtcgccaccgcctacgcccgtcgccaggaggagatcgaggagagaggagtgagagagagagagggaggatagagagagtcagatcggccggataaataaaagagagagagagggggggacttaggcgcgcacggataggggaaaggagagaaaaagggaattttttgaagtgggtaggagggaaactattttcccctgcggttctcttaatatattgcacgggaaatttggctcattttcacgtgcagcctatttaagaggaccgcacggaaaaatcgattttcccatgcagtcctcttaaatggatcacatgcgaaaatgagctgatttttccgtggggtgtgagttaccgcccgcacgcaatgatcatttcaatagtagtgaaaaatcaacgtttgagaatatattcgtctcataaaaaatcaacttatgaaaatgaacgggtcaaatgcttccaacttatgaaaatgaacgggtcaaatgcttccagattccttcattgaagtttctttttatatactcctgtcaaaaaaaaaaagccaacctaggattagggtagccaacctcctaatcctaggttgacttttttttggacagagccaacctaggacccctaggtttagctcctaggtttagcttttttttttggacggaggaaatatgtagagagtaatatcttagtatacgcaggtactaccaaccttggttacagacttacagtaaaagcagactgtttacttaccatcagcagattggcagttaagttcagcatgcatcaatagattggcagtgcatccaacattgatgcatttccaacttaaaccaaattatactaagcacgatctcgcgttgtaaaaagcagactgtttatttttctggcaagcagggttaacgatgactaatattttgggggctacagaagtctaatggtagaaacaaaataaataacaatgcgatattcgcttcaattgagcatgccgaaggacaaagaatgcaataaaaatggcaaaaaaaatttccaaacatcacattcgaattgcatgaatcagacaaccaaatgtctcaaaaacttcagcaagttaccaatttactaccatcagtaatcagactgccagtcatcgattgtgttaacacacaaagctgccaatcttccaacagattaacatcaaatagttgctcatcttcagcagatcaacatcaaatcaaagagttgctagaaaacgagtatctaagatgacatacacaatgttttccctacgtccaaaaacgaagactcgtaattgctgccaacatgaacctacagttcaaagcaaactcacttagggaacctttgctcagctaattttaagttcgcatgcataagtgaaactcgaaattcagctgtcagccaacatttccaaaaaaaaaaaaggaagtttatgtagcactaattgcatcgtagtgcatcacttcgtaagaaagaaaagcttcctaatctatcagaagttcagaacaacttcaacaaaagacttcctaatctatcataatggctttcactttcacctgttaaatttcagaaatctggagataacaagttaaacgttagatacatcttattgatcataacaagggagtgacatgagaaattaaccatttcttcttgctactataaaaacacgtattaacagaaataatagtgtactcccatatacctctttgcagtttcatatagagaaaagtataattgcatgtttattttccatgtgcatttttttgttgcatcaaaaccttaaggcaggatagcttgataaagaaacattaatcattgtagacagtaactcaagatgccaacaaaactaaaggtttcatttaggtttacaggacgaatttgaagcttgtgtacctccctatcatgagaaaaaaaatacgaaggttgagatgtatacgaagaaattatagtcatctatcacaagaaggatgattttatgatgtatataggggtatttatatctctcgttgcaacaaaaaataactacttattacacaaagataaaatacgtccttatgtctcacaaggatgggaaatactcccatcaagtcatacgaggtagtttaaatcatactgtaacaagtatgtacagctaatagaaggtcttgagtaaaatgcaatatcaatattttttagcatactcctgcatagtgaatctaaactgcaactacaagagcactgtagataggaatattttactgtttgaaacctactccctccgtcccataaaaaacgaatctaggaccgcacatccggtattaggttggttttttatgggatggagtgagtaagtagtagtcattttgtaaacaagcctgtctcaaatgacaacagggacatataggcagagaaagtagccagccataaatgcaatttccttaacacaataaagaatgaaatagttggtggttcaaaaaaggataactagagaaagtaccagatatatattccacaaaccatttccacagggtagaaaaacttacaatatgatcacttgacaagaaacaggaagcaatttacttagtagctcataatgacaacaagactaccgactttatttaggcttgcatcctagattcctagactaccgactcataatttactgtttgaagtttgtattcagtgataactggcagataaaaccacagctacaacctgtacagctccaaggtctatagtatgacatagtagccatagttatttgtgtactgttttatggtgaggtgaatttaatttaaagtgcaccacagtaatggtcagcaaaagtaactagtcaggactcatgtttccttaacataggaaaggatcaaatatatcatctatactttgttaaaagggaatagtggtggtggttctgccaccacccccatcaaactcccaaccttttttgagaggaaaaagaacaggtgaggctagagggctcacatgtcaaccacccccaccaactctctacattttggaaagaaaaatgacaatgtagggtcaaagggtccatatatcagtaacaaaatatatgtggcaactaagagatgatatgtgcaaagaatgttagtaataacgggttgtctatactcctttaaaagagtgtagtactcctttaaaagagagttgtcatggtggtgattctgccaccacccccaccaccaactcctaccttttctggagaagaaaaaggagaggtggggctagagggtccacatgtcaaccacccccaccaactctctactttttggaaagaaaaaggataatgtggggccaaagggtccacatatccgtagcaaatatatgcagcaattaaaagattatatatgtagaaaatgatggtaataacgggttaatgataattttctttaattaaaattttgttgcaatgcacgggccatatgctagttagacaagaatagcagaataaagtatcaagcgaacttggttctttacctcaattcttcgtgtccttatctgcacgaaccaatatgtctgacaaggttttgcttttgatgttgctcttggtatttggagttcctacagtgagggagttaaacaatacaacataagaaatggaactgtacttttgtgtacattcgtatacagtatgcaagagcatagcatcttgtctctgacacattcaacagataaaccatgtttatacactgaaacatgttcagctcagttggctgtaaatgcataattttccatcaccatttagctccacattgggctagtgcagatcaataacgtactcatcaacaaacagaataaaatggctatgcatgttgacagaaatttaggtaagtttcaagcaatttgcaatgggtatttctgtttttttttggatgtttcaacatgcctacctaaattcccagattacagcaactaattccaccattcaatgaacaactgaaattggaaatgacttatgacacaatactaatatcaaaaaacatccaactatatggtttattttcgaatgacatgtaagacagccttttcccagattgctcccaaaaggagtctaacaatctgatgccaacttatgggttcatgtttggaatctctactcggctaattttaagttcaatatgcatcagtaaacccaaagttgaggactcggccattgttttccataatgagaaattggaatcacagctccaattgcataataatacatcacctcaccgaaaagagaaaaatcctaatccatcagaacagcttacacttgttaaattttagaaacctagaaagcgaaagttaagcagtgggaacgtgcgaggggagtaagtgatatgaaatgaaccaatatttatttattcatcaggaacacaagcaaacaaaaacaatattatagtcccatatacatgtttgttttttactcttctaatagaaaaaataatgtgattatatttttcttctacatgccacttacatcattacatcaaaaccgtatgacaggatcattgtcaagaagcaggaagcaacatagacaatgtctcaagataataacaaggcaatttattttggttccagtctagataagttttcctggaccaatgtgaaattttgcattaagccactcctggcagttcgtaccgtccgtacaataattctaaagtaaatgcatgtaagttctagagtaaaatgtgaaagtgataacttatagagttttagtatagtctattagtcttgcatagtgaattctaaactgcaacaaaaaagactgcgaaatataattgcattaagatatctctcctgacctacaataaatcttcacaaatgatgatacagaatttatgcatgaatcattaacataggaaaaaaaaaacagattcaaaagagcataggttagttgactggacatacataatttttttcatctatcaccccattgaattaccaatccgcacaacacactcatctagaaacagaatcagatagctagcaggcacatcgattgaaatttaagtggctttcagacgcttgacaattagcatttgcaaaaatcccatagattattcatgaaacaaatcatcctactataaacaggcctccaaccacacggttaaatttcaaggacaaatcagaacatatgagcgtaacaataaaaatctgcatattcacatcgtatggaaaacatgcatctcaaagaaagcatgagaaagaacctgcagaaggtatccggtatgatggaagccacggtgggagaacacacggagttaggagagcggtgagacatgagcgagtataactctcatcacctaacagagaacgcccaagcaccttacccctctccatgtcaacggagatacattgcacgccgattttgaggtacattatgctagcattcagtgggtcaatgacaccaatctgtggcgtgtcctcctgctgcaatgggagtcccccatccacccggagccggctgagcgccacccggtgctccagcgtccagctgctgccattgtcgtcaagggcaaaggagctgagcacgaatggctccttctgggacgcctcagcgtagcgcagcctcccctcgctgacgcccaagcggcggtacctgactaggcccctccgcttctcatccttcacgggctccatcacactgccccctggcagctcgacaaagcgcagctccggttggtcgctgagcggatcgacggaaatggcgccccagctcacgtcgacccaccaaatacggccggcgaaggtcaccggatcgtgatccacgaacaatggccgctcgagcgggagcggggacgggaaaaccaccggctcgtcccattcccccttttgcgagagaaaccgccgaacggcgaaggaccactcatcgttgtcggcggcggcggcgtttgagctgaacgaagcgagagcgtacctatccggcggcccgttggggcggtcagattgggtgaggatgccgacgagttgccacttcaaggtcttcttcgtcccgtcgatgtccgggacgcggaacagctcgccgctgagagggttgcagacgaagcgcgtgacgtcgggcttcagttgcttgccgtcgagcggtatcgggccgcgcgcaccggcggcgggggccgcggtgaggccgtccgtgaagtcgaggacgaggaggccgtcgccgctggaggcgcgggcgtgggaactgcaggcgcgcatcatgccgggggggcagggctgcggttcgacgaggtgctcggggacgaggatgtgggaggcgcacggtggctcggcgagctggaacgcggcgcgcggcgacgacgggggcatgagcaggcccgtgtggtggatcatcccccaccgagggcgcgaggccgaggcgccggcgccggcggccgtggagagggcgcgcgccacgggcgccgcggcggagcgggtgctgcatttcggagtcggaggcggcggagcgaagcagaggggggaatcgaggagagggttttgctgcctttgcgttgcggcgtggagggagagtcttttaaccccctgtaccattaagtaagttgaagcttacgcgtgtgccgtaaaaaaattgagagttacctgtccatgacacaaactttcgtttacccgtgtaccattccatccatgttagagaatgagctctgacatgtgggactcacgtatgaaaatgactaaattgcccctgaagcattttcatctctactcctcctctcccgtgcgcctcactcgaaccctagcctagccgccgcctctatagccgccgccgccgccgccgccggtcgtcgccgtcgccggcacgccgccgcctttgcctcgcctcgccggcatgccgccgccgccgccgccgcctcgcctcgtctcgcgtcgcctcgccagatccagcctgctcggcgccggcagcgtggtgacggcggcggcgggcatcggcgccgccatcagggggctcgacgacggcgttctggacggtgccgacgggtggttccagaagatcgtgtcgctgatgccgcaccggccgatgtccatcggcggctcgccgctgtacgccgtgtacgacaccgacttcgggctgggccagccgacgaaggtggagctcctgtccatcgacaagacgcccggcacggtgtccatggcgcggcatcgagatcggcgtggcgctgccggagtccgacatggcgcggttcagctcatgcttcgccgacggactgaagcagctgtgaggacgaacagcttgttgcatttcttgctttcttgctgctacatattgttgcagagttcagagtttgttcagtttgggtgtgattctgtaatgctagcagttggtgatctttttatgtgtggacttagtgtgttgaattactactttaaatgttggtgatatgaacttgttgctatggatgcaagttatgtcatgaatgttgatgctatgaccaagtttagttgcttgaacgttgatcctataaccaagtattattcctgctttttctaattttttttgcattttttcttatttatccacgcatttttttccttatccttttacgaattttccttatgttttcatatgtttgtatttatttatgatttttaaaatttatttacgaattttttttcttatttattccctgttttctatttatttccatcattttaaaatttatttacgaatttttccatatttatttcctgttttaactttattttcattttttaaaaatgttcactttatttcattttcttcaatctacatttcagcctctatgtggtgtgtgagccgatttctcttccaaatgtttcatccaaagtggctgaaatagagcaagggcaaaatagaccttttaaacctccgttagtctccgttagtgctgattccatccaaagtggcgcacaggtaaacgaaaatttgtgtcatggcatataaatgactcaaaacttttttatggcacatgcgtacctccaactttcttaatggcataggggtaaaacactcgaggaaggaagtggagaagccgaggcggtcggtgaggtccacgagagctcggttcacgcggggggagcggtgccgtgttttgaggtaatgaggtagggcccgcatgtcatgtcagggtggtgacggtgtcttgctcctcttccggcttccgcactgcttgggaaaaaaattgaaaaaatatattttttatcgcatttgtaagaaaatactggtttataaactttcatcacacagttcaagacattcgatttaaatttgaaaactttcatcttaaaatttaaaacattttttaaaaattttcaacttaaattggatgtgaaaattttaatttataaaacaaaaaaaaaatcgtgaagaaaatcacgcttgcggcgagaaaaaggtaactaatcacgggagaaaaaaagagcaacagagaaaaaaagataaaaagggaattagtgtttgcgccgccaacgcctacgcgctaattagcgtttcggtaataagcagccttatggcagatgctcattggtctccgtgcctgatgcagcaacgggggttcccgatctttcgatgagaggaggataaacttcgatttggggaaggatacgacgttggctgtccgactacaactaccacaggggtgctgcgccgtagcaactggtacaccgactccacgttgttgctgttcttgtcgtgccaagaacaaccttgaacctgcaagcaatcgaagaacaagcaagaaacaagttgacaaggaaacagctcacggcacttgtcaaatgatgaaacttaaacaaaccaaaatggggttctaaatacaagtatccgggtggtctagccgacacacgcgagtacaaggaagtagctgcagctaaacttacatcaaaacaaaacccaaagtgcaaaatggtggctgctaggagtgtatataggtggaggaatgaccaggagaggaggtgggagcaaaccctaggttttgtggacccctaatgggctgtaatgatacaaggcccaagcccaagtttctgatgtaaagaactattttcgtcattctgagtagcctgggtcaaagttgatggtgaggccacacatagctgacagtagacgacgagatctttccaacaagtactcatttgccccgtttgccctccggagtgaagagcattgacttcatcaaatcagcgctgctagtgctgcttgcgatttggttcctctcccatattcctaacaacaagtagatcacaacaaccatttagtagcacctaattctgagaagaacttgtatgattagctaggaatgactttacctgataattaagttcacgagctcgagctctagtcattggtccttgctgtgcaataggcgtggttgtatcgttggaagggatgtcctcatcagtgcctaatcccatcatatgctcccgccaaaacggtgtttatgtgcttagttattttatgaaaaaaaataaaattatgcgctagagttaggatcgttttttacggatcctttagtcatatgactttgtcattaacatataacctaataaattctgaactaatatggagaaactcaatccgatggttttgtgcattttcagtaatggaatccgaagaaattgagcgagcatagaagattacgatttaatacaatttaccgtcgcatcgacctgtttcatgtgaaaggatgagcgtgttatcttgcaataaacacatcattataaacaaaaaatggcgccgagaactcctgccccgtggttggcacttggcacttggcaagaaagaaaggaacacgaaccaagagagaggccaagaaaggaacacgaacacagtgccggggagctcggttgccgaaggtaatggcgtcggttcgccggagatgaagaggcgatgattcaaggcgattaaaggcatgattgatggggaaaacatgggggaatttatgaggaggtgaagggtaatcgattttcgtaatcaatcggaatggaaaacaagcggggaggcggatcgaatcggtggcagcgctagggttttgtggccggggagaggaacgggcagcgtctggaggtggaagacgacgaccgcttgcggcggggacgggatgggccggctgggctgtaccccgctgcagccaccaccctcctccttttctcccgcctcatctgccggcctctgcacccgcctctcgcctcgcccagaatgatagaagaggagaaagaggaagggtgatgacgtggatcactcttacatatagtgcctacgtgggtcccacgctgactcagtcaccacgtcgaacaaaacctgttgcaatactgatctaggacctattgtgatcggttttaattagttaagggataccagatatctggttttgtggtttgagggcgttttttaagtcgatgacaagtcgagtgacctttggtgtactttttccaactgaaagatacttccagctgacagatgggttcacatcgataaattacagggaaggctcatacatcaatcgattcataggcccaaggcccaagaaggaccaagttgggagtggattctttcctgccaatgggaagagggttgggcgggaacctctcgcaccttttctcttccctcaatccgacgaaacccccccatttccccaaccccaactccatctcccttggagaaggaaccaaccaacgctaactctcgcctactgccgctgatgcctcctaagcgcaagtctccggcggccgggtcaccgaggaagacacggagcatggccgtcgggaagcagtgggccgaggctccggcaaaggcggccaaaaaggaggcggcagcacccgagtagaaggggaggaagagggccaggaaagaagatgcagaggtggcggctgcggattacagcgctgtggccagcaacgggaagcgcatcgtcgtggagtcatggtaagtgcccccacgctcggggtgaggggattacttgttcatccttgggatttaatggcgttctgctggggctaacaggctaatggttggttgataacctaaaaggtgaagcccccttttacatacatactatggatggtcttctgtgcattcttcagattttgatacccgccgaagccataaggaaatcattttctaacgatgtcagttcagaagaaaaagaaaaagaacaatgttctctctgtacctaagttcaaatagttgctaggggattatagtattttggctgtagtaggtttacttacttcttcttgcggcttctagttttggtgtatatatgaagccattttttgtgattatctgtcaagtgctttgctatctataggtttccatttctttttggggggtcatatactctgcttccttccttgataattgagtgttttctgctgttttctgtacgttcaattaatactagttacttaaacttcaataacggactttagtttttgtgaattatcactggaagtgttaacaatggttttgtcaatagataccatcgacatagaacccaaacccagaattccttactgtatctctaatcagtatgtaagaccaccttcttttgtattttacatataagaatgatgattgaccatacgcgcaatagatctgttatcgaacagacttataatttgcttttgcacattggacaaaatgttctccttgcttagctgaataattctagataactcgtacatcattcctttatcttgacatatctaaaaaagtcctattgcattaaatgaattattggtagcaattcttattgaattttcttttatccttgcttctttgtacgattctctagcactcaatgcagacagttcaagatcagagctgtgaaggtaaaggaggatctggaaagttttgttcctggggtatctgtggtaatcaaccctgaaaaagtatctacatggtgttaaaccgaagtaattgtttttttttgcaacaatcaaccctaaaataacttttcggttatctcactggcttccttcgttgtcatcattgttttcctcctaattctcagccacgacgtggttgcctggagattcgtgaggaaggtggtgaagtgttcatatcactgctggtaatcttgtttactacttggtacctgaatcataagggacttttcttagctttctacatctgttgtttgctagctagttattcttttggttttcttttaacttgcattggcagttcttttcagtgatgatatattaactcacctatgtacttaaatcacttgcattccaattagaacatcgaatctaagagaccattctatataatcattactatatttgctaggaattagggtgcatcatgatttgtgtctgattgagcacactccaatttgtgtgcagaacatgccaagacctttcacagcgatgaagaagctcgacatggatgaggtcatcaaggacatagcaaaataaaatctcctgaatcaaatcaacaactcatggggtgaaaatctttaggtggcttataactagtagtaagcctccaatcccacctttctgttggatcttcatcttgaaatgttattggatggcactccgtgttgcatacccatggtgtgttgattcactggcacttcctgtgttaaatgtatctaaagattcctgcatactactcgtaatatctaatattcagttacctagtgatttgatgtcatatgttctgttctagccacaagtttgaatttatgtacagttcccccctcacttaatataaaaccagcaagagctggcttaggtttcaaaaaaaaaagtttgaattgcagctgtttttgataggcaatgaggctaccttcttaggtctttcctaacttttctcaatataatagtcaatattcaggggagaggctaagtacaaaattaacaatgtgttaagtcactgcagtcctcaaatcaaataatgttggctcaaatagtaatatatttgtttctttcagtacattgcaggaagtagtagcatatgtcaacaatacaaatcacaaattcacagtcccatctcatgtacagagctgtagagccttccttatgaatgatagactaggcattatctaaaaaatgaatgttagactagagcaattttacagtctttaagaagataccatgaggtaccactttttctattgtaaattaaatactatgaggcaccaaattttacattaaattttttttacctcatggtatctcttcaaggactgtaaaattgctcgttaggctaggagatttgctgacagttgtggaccgcaacaatttgtagcatgcattgactgttgtctctagcaatgtcttcgacaatggatggctgccagataccacttgggtgccttgagctatcgaagtatttgtttcctactcctcatcctctgaagctgtccattaagtgaaacggagacagtagaaaggctcatcatgcagttgaaagatggaacgaatatgggtaaaaagaaagaaaaaatatggacagaaatcagaagaagaataagcagccgagctaatttactccagtactggaagaagagttgtcaccgatgtttgtctcaaaactgtagggttctcttgtgtacaacatgtgccacttcctttcatcgtctctttgatcagcataggccttgatatgctggacatggctcaatttgccccactcaggaccagattctccaagggctatggatgtgagcagctctaagttgcagtccagcaccaggtgcataggactcacatcctgcaagcctgcaggtatcttgggagttgttccatgtcgtagtcctccagctccagcccccgtagctcaggcaccccctccaatgccctcatcttcgggcagccgacaatgatgagcttctacaatttggggagagatgtgaccctctccaggtcagggttatcttgcagctcaagcttgacaagagaagcaaagctctctatagagctgagttgctggatttatataggtccatgcttgttaaagctatcgcttccgaggaaaggccaggaggaaggcttctcaatttgcagttttcgagcgtaagctcttccaatgcaggcattgtctgcacattatttggttgctgatcccactcccactcccactcctactcctccatgcctattagattcatctccttcaaactagggtatacttgggcaccatggtggtgttggctggatgatggtcgtatagtaatgaatttagggccaacacgcttgattgcaggggcatgcatgacctgaaaaaatttcaggcatgggaggtggcagaggctgttaggcagttgggtgcagcaggctaggtcctgcatcatcacaatcatcagtctctcaaatgcacttgctcctctagacatcatccaccttggtagccgttgtccaaaatagccattgatctcaatactctcaatgcaccatggtggggcaagctcatccaacacctcctcgatttgtcaaggttcttcctcggagacacttttctcatcttttactaacccatcttcaccaagtctactgctacagtctaatctcaagctaagtacataagatgcaacttcaccaagcctagcctctgtagccaaggagggagcaggtacattatctagctttcttagtgaaagtctccgtagctgagcgagaggccccagctcttgtaaactacaccactcaccatctgcttgtgcaggaaacccgcataaatacctcaaatttgtcaatccacagaactgtcggggtatgccatttatgcttacacctaaaaggtcaagatgcctaagccgccctagctttacaaggcttggatgcctaagccgccctagctttacaaggctattaggaagcctgactaagttttcaaactcaatctcaaggtactgcaataatttgagtttgttgatgttccgtagtagtctagctaggtcgctgcattttagaaagatatacctcaaatgtttgagatggtgcaaggattcagccaaggaagcagtacagttggcgtcttctatgtgcataattcttaggcttgaaaaattaatcaacaaatccccatggttaatcttgagctcaccaattactattagtgttctaagtgatccctggccttgtataagtctccagtcaaattcatcatttggttgcaaatcattggtttctatagacagcctaagaaacttttgtgtttgaagtgcacctttgcctctttcatctaaagttgaaactacaaatgcttcatctctagatagatgttgagaaaatgagcgaacaacatcatgcatgctgctaacactgattagcatattcttcatctggctctattaggtttctgtaaattaactcttgatattacccttctcctaatttttctaaatcatcggtgtccccgtgaagaaatcattcgcttatccacatgccaagactgtgacattgtagaatactacattttttgggaggagggagcagtgcagaaagcattgcttcaaacaaggatgcaaatcttgatagttcaggtacaccgcatcgtctaataaagcaggaggtattgaccacataaaatcttgcagaacttgctcccaatcagatctccgtttctccctcctacgcaacagccctcccattacttttacagcaagtggtaatccgccacatttctttattatttccattccgatgtcctttagtgtgtcatcaatttcaacctcctccatatcatcacttgatgctacctgaacatgcatgcatgcatgaattcagattaattttgagcttactagctagcaattagtacaagattacatatatatgctggtaataattaatatgggtagagctatgacctgtttcttgagcagtaaccatgcatattgagggtacagtttgtcgacgtggtggaaaggttgcatggcttccatccgttgggtgacttcgtcatggcgggtggtgatgaggaggtggctgccggcggcgccatggctgaagggtgccttgagtaaattgtcccaagatctttcactccacacgtcatcgagcaccaagaagaacctcttgtccctgatggcgtcgacgagcgctagcacgagcagtgacttgttgctctctcgaccatcgctggcgccgccgacagacttgatggccgtcctcaggaggttcacctcgttcacgtcttgtgtcacgctgagccatatcttcttgtcggacgcttccttgatggcctcgtcgttgaacaccttctttcgccagttttgtcttgctgatcccgccggtgcccaccatggcaaccaccatcaccgcgtcctgcttcttgtgcttgccatcggtgagtctcctcaccagcgccctggtgtcctccttgatcttctctccgaccacggccgactgctccaacaccgggtccgtcctgcggttggcgacgctgaaccgtcgaggcgccaccatgtcttcgtaggactccagcttgaggaagctgaaggtggctgcgctcttgcagatggcgtcgagcctggcattgagcgccttgatgcggctgccaatgtcgtgggcgaagagtggattacggaggcagaagagcagcggtagcccacagggtcggaggaggatgagctaccacccccgcgctgcatggccttgaggtggcagaggtcaaggatgtcggtggcgtcgtacatggtgtgcttgagcttcgtaacccagccctggacactcaggtcggtgatgcgtcggcgatcggcgtcggcgagatagtccttgaggatgcgcagcttgtcgtggagggtggcgatctcgagggagacgccgaagaggaggttgagctcgtccttggccacctgcttgagcaggttgccaacgtaggacgcgaacacatccagaacaatggccatatgtgaatgtgaatgatcgacacaaacacacattgacactaacggagggcagattggttgatgaggcagtcagtacccgcacggacgtgtatatagctaccaacatacattttttcctttttttttttgaaataaagtttatccctgccttgccttgctcttcatcctatgcttagcttgatgcttctgcttcaatctttaatttgttgttagctcttttttcttttatttttttggtgagattgtgatgcaaggaagggcttattacggggtctatctttttccttgtcatcatttccttcatttgcttttttctaccctcttcttgagggtacataaatattggtcgttgggtgtgattgagtacaagataatgaaacctgagtatgccggtattaaaaccttgttagtgggtgcatttttaagtttagaaaaaagagtcacttaggatatttctgcacatcagcttgccaccccagcaaaatgataagtgcgtaaataacctcctaagatcttcctacatgcgtaaaattatgcatatctttgaaccatgcaaatcttcatacacatcaatattgtcgaatcacctatcccgttggattaacaaactactactcatcatgtcagattcaacggcttactgatccacaggctatagtggtgtgtttggcactacttgtttgtaactcattctcaaaacgaggtagtagctcattagcgcataattaattatatatatatgattaattaagtaaatataaaagaattgaaaaatgtagtaatacgatcttttaaaacaactttaatttagaaaaaatttcaagttcaggaagtatgcacatggaaaacaatataacagaggtcagcaaagtgtcctgaacacaccctaaccagaggtttggaaagcactactctttaacatcctccaattctaacaacacatgatttgttgttgaaaaaagtctttctgactctcatggcttaataattgagtttatctgtagctagcacattcgacaatatttaggagaaaaactttttcactttaattacatgtgtaactagggtgtagatttgttttgaacgtaaaacccacacttgcccagtggtggagagggctcgccaaagaggcagagcttgcgcgattgaatcccacgctgtcgattttattcccaatctccacccgcacgaattttatacatagcccaaactttaagtaccttcgcactggtaccttctatcttaatccgttggatttagagcaatcaatggctctaatatatcacatgcactgtagaaagtctttaatttttttaaacaaagtttatccttgccttgctcttcattctgcgcttagcttgatggttttgtttcaatctttaattgttggcttttcttttctttttttttgcgtgattgcgaggcaaggaagggattattgagggatctttatcattattttcttcatttgttttcttcttgcctcttcttttcctactctatgggcattcagctatgcatcctagtttacatcctccctcagttatcaaaacgagatcaattttcatttagtgactaacgtggcatccatgttagtaccaacatgaacataataataataataataataataataataataataataataataataataataataataataataagtggatccacatgtcatcccttctctctctcgtcccctcttctttctatctctttttcctagttggcggaccttcgacaatggctcctagctttggtggagccatgggagccctgagttgttctcctctccacctaccacacgtctgtcaccaatgctgatggccgtcttgcctccattgaaggagatcctcgccatggttgtcctcgcggctggagccacctcctcgctacctcttctctgtgggaagagcaagtgttgtggcattgggggacgtgggctattgtcgggccaccgttggggagtagggagaggggttgaggagctctcctcctcgacctccctcttctccctctatttctttggcaacctcacatgtttctcctcttcttctatctctctttctctcttccctatagctctctctagggcatgtgcctgtgcacaggtcatctgtgcatatgtaccaatgtggtgatgcctccacatgcaaacctaattcgtctctcacgctgctactagtttctcaaccaccttgacggtggggctgtcactatccctaatttcagcagtctgcgttgcttcagtttcacatcaacaagaaagatgtggaggcggcgtcatgctctccttcgctgctcaattcttcggtggcatggtctgctagtgggattggatgctactgggccaccacgtctgatggcaagaaagcaaagacgatgactctgtaggtattgtagatttctggaatctgttgtgtctaggctagtctctaagtgctttcatcatgtagtatatgccaaatcgctgtcttttttgaggaattagtttaggtctgttgtgttcatctccatttatagatactatgtgtctgaaatattttagcatatgctgcatttaaatcaatttgaacaacaatacatatttgcaaccggactaaattgacacttacggcaatagctaaacaacatccaaggcaacaacataatagaaaaccatcactagcacattttggcagaaaaccatcactagcacattttggccctcaataatttaggtaataaaaaagttgtattttcctctaattacaacattcttctaactagacttgtcggaaataaccaatttgccttacaacgaatctagtactccacaataatgtttatttggacaatttctttgagataccattctatgtaatgattacaatacttctaggaattagggcacatcatgattttgtttttgattgaacacactccaatttgtgtgcagaacatgccatgacctttcaaggtgatgaagaagcttgacatggatgaggtcttcaaggagatagcaaaaaaaatctcttgaatccaatcagtgactcatggatgtgtgactccattatgaaaatcttcagttggaagcctgaaaaacccacctttttgttggagcattattatctcgaattattgaatgacactctatgtcacatgcccatggcttgttaatttactaccctttcctatgttcaatgtagttaattaaagacattccaaattgatgacagtataacaatgaaaaagctttggtatctgatgagcccctttgtgttacctgcgtacttctctcaagatttggttgacctctgatcttttgatatagttttgttttgcccacaagtttgaactacaattgttcttgataggtagtgaggctagctccttgtcgttgtgagctctcaaagtatttttgtactattcctcatcatcccctgattctgtgaatgaagcaacccaaatgagaaaatgaaatgaacatgttgaaaggtggacagaacatgggcaaagaaattaatgcaaaagaatatatagatataaattagaaagaagcatatgtgttaaagtgttgatttacctccagaactagaagaagagctgatcccaatatttgtctcgaatctatagggatctctcgtgtacaacacatgccacctccgttcattgtctccttggtcagcataggccttcacatgctggacacggctcaacttgctccactcaggaccggattctcctgttgatatggctgtgagcatctccaagctgcagtctagcaccagatgcctaggactcacactctgcagcaggtatcctggaagctcttccatatctaagtccttgagctctagcctcagcagctcaggaaccccctccaatatcctcatcttcaggcagccgtcaatgacgagcttctgtaacttgttgagggaagtgatactctccaggttggggttatcatacacctcaagcttgacaagagaagcaaagctctccacagaattgagttgttggatgttacgtaggtacaagcttgtcaaggccgttgcttgtgaggaaaggccaggaggaaggcgtctcagcttgcagttttcgatcacaagctcctccaatgcaggcattgcatgcacactatttagttgttgatcccactcccactcctcccactccaccatgcctatcagattcatcctcttcagcctcgggaaggcatgagcttggcggagttggctcgatgatggtagtatagttaggaattcagggccaacacgcttggttgcaggggcatgggtgagctgaaagtaatacagagacggaagtcggcagaggccatctgggagttggttgcagcaagcgaggtcatccatgatcaccatcgacaacctctcatatgcacctgctactcttgacatcatccaccttggtagctgctctccaaaatggccactaatctcaatgctctctatgcacagtggcggggtaagcgcattgaacacctcctcgatttgccgctgctcttccgtggggacaccattctcgtcttgtacaaaaccatcttcaccaagtctactactacattctaacatcaagtagctaaggtgggccttctcaccaagcctagcctttgcagcgaacgagatagcaggtacattctctaggttacttagtccaagaacccagagctgagcaagaggccccagctcttgcaagctacactaatcaccatctacttgggttggaaaaccatataaagtcctcaagcttgttaggccacaaaaccctcgaggtatactagttatacttgtgccactaaggtcaagatacctcaattgtcctagctttacaatgctattaggaagcctgtccaaattctcacatacaaggccaaggtactgcaagaatctcatcttgccaatgttttctggcaatctagttatgtcaccacattttagggagatgtacctcaagtgtttgagttgatgcaatgattcaaccaatgtggaagtacagttggcattttctatgtgtagagtccttaggcttgaaagagtaatcaatgaatcccctgggttaatcttaagctcaccaactagtattagtgttctaagtgatttttgcccttgtataattttccacccaaattcatcattcggttgcaaatcatctgtttctatagacaacctgagaaatttatgtgatttaagtgcacccctgcctatttcatctctagatgaaattacaagtgcttcatctctagccagatgttgagcaaatgagcgaacaacatcatgcatggtgctaacccattctccagcgtactccgcatttggctctattaagtttctgtaaattaactctttatagcactcttctcctaattgttctaaatcatcagtttccccatgaagaaatccttcacttatccacatgctagtaactgtgtcaatgaagaaatccacatttttggggaggagggagtagtgcagaaagcactgcttcagacaagggtgcaaatcttgatagctcaagtatatagtatagtttagctcatcaggcatttgaggtactgaccatatagaatcatgcaaaattttctcccaatctgctcgccgtctctccttttggcacaagagtccccccattactttgacagcaagaggcaatccaccacatttgtctattatctccattccgatgtccttgagcgtctcatcaatctcaacgtcctccatctcacttgaaactacctgaaaattatttcatatacatgcatgcatttagaacaattagtttagcaaatggtactctattctagtctatatacatacaagttaatatgttggcaatgtctttttgttgttagattattttttttcggggatttttgttgttagaattaattattatggccaagaagataggtgtcacagtgtttcttatggcagagatagatgagggagggatgtaaaacatttagtatattgtgtaaatctgacctgtttcttgagcagtgaccatgcatctggagggcacagtttgtcgacgtggtggaaggggtgcatggcttgcataccccgggcgacggcgtcatggcgggtggtgacgaggacacgactgccggcggcgccatggctgaagggcaccttgagcaggccgctccatgctctgtcgctccacacgtcgtcgagcaccaggaagaacctcttgtccctgatggcgtccacgagtgtgggcaccagcagtgacttgttgctctctcgaccatcgctggcaccgccgacagagacggacctaatggccatcctaagggctccacctcgttcacgtcttgtgtcacgctcaaccatatctttttgtcgaacgcttccttgatggcctcgtcattgaacacctttttcgccagcgtcgtcttgccgatcccgccggtgcccaccacggcgaccaccaccactgcattctgcttcttgttcttgccgttggtgagcatcttcaccagtgtcctggtatcctcctcgatcttctctccgaccacagccgaccgctccagcaccgggtccgtcttgcggtcggcggcactaggtcggcgaggcgccgccatgtcctcgtaggcctccagcttgaggaagctgaaggcggcggcgctcttgcagatggcgtcgagcctggcgttgagcgccttgatgcggctaccaatgtcgtgggcgaagagcggattgcggagacagaagagcagcgagtccaggcagctgatgttgacgggaggtgcggatgagccgacgccgccacgctgcatggccttgaggtggcaaaggtcgaggatgtcggtgacgtcgtacatgacgtccttgagcttcctgacccagccctggacgctctggtcggtgatgcggcggcgctcggcgtcggcgaggtagtccttgaggctgttgagcctttcgtggaggctggcgatctcgctggagacgccgagcaggagggtgagctcgtcctgggccacctgcttgagcaggtcgccgacgtaggacgcgaaggcatccaggacgatggccatagctagctagttgatgaactgggaggcctgatcgatcagcacggcagtgtgggtgtagatagctagcctcacgcgcgtacgtgtatttatcttctaacggccatttagtttttagttttttttttaagaaagatttatcccttccttaccttgctgtgagtgctatgcctagcttgatgcttctgcttcaatagcttttcctttattttcttttcacttttttatgtgggattgcgtgggaaggaaaggattactgagggatctttttccttgtcatcattttcatcatttgctttcttttccccttttattttcctagcatctgtgggctcccggtttacaattctgtcctccctcaattattaaaacaagatcaatttatctccctcaattcgatgatttgccggtcggtagctgaacgggtcgacagagaccacgccccagcttgtattgacccaccatagccggccggcgaaggccagcaccgcgttatgcggcttattcccagccgaatcagcagcggatctatcataggggctagaggatctcgagccttcactaccagcaatataaccataagaaccctggtaaaaccatcactaaaattttacgtcatatatatttattcgattttgctatatatttgtcgataaattttctcctaaaaatttgacagatgtaattacagtacaatcgtagtgtaattacactgtaactatagtgtaacttgtatgtaactttcaaaaatctctccgtaatatgttatttcgataaaatagaggttgtggaaacaaatccttacatatgtatgtgctgtgattttatttttcttcctcaccaaaacaaatcttgtaatagatctaaagattcaaaattacatgaaacttatatacaagttacattgtagttacatgcaagttatagtgtaattacatataagttacagtgtaattacactacgattgtactataattacatctgtcaaatttttagtagaaaatttgttgacaaatgtataggtggtcccaatgaatatagagagaggcttgggcctacatgtcactgggatagaggaaaagaagggaggtgggcagcatggatatgtgcgagtcatgtggatcgatccatatcttgcgccctggttgttaatttctgatcaaaggagcagcacatcttcttatagtatttccttggtgtgacagcggagagcctattctctctaacctaatctcctccataattttgagtgattagcagcagcagcagctggtgatctgcgatcttctcgtccttcgtcatccccgtgctgatctttctaggtctcaacttcgttgtctcggctcgccacgaacagcggacttcgtcgtgcttcactatacgtctctcaacggttttgagtaccgttgatttgtgagaaaatcggtccatctttctacgtgatattattgtttgagacttactaattgctagtagtaaattaattcttgctagttgttagcctgcatatgtggagtaaattgagagccatagctaatagcttgacgtgtttgacgttgccatgtcaaattacgttgcatcttttgtgatcatgctactagcatatatttccatgtgggagttcttaattcttgtttctacctttccatttagtttaggaattaatctcatggttaaaatatgtctcctagcactatgctttcaacattgggcgagctcgattgacgcgcgctgtgccgaagaaagcgaagattcgcctatcttggtgtattgtatcatcgcccacggaggctgcgatgcggccgtacagaggccgcggcggaggcggccagagatgcgacactgaagcacaatcttggtgagggtggggttctcactctctttcctcggtccttccaacagagaggtgcacctagcgtcgtggcatgctctattgggattggttcacgcagtgaagtatgtacggtgtcacacagttaataataactactaatactttcaccttttatttaacttttccttaaaaacctactagtactactggtttaactaccggaagttttctttgaaaatcttacttactactttcctataaattattttaccaaggcacttcctccgaaaattctttgcctcaggcgaccgtccgagggatcaaaatcgggcgctccccccgacgccccacatgtccccctaggccccatcatgtgtcttgctcacacctgccacgtttctcaaaaaaatatttcacctaatatactcacaatgtttcactatgtatagatctaatgttgcagtgaattaaaatattcttttgcaacaaatcacccacatattttggaaaccctctattaagctaattcgttccattttttgttccaccaaaaatattttacctagtgcacttataatgtttcactatgtatggatcaaatgttgcagtgaactgaaatattctttcgttatttgctgaaacattgtttttatataaggtgaaacaacgtccgatttaaatgattgaaacattttcgatctacttagtgaaacaattccgatatacctggtggaacatcgtgcaacatttaaaaataattcaataataagctaaaaaaattttatcgaaatatatccatatgtggtcttgttttgaagatttaattgcaacaaatttaatggtgcaatcatatcatgatttggataaataatttaagagaaaaaatagtttaaagtgtttttgcacgcatgcgtggcactgacgtcagcgcccgattttaccccctccgcatcgggcgcccgaccgggagtcgcctcccacttcctccatctcaaaataaacaaatctaaagtagaattagacgttatcaagaatgaatctggataggggttgtctaaatttgttgtttaaggcaaagtcacatcatgtcccagattggtttattttgggatggaggaagcagcaattaaacttccatgaatatttttttcggaaaaagtacgaattacccccccccccccgaactatcgcggtcagccgaattcccccctgaacccgaaaaccagacatgactcaccatgaactttcaataccggatgaattaccctccttatccaatccaaagcggttttatcctacttggcgtacgcgtggcaacccagtcaacattttctttttctaaaacatagtggggcccacctgtcatatacacacagtctcttccctcttccctctcactctctctctctctccctctctcggcgagaacggcagcccgcggtgactccagcgtcgtcgtcgtcgtggtcctacgcggtggagccatccaaggtcacatcacctccccttctccaccaccatcccgggcctcaggtgcagcgatggcggtctcgggagccacggcgtccgccatcggcaactcctcgttggcaggccagagacgacgatggtgagctcccggaggccgggcgcatccacctccgttgctgtcatgtcgtaggaatgatgaagccagagctcctcaagcgtagtggcggcggcgtcgagccacaggttggtgaggccggtgatgtggcagcctccacagctgcgggcagtaggcggaggtcatcaccatcgttgacgctggtatagctgagcaggacatcggtgagagcgcggaaggcgctgccggtggcattcaggattccgaggaccgcgctgccaagccagaggcgcatcgtgtgaaaccccccaagcaagggaggacggcggggcacgccggcaagcccctcagactcctcatctccatgggaagttcgagcgtgaacgtccccgtgacgcagccaccgccgcctctgcatccagcgccgctgcggcctccgcatccagcaccgccgcatcccactccaccggctctctatcccacgacaacgacgacgacgctggagccgccgcgggctgccgtgctcgctgggagagggagagagagagagtgagagaggggaagaggagagagatagagtatgtgacaggtgggccccaccatgttttaaaaaaagaaaatgctgactgggttgccacgcgtatgccacgtaggataaaaccactccggattggatcgaggtgggtaattcgtcccgtattgaaagttcagggtgagtcatgtctcttttcgggtttaggggggaattcagccgaccgcgatagttcgggggggggggagggtgggtaattcgtgcctttttctcttttttttctctcattatcggtgctggagtttgttccaagatgtcatctaaactccgtaaacttgcaaaactcacacccatctaaatctaaaatcttgatttaatataccaaggttcaaagtgtaattggcaagcaatagtgcataggaatcttttccttcactggtccattctagagatttattagtcaatgttgttcttttcccctctttccctactcagttcactcgtttttcgcgtgcacgcttttcaaactgctaaaggtgtatttttgtataagttttcgatatgaaagttgcttaataatgatacttaataatataaacaccacgcttacattactaaataccactctacatccatgcatccgacatagagcaaccgaatactaggacattaaacccacactaatgcacctctctggtaaactagctacacaactatatcgatgcaaatataaaataatctcggtactcagatgatataaagggaataaaataacgaagatgtataaataagaatattctattaattcagtaagtcttacaaaagaagagagaaaaactgctagagctatacccgaaatctcatgaagacttgaggactaagaaaactattctaattcctactccactagcactagaacactactaaacttaagagagctctttgatcttcttcttgagtgtgtgttggagtggagaataagctcctcattaaataagctgctaatgatagttgtgatagatggaaatgtcctaactgctcagcaaccatcattgaggagtgatctggagcgtccactccaaacccagcctgaacggctgggatgggggttcgaccgaaccatgggctggcccaatcggcccaaaatttggcaggtcgtctccctgtagactcctcactttagtgacgtggtgtcttgggctttttgaggttgtttcactggaattgtaagcccatttacccgcaagtatatttctcgacggcgttcgattgattgttcagttattttccgtcgattctcctccattttatgtagcaatctctgcaagcaaataatatccaagtacaagtggaaatagattattctaaaacaaatatgcattgcaagcatagctaggtctataacgaccgtcaataataatatgcattgcaagcatagccattgacggtcgaaattggtatataacgaccgtcaataatactctaatgattactaaattttacaaccttgtaacttaagggagtttgtatttatctacttattacaacaactaatgtttggcatacaatagaatatcaatatattgtcttacacacgctaagattaaagtagcagtttcatgtccaagtgggacgcactgagattacagtaaatctatgtttcaaaaaaaaagattacagtaaatctcctagtggatccgttgagcaatatacgatgagcatgtcgtccatcgcagaaagtgaagcaatatcctctgagagaagatcgagattgttctcaggttaaataggagcatgctgagaacttccaactttaggtcttgcctcatttgtaagattgaaatgagcttcatatcttggttagaagactttttctccttgaaatatttctgatataggagaacaaggtgttttggtatacggcaatcttaagcaacatgataattagatccacaaatgttggaatgcttgttgctgttgtcacgaggttgtggtgccttaccctttccttttcatttctttcgactattggatttacgcctgttgttgtgtttgctttttccaataagattatgttgattcagtatcatgtcctccagaaggatagtatatagagttatttctatcttctctgcccatgttgactctttttttacaaaacttcaacttagagcgaatgttatgtattttgccacaattttgaaatcttgtaggcttaagtgcttccactcataactagcattaggccagatgagttccttttgatgatcataatgttctttgagagctttccataagttgagtgggctcatctccaacatatactcatgtttgagatctttatggatatagagcctaagaaggaaaaggacagtgtttttcttccggccctcaattggatggatccccactgttgggtttctcaattgcattagaaatcccgcaagaagcaaaatttattttgatatccgaaacccaaattgggtacttactccaatcaagggcaagttcatcgaactcgttagttgccatgtccctacaatcatgactaacattactaatttacatagataaattaataaaacattatatcgaagttgtaatctcgatgcgaattgtaagacctcataatttggcatgtttcgaaaattgtaggtaataaaccttacaatctaagttagaattcgaaattaggtggcacaatgtggataatctccaagtaattagacagtggagcacatatcttaatagtgagcaagatgaacttgctgcctaaaatatggtctctaggcaaatatattttgataaacaaccgcagccaatataggactccactaccttgtgcgcatctagatttcaaataatctcatattttcaaaacatattatcagaataacacatgtggttaattattgtaagatgtagatctctttatgatgggtgagatactcgttgcctagattttgaccattgtagccaatgtgtaggactccatctgggtaatcatcttcagatgtaaaacacttaatgatgggcgagatactcgatgcctaggttatggtcgttataaccaaactagggctccatcaacatgtggtttaacgttatgaccaaactagggctccatcaacatgtggtttaattacaagtcaaaatatgtagttgaacatgcattaaattctccattaatcatgttatacataattaagagaatttgctaaattaaaataaaaaattaaaagaattttgcaaattaacagagcgagtaagtagagtgtgtctttaaataatatgcaaaaggcattttattaaaacaacaagtaaaggagggaattaataaacacatatgtcaaataacatataacattaggggtctgaacgaccattagataattgttttacaactgatgatctgcttacctaaattaactaaaatgatagggactaaaagttaaatttgctaatttaattaaaactaacattaaaagaaaagaaaagaaaacaattataggggtggtgggtcaaaatcaataggattcagcccaccatcgcagcggcgctagcccgacccaccaggctgaacaaaagaagcatggggcatgggggttgccccgcggtttatctgccaccgccgagtccaccgtcgccaccgcccgtatccatcatcgctaccccttcgagtctgggcaccccttctcccgaagttatggggctagtttaatagaagcccaaagaggtgcatatggtacccaaataaggataggatagatatgtcaaaagcaggtctgatgcccctgaccctatcttgattaaaaccgaaaaccctctctaaggtggagccaagttgaaggtgtcattcaaagaaaaaatgggaataaaaatccagaacccctttttgactctgtacccttgattccaccgccgctgtccgcacccaccatcactccagtgttcgccgctgccacgtccctcctatgtccatcggcggcttgccagccggagtttggccaacggcccccactcctcatcggagtcggagtctggtcgaacccgtatgtcattccccactctgttcgggagtgtgaggctcgaagaaccgtgaggaacgacggggaaggtgctgtggaggccgagggcaacgtgctgcaaaggctctggtgtgacagcgagacgatgacggagtgaagagtggtggctcccccgtgtgtgtggctagggttctgatccgaccgaaacattgtggcgtgggagttggggagcggcgtcggattggtggctgcatggtcggtcgaggtgatggaggtgcgatcaatggtggtagggcgatgaagagcagagccgacggcgattccatgtacagcgggagggagcactgctcaccggcgaccgtcaccactgcagtccatccatggtgagtacaaaactatacccctggacatggatgcggtgggcgccccgacgatcggcgaggtaggggctagcggaggaggaggaggaggaggaggagcgactggagttgcggcgacaacaatgcagcgccgagggtggtggcggcggccaccaaccctagtccggcgcccatcatggtgatggtggcgactcctcatcgagcgacagatgagatggcaaagacggtgagcacgatcgtggcgaggaaggccgagaacggcatcgatcattgaattgaaggtaggcataccttctttccttgttcttctcgtcaagagcaaagtgctaataaccttctgattcggcaaggataatcttagtcagacccgtaccctttttcaacatgttatcaacactttgctcttcacgagaagaggaggaaagaaagtatcccaactttcaattcgatgatcgacgccattctcagcctttctcgccactatcgcacttgctgccttcaccatctcatctgtcaatcgacgaggaggccatcaccatgacgggcgccgaactagggttggtggccgccgccaccactctcagcgtcgcattgttttcgccgcaactctggtcgctcctcctcttccactaccagcccctgccttgccggccgtcagggcaccctgccgcgtccaagtccaaggggtacagttttgtacccaccatggatggatcgcagagatgatgcccaccagtgagcaatgctccctccttctagagatggaatcgctgctggctccgctcgtctccctaccaccaccgattgcacctgcaacacctccaccaaccacgcagccgccaatttgacaccgctccccaactcccacaccaccgggtttcggtaaaccggaaccctagccgcacgcacgggggagccgccactcttcacttcatcatcatctcaccatcatgccagagccgctgcagcgcgccaccccggccttcgcgccaccattcgcgccgttcctcatggttctccgagccacacactcccgaacggagtggggaacatcgtacgggtccaaccagactccgactccgatgaggagtgggggccgtcggcctaactctggtcggcaagccgccggtgaacaagggggggacccggcggacagtggagcaacggtggatgcggacggcggcggcggtggacacgaaggggaagcagcgatgggtgcaggtggtggcggcagaggactttgccacgcctcttttgttcagcctggtgggccgggccgacgccgatgcggtggtgggccttgttgatttcggcccaacacccctttacatgtttttttttcttttctattattttcttttagtgttagttttaattaaattatcaaatttaaattttagtccctatcattttagttaattagttaagcagatcatcacttgtaaaaacaattatgcaatggtcctttagacccctgatgttatatgttatttgacatgtgtttattaataccctactttactaaatttacttgttgtcttaataaaatgccttttgtatattatttaaagacacactatacttactcgctctgttaattggcaaaattcttttaattttgtatttttaatttagcaaattctcttaattatgtataacatgattaatggagaatttaatgcattttgactacatattttgacttggaattaaaccacatgttgacattggtcacaacaatcatagcctaagcagcgagtatctcgcccatcattaattagtctacatcttaagatgattacccagatggagtcctacacattggccacaatggtcataatctaggtagcgagtatctcgcccatcacgaagtggtctacatcttacgatgattacccacatgtgccattcagtgaatatatgttttgaaaatataagattatttgaaatatggctgtgcacaaggaagttgggtcctaaacaatggttgtggtatatttatcagtatatatttgcctggagatcatgttttaggcggcaagtatatcttgcccactattaagcgatctactccacagtctaattactttgagattatccacattgtgccacctagtttcaaattctaacttagattgtaaggtctattacctacagttttcgaaacatgaaaaattatgaggtcttacattttgcattgagattacaacatcaatatcatgttttattaattaatctctataaattaataatattaatcatgattgtatggacataacaactaaagagttcgatgaactggccattgatgggagtaactggcttcggatatcaaaataaactttgcttcgcgtgggatttctaattcaattgaggaacccaacaatggggatccaccaatcgaggataccaagaaaaatactgcccttttccttcttaggctctatatccataaagatctcaaatatgagtatatgttggagacgagcccactcaacttatggaaagctctcaaagggtaaggcaccacaacctcgtggcaacagcaacaagcattccaataggtctggatctaactataatgttgcttaagattgtcgtatcccaaaacaccttgttctcctgtatcagaaatctttcaaggagaaaaagtcttctgaggaaccaagatatgaagcacatttcaatcttacaaatgaagcaagacctgaggttggaagttctcagtaggctcctattaaaccagagaacaatctcgatcttctcctagaggatattgctccactttctgcgatggacggcatgctcatcgaatattactcaatgtacccacttgcagatttactgtaatctcagtgtgtcccacttggagatgaaactactttagtctaagtgtgtgtgagacaatatattgatatcctatagtttgtcaaatattagttgaaataataagtagataaatacaaactcccttaagttgcaagtttgtaagatttactagtcattagagtttgtactattaaatctatgtaaacgtcatactatgtatttgatgttttaaattattgtacgtatgtatatatattaaataaagaattcttcactaagcaagtattctttcactatagatgtctaaggatattgctccgattggagatgaattatgtcttgtggacagtggtaccacaaattctatatacttagggagatcaaatactttcaaactcttaaaaagagagaaggcaaagttttgaccatcgctgaacgcgatactgtgatagttggctctggacgagcaactattacactcctaatgggtacaccaattacaatcgaggatgccttactgtatcctgattcaacccgtaccctactaaattatagagatatccatcaaaatgggttccacattgaaacccatatgtataaccgagaagaatttcttctcttaactaaacaaaatggatatggcaaacgcatttgcgagaaaattccatcttgcacatcgggattgtactatacgtacattaagcccgttgccatgttgcgtataaagtaatttttacaaaaatgttgatgcattccacacttggaatgatcgacttgggcaccccgatatcgggatgatgagaaaaattattggcaactctattagtcatcatttgatcactggaaaatttcccaatcctccataggattttgcattatctagatatatgccgttgatcttacatcattggtaatacacaagatattaatgaagcacgtcatcatttaaagacagaatttgagatgaagtattgggtcaaaccaaattttgcttagatctacaacttgagaatttacctactggaatccttagcaccaaggtgcatatacccataaaatattggagaaattcaatatggataagtcatatccttccaaaactgctatggtggttcaatctctagacatagagaaagatccatttagaccaaaagaacatggagagaatgttgtaggacctgattatccttatctcgctgctatcagtgcacttatgtatcctgcaaatagtacgagactggatttctattagcaagatacagcgctgctcctaccaaccgccattggacttgagttaagaatatctttcgatatcttaacggcgcaagagatctaggacttttctttaaaagaactaggattcgactttaggattcatatttttacaaggtggaactactatttcatggaagtgttctaaacagacctggtagccacatccacaaatcattctgaaataattgcattatatatgagacattacgtgaatgtgtatggcttcgcagagtgattaacaacatattaacatcttgtggtattggttcattagaatcacctacaattatccatgaagataatgccgcttgtgttgttaaaatggaaactgattatattaagagcaacatcactaagcatattgctcctaattatttttttctcatgagcttaagcaacatggagagataaacatcttgcaaactaagtcatgtgataatcttgctgatttattcacaaaatcacaaccatactccacattctttaaatgtgttgaaggaattggtatgacatgacttaaaattttgcaggattcagggggagtacctctctctgggaaataacttattttcgttatattacactctttttcctttgtatgagttttaccctttaggttttctcattcaaagtttttaacaaggtaatatcaaaataagttatatgtcttatcatttcgctttccaccacttgggtttttactaaatgataaatgtagacattatactattttggacaatattacgagttttactcataaaagtctaaaaatagataataatatatcatggtttttctccttatttttcccactaggtttttgaggagtttacatgatgtatctaatatactaattataattatttctaagattgtctttacagatatctggaacaatgaaagagcaatgatcaaaggctggattcgatcaagggggagtattatgaaataaatagatgatctcatccatataaatgatgggatcggcaaccgaaggtttggcacggcggttgtgccaagccacgtgccttctcgccctctcggcgctcctcagcaacgggcttgatggttcccaaccatcgcgcctacggttgctgccccttcctcatctatatattgtaatcgcattgatcaataaaggtacaacgattgtctcgctctcacaatctcaattgccttttcaatggattcgagtaatttttgtctctcactctatatatcatattaatatccccaaggagcagccgtcactcatcgaagctggcttttaatcttatgtgttgcgtagtaaaacctctttgtctataagcctggtttgtccgtagactccttaataggatgaactccgtttggcagtgtaggagcgtcatctttgcagtgctagacaagcaaaggaaaagatccctatgggcaggaaccggagatctcacaagtggaaaatgcaaagttaattgggtgaggacatgttcacagaccacaaatatgggccttgcccctacacctcgagaaattcgtaagagcgttacgaatgagatggctatggcattagttgaaatagctgggaaaagcttcgttaggaatggagactccatgtgacgacactaacaaaatcctctttgcggtggcaacacaaatcaaggtgggagacagaaccaccgtgcgattctgggactcagcttggttcaatggcttgcggcctaaggatgtggcaccaaaagtgtatgcaatctcaaaaaagaaaataaaacactaaagcaggccataaccaacaatcagtgggtgtaggatcttgacttgccgattgtacaaggtatgacaacagacctcctggactagttggtcaacctttggaatgggtccagctggtcgagctgtcccctagtgaagcggatgacatcatttggaagatcacaaataatgagacatactcagcagcctcaacatacgaagcacaattcttcggctcgaccaaaacaaacttcgacatgctgatctggaagccttgggccctagttggtcatgtagaacagagtcctgacgtccaacagactgtattgatctactgtaatagttttcttttcttttcaggctcttgccaagttttgtacatactctttgttctttaatgtatactgtgggggcctccctcactgtgctttgataaaaaaacagactatatgtgagaggttgacgaaacaacacatactgcccactttgcaaacataccttggagacagctttatacctcctggcagaaagcagatacactagaagaatatggaacatgattgcaacgtagacagcgcaagaacaattcaaattggcatcatgagaggcgatgaccacagtacatgattggtgggaagcattggctacatgtaaaggactgcccaagaaaaggatgagaaccctcctgctgctgacaacttgggaaatttggaagaagcgggctacagatctgtagccagctgcagcacggactttaagacgtaatatgtgtatgataggtaggaccatgtattaatagtatagtaagtaactattgtataaactaggaaggtagcccgcgcagatgcgcgggcaccttatttagtgatgtttgaaattttgtaacgaatgtttatgtataggattttttaaaaaatatttttttactcttctaaatctatgtttatcaatatttttttggattgttttgaaagttggtttcgatcactggatgcacggacacgcgttaagaaggtacatgctcctggacatttgtctgcttatgtgactatgcaagtaaggtggaccaacagggacgtcgggtcctttgagggggtttctgtgacatcctagtgcaattaggatgtggtctatgttttttttttatttaaaggatatgatatgtgatgtccataagcattgtgtgcacttgtccataagaatgaaagtgtaagtgatgtgatagcgtaagtgagcgtgccagttggagttggatgcatgctgagctaccttgttctgaaggacgggttgttataaattgtaaacaaaattacttagatttataagaaaaatatgtctcaacaatagagttggttcatatgaaactatcattttatactacatgcgtttttttaatttaaacttttaagtaatattttttccttgtatactaaacatgtccttgtagattttaagatataataatttaagaaattttctattaaaaatatgataatatgacttctttatctaattaaagacatactcacgtacttctatttacttctactacctccatccataaatcaaaggattcaaattttatcctaaaatatatgagatttttaatactactcatttcatccaaccattcttcatttaatttttatccaacattactctaaccatcttctaactctttacataccccttatttaatgatggatatcttagtatttttttcattcctccttaattcctataaaattttaggatccattatagaatggagatatatagtaataaaaaagagcttcattcatagacatatttatcgggaatgctaggggacgggataccattgccccaacgggatagcttcccctccacctccatcagctgcaagagcataaggcacgagggccgagccagcagtggggggagagcggcggcagtggccggagctagagagccggggggagggggcggcagtgatggccggagccgagggagagagcgacggcggtggccagagtcggggagccggcggttggagccagagagcggagggatggggtggcggcggtggccggagccagagagccgagggagggggcggcggcggtggccggagccggcgggggacggggcggggacggtggccggagccgggggagggagcggcggcggtggtcggagccgatgggggagggagcggcgacgggggccggagccggatccaggggatgggagggggtggcggtggtgcgtcgctggagccggaggagggagcggcggcggtggccggagctagggaggaaggggcgctggggcggcagtggttggcggcgtcaatgtcgggtgtgtatcgcgtgatacctggtaggtatcgcgtgatacctggctggtatcgcatgattcctgataggtatcacccgatacctcgcaagtatcaccttatatgtggcaagaatcgcatgatacctgataggtatcacctgatacgtcgcgagtattacctgaaaacgtggtagaatcgcctgatacctgatatgtatcaaccgataccggacctgatacctaaccagtatcatcccgttcaaaaatgggattccgttatatagcagccccccatatttatttgtacctttgagattgatttagctttacatatttgtataggtaaatagacctcgtatacaagttgagaaatataattaagttggtagaaagtcgttagatatctaatggtataaagtaagtaaaaattaaggtggatttttttggggggtaatttttaggatcttttggttaacttaattgttgtaaggaaaacaaagagatgagagctagtggattcgtctcgtccatgaggagggaaccggatacatgtgttgtacatacgcactctgacgacctgatcatttggtagggtttttttaagatatagatctaatagtttataacggtttaaaataagatccatcggtttgggtaaaatgatttttttccttagaatttcttacactttaatttattagagcgtcgtgtggtagcatagaaatgtttataggaatgtatagcagcttaagaacatttgtaagatatctaatggacttttagtatataataatagataattcatgtcatattaattaatatatcacttaataattaaatattttttataattttttatgggttcgccactgaaaggaaatggtatatatcaaagtgatatccggataattttttctaacttcgtcactgaagggtatattcatccaagtgacatataataatttctatatagaaacatatgtacctagagattatttttatatttggttgctagcttaagaaataggaaagaactcggagagacacagaaggggagagtcagagggggtgggacggagtacctatatacatgtgaacgcattatgttttcttttccgaacatataatacgtattgaaaggggaacgtgcagatttttttcttgaagataagatttaatggtaaaataaattaattgtttaaaatattgggtccaccggtttgaatgaaagtggcacgaagcgatgtaggagcttttaccggagtgccaccggacataaattatacaatgagatagataatcatacatatgatgcttataatgtctatccacttaccataattatcaccgttttcactctatattagttagaaactatagttaataaatagctaatttttatcggtttaagtcattggattatttatagtttatagttaaagaaatatgttattttgaattttattgtgactttttagtatcatttaaaaaaaattaaaaaatatgaaacaaatgatatatattttaccggctgaaaaactacatatcaaatattatggaggagtccggtacctgtgtacggacgtgtgaggttcacgtacacgcgagagagagaggagagggtgggattaaattctctttttaatctaattaaatctaatggtctaatagacccaccaatttaaatgaaaatcgggctagatattcctaatatattagaacgccacatggcgatttaggagcgtttataggaatgccacatgacggtatgagagcgtttgtagtatgtttaatggatttttagtatataataatagataatagataaatggcaaattttgctacatgacacttgttatgtgtggttttagctctaggacactgcccaaactcacttttaggggaaaacactccataaacgtggtaatttgctagtggacaccgcgccgattaaaataatattttccggttggggaggagagagaaatcgcgtggaatgtcaaaaatgcccttgggcccacatgtcagctctatctcctatctctctcctcatctctcttttctctctcggagcgcctccacgccgccttcaaggagcacagcggccacccacgatgccgccctcccctccctcctccccgtcgtcgtcggagttcgactctcagtcggagtcccagtcggagtcggagtcgtcgccctcacccttccacgccgtccgcagccaccatctgccgtcctaccggaagacaaagcagagcagcgaggcgcgcgcgcgggcgggtcccctctcctcctcatctggaacggcgagcgcggcggcggttgtcagatccgcgtccgacgcgtcggcgttggcgtccgccaccggcttgggcggaagaagcggctccgcggcggcctcgcggtagtcaacgggctcgggcagcagcagcaccgcctgcggcgggaggtcggcggggcggcgcgccgaggccggggccacgaggaggaagcagacggcggcggcgagggcgagggcgaccccagcgggggccatgctttgctcttgtgattagtagtaatactagtatttgtggatttgctcttgtgattagtactctcaggccggcgctgccgctccgccggccgccgtcctcgccaccccgtgcgagcgcgctctgagagataaaagagagagatgaggagagagataggagatagagctaacatgtgggcccaagggcttttttgacatttcacgcgatttctctctcctccccaaccggaaagtattattttaatcggcgcggtgtccactggcaaattaccacgtttatggagtgttttcccccaaaagtgagtttgggcagtgtcctagggctaaaaccacacataacaagtatcatgtagcaaaatttgcctagatagattggctattacattggctctagatgacttggggctggtatttggctatactattgaacttgtgctaaagaactcccgacaatagctcttctcaccaagattaaagaggagggggaggacttgggtgcgtgctagagcaaagcatccagcagagattgtttcttaagcttgtatagccctttttaggttttaccctctaaagacttttactcattctctattcaaggaaattggcaccgtcttgtgtctgttcattaagaaaaagcagtaacagtcatgctctcatgctctgaagaaaagcagaaaccaacatcagcaaggctcttcgtgggtgcggcgtttcggttcggctgggctagagcaagaggctcatgtcatcatgtggatgcgcacccaaccatgggtagctaccagggctttggcccatttagagcgagtacaatagcaggctgagtgctgtaaactcatgtagaggagagaagagaaaaagagaaggaaagcagaccggctgccgcacggactccaatacattgtgtgtatatgagaggtgggatcatatattaatggtgtagtatatagttataggtaactattacatgaataagctattagattgtagtatattattatatgaataaactattagattgtagtatatgtttataggtaactattacatgaataagttattaaattgactattgatgtattgaagccttaaacttgctcttaaagatgaagtagagagagataaatgaagatagagaaagaaagagagagatcgtgagataccatgagttgggtgcgcatcgtctgctcaccgtgccgggtgccaatgagaagagaggaaggggagtatctaaaaaactgtcacaagtttgttgggtcaaaaacaaactgtcacaagtttgttgggtcaaaaacttatcattcagcagttcagcttgtgggtttgcaaatcctgatcgtccatgcaaagtaatggttgggattggccaatggcacggtgctgttgaaacagagaacggccgatgatgcgcaccgccgcacccccagtagccaacgggaggaagcaaaaaaaacaaaggaattaggaaggaaaaaagaaaaagaacaattgaagagaggaaaaaggaaaagagataggaagaaaaagaaaaggatatggatttttcttttcggaaaaattccaaatttggaggattttggaaaaaaaaaattagaaaattttatggattgggaatatttaggatttgagagaattcacggaattgagctccacttccaaaagccaaataaaaatcaaataacaaacaatagaaaaaaaaagagtggcataattaatttatttagtaaatttaacccttttttatttatgaaatttctattaagctattttaggcgaataaatattaatgtgaattttcgaaattaggcaaattcaaaaacgtgaaaagcgagacgtggcattagtcctccaccatccgatctctctttacgaactcttcttgattggttctttccttccccgtcacttatttgtcaaaatcgtaatagcttcctttggtttctacaccatcaccaccacctccatccctgctgccactattcctacaccgttgtcaccactatcacttcttccctactacaagcaaagccggcctccaaccaaaagaaaagaagaaaaaaggttccagtttctcccaaaagaagtactcccaaaaataggtaaactacgagaccaaagcattagaacttctctcgtgttccccaaaatgagacttctgcaagagctaccatccatcagcttcctaattcctgtcagttgtttttcatgaaacctgaatgaaatagagaacggttttgctagctagctgtcgacagttttggaggccaaaaactttcgattttctggccgtgcgatccgcgcgagatgattttccgccgtgcgatccgcgcgagatttggaaaaaaaaaatgtacgcgtgttgtgcttgcaggggctcgaacccagggtctccatcctggaagccgtgcgtgctagccacttgatctgctacatgtttttgtaaagtttaatgagttacattttagttatactccagttataccctagttacactatagttacatttgtaactacattgtaactacattgtaattactatgtaactgcactgtaactacattatcatctctatataatttagatataatgttacatatattattttaatacttatatacgagttacattatagttatagtgaaattatattgcaattatattatagttagatttgaaagttttctccttaaaaaactttcgacagttctctagatagtcccaatagagaaagcatttgaatgatcatatgaagagaacgagcagcatataagcataaacacaagtaaacaagaagctaagttagttcatctagtcctttttacttttacttatgaaaatcgagagatagcaatatgtgttttgttctatcctgattcagcagattacagaacacagatatattttatattcatgtcttgattcggcagatgattacaccatgatcttgttatgaaatggcaagcttcatttcaggcttgatacgttggtactccaatatttttaggactaaagaatgacaatggttcatcataatgacaaagctgggcatcctttaagatcttacaagacaccatgttttgtacgtagaacttctagtttgcacttaattatgtctgctagttcattatagacgcaagccaacagaaataccggcatactcccatataacctatctgtattttgtttaaagcaatgtacatggtatggttactttctatcaatttatttcatcccaacaaaaatataaaagcagggtcacttgtcataaacaggaaagcttcatctcagacttgatcgccagatgatataatgttttttttttcaacagttaacatgatgacaagactgggtgtcattcagtttcttaaatattatgtttactgacaaattgtagtttgcactcagtgatgattgctggctcggagaataataatacggaacagaagtaagaattttcattggcatcaacctaatacttggtaggacacgacagcgaagggtgacaaagcaggtcgaagaagatgaggataactaggaagaaaacatatcttctttttcagaggaagaaaggtaccctacataaaaaagctgtgtttaggcttccactattgagttaacctcggttcttttgaagttggaactataaacagaatgcttcaacagaagtgatcagccacaatttgggtaccagcctaaccagtgacaacgtctggcacatatagtacaaacagacttactagttttagctaaacacatgaaaggttctattagaaacaaaatggcacacacgaggtgggtatttactgcataaaatgtctaagaggtgagtgcacgattatttctgtaggatggacaccttcagactagaagggatgacaaactggatatacgactaatagtggatgaaacaagaagcagtagtggagagagtacccaaagattgtttagatgagaacctggtacatcatctgttctaatcactgctcgaacgaaccaggacgtctgccaaagtcttgttttcagcaccttcctccttgcctgaagcggtacatttaatcatttgtacaagtaaaacatcacaatagtaacacagaacatactaaaacaatatggaattctctgtatttaaatataaggtttgagctagcaataaaactcttcttgtagggtaggtaatggaaaattcagcacagcgaatctataattggcttaattacatgaataaagttgttatgaataactttcaaatggacagtcttatgtgtgatacaaacaatagacatacctgatatatgcaaataagttagcttgctaatttttggtccagggttacactctttaactaatatagttcttgacaagttggagaagtaaagaagtaagagaaatacttgaaagaatgagttcatttgctaattttaggtccagagttacaccctatctgataaaatacttgactagttagacaaatgaagaaatccttaaatggacatatcatctgtattaaactattaattgtactctatgaacacaaaattatagaaagatggaaatagaatgtggatcatgtggtataaattcacaattcacaaacattagattattatgagttccaacaaatatatcctcaaacatacatggaagggtttgaacgattatacaacagaacagcaacagaaatatatgtatataagttgatagttgaactactaaattccacagcatgtgaggtcattgtcctattccataaccaagataacgagattaacagactataagatgtcagtttgacgaagaatactgaaaatgcatgtaaagcaatgctataatgtaaaaactagcaaatgaccagcacagagaacaaattgtaactagcaaataaagaggacaagttgaacatcacctgcagaagggatccgacttgacccaagccaaggtgggagcacacacggtaagaaggtgccaatgagaaatgttcgctcatggaactcacattcccccaaatcagaacaccccaccacctccctcctgtccatgtcgacggcgaggacatgatctccgacgacgacgcacacgacgctggcattcaccgggtcaattgcacagatccaagggattctatcctgccatggccgtccagctgccgcgttctacagtggccggccaagcgccacctgatgctcaagcgtccagcagccgtagtcgtcgtcgagggcgaaggagctgagcacgaatggcttcttctgggacacctcgacgtagcgcagcctcccctcgctgaccccaatgcggcggtacatcccctgagccagcactgacgccatgaactcctcccccgtggttggctctggcagcacgctgctccgcggcagctcgatgaagcggagctctggccggtcgctgaacgggtcggcggagaccacgccccagcccagatcgacccaccatattcgtccggcgaaggctaccacctcgtggtgcgagtgtacgttcagctgccgcgcgagcgggagcggcgacggcaagctctccagcttgtcccactcgcctgtttgcgacaggaaccgccacatcgcgaagccccgatccttcccgtcgcggccgttcccctcgctgagagatgcgacggcgtactcgtcgggcggcccgtgaccgtgcccctgcgcggaccgggtgaggaggcccgggaggtggcagaacatggtcttcttggtgccgttgatgtccgggaggcggaacagctcgccgctgatggggttgcagacgaggcgcgtgatgtcagggttcgtgttgacgccggcgagctcgcgttcctgggtgtcgccgcgtgagttgtggaggttaaagctgaggccggtcaacttcttgccttgctgctgagcctgagcctgcgcgccggcgcggcggttggcgacgacgcgggccgtggcgcggatatcggtgaagtcgaggaggaggaggccgtcgctggtggctccggcgtccccgacgacggtgcggaggatgtcgctgttgggatcgaccgggggctcggggtcgaggccgacgaggtgctcggggacgacgaggtgggagacggccgggggctgggcgagctcgatcgacgcgcgctccgccgtggacgcgcgtatcctggtgtactgtatcatcgcccacggaggctgcgatgcggccgaggagaggccgcggcggagacggccggaggcggcggcggcggcggcggagaggtggcggggcagcagcatctcggtgaaaaagtgggggttaatttgataatttctctcgtctccttcgaacagagagaaggtgaaaggaattttcgcgtgaggaattacggagttgatgagtagtactagtagttgggtgcagctggcctggtctactgggctcggtccagggatttgaacgacattttacggcaagggctgtgtttatttccacgcaaagtttagattttggttaaaattgaagatgatgtgactgaaaagttacgtatatgacaggttgatatgatggaaaagaactgaagtttggatctaaattttagatctaaacacagctaaggtttgctgcacccctccctgttggtgcggcaaaataaattttcggaaaagtaaaacaatatgtaccacaaaattttaaaaaagggcaaatgcacaaaaaattttaagctacgcatcagagcatcgttttgtcatttttgaactttgcaggtcgagctttttctttctttggcaaagcgtctgtacaaaccgaaaacattatctgctattttcagggattagcaatgactaacattctcagggctactgaaattccgcaagaccctaaaatcttaacacatttgcacatactttctcagtcccaaagtaacgtaatcattttatttttctatgtttctatgtttcataatacaaggcacctctttcttaccacacctctttcttcccaaaatttgtttttctttaaatcatctaggttcaacatctctaatcctacccatgtattgtatttattgagatgattcaaacaagagtggtaataattcttttaagtctttgactatactaatggtggttatgtcgagaaaataattggaatggcacctctattgtactgccacgtactccctctgttccaaaatgaatcaaactcaagagatgaatctagacacacatcctagagtttgagattttttgggacggagggaacaaacaccaatttacgtacagtattcagacagtcacactcacacatgctgaattttgcattaacagacaagttgtgaatcaacatctaagacgtgctcaaacacatggcatttttgcccggattccaccttcaaaacggactcaaaatcttctgccaacgtcattagccgcagctcaaagccacaaactcattagtgtctagggaacgtctgcctagctgcttttaagtacaatattaatcagtgaaacccaaaattcagcgttcagccaacgtttagcaaacaaagaaaaagagggggggggggtggagtttgtgattgcagcacccaatgccattgtagcgttgcttcataagaaagaaagacttccaagttcatcataaattcagaacagctttcacaaaacaacttcagaaaccaacagaacagatatcgcctgttaaattccatagacctggagagaatgaattaagcattagcccatctcattaatgatgccaagagagcgagtgctatgagaaagaacctatttttctttgttacaatatggatgcatgcaaacagaaataatactataatcccacacacctttttctcaattttatataaaaataggcgtaatgtttattttctatataccatttctttgttccataacagcaaatatgtacatctgattggcagatctaaaataaaacacgatagccctaatttttaatatgctcaacatttaaatccgaagtgctactaaaagaccacagtataggaatcatggactatttgaaattgaagtagccatctggtaaattaggctgtcttgatctgaggtaacacttaacaaataatgatgggtagcaaaaagtaactaatcaggaatgcagtttccttaacacaggaaagaatgaaatagatgatggtttaaacaatgatagctaagtaccaaatatacattatatataccatttctatggtgcaacaaaaactaatgatttcagtcacttgtgaagaaacaggaagctatgaagttaataactcatgataacaaaaacagttatttagttttttaatacgcaagctttatttaggtttccatctagataagttttactggtacaacgcgaagttgattctcggttataatgggcagatcgaaccagacaaatctgtacagttgatgacaagagtagggcacggtaaccataattatttgtacactatttcacattgaaatttaaagtaccaatagcttaaaactgaagtagtatatcatatcatgttctacagtacacactacagaaggactcaattgacgctacaaacatatatggtcagcaaaagtaactagtcataattcttgtttcattaacaaaggaaaggatgaaatagattatggattaaacaagaatagcagaagaaagaaccatatgtatttgcttcttcacctcaactcttcatatccctgtctacacgaaccaatgtgtctgccatggttttgcttctgatgctggccttggtgcttgaaagtgttcctacagtgagggagttgaaccattataacacaagaaatggaaataaacacttccctacatttgtttacaatatgaaagagcataacatctctacactgaaagacatgcgctgtaaatgagtttgtcccatcataatttagctacattaggttggcacagaccacacaacatatgcatcaagaaacaaaatggaattgctaacttgctatacatgttgactgcaatttaagcaaatctcagcatttaacattgcacgtttccttttaatgacttcgtaaccaatttaacagcagaggtggctcatgaaacaataacattctcacaagcctccaaccacatcgtttagttttgacgggcgcatgcaagacagggcttttcccccgattcctcccaaatagaggagattccaacaatctgattccaatgaaaaccagcaacccaaactcgtctagggatctctgctcagccaattttaagttcggtatgcatcagcaaaacccaaatataaatgcacatccaatgtttccccaaaatgacagttcggagttgcagcaccaattggcaattgcatcataatacatcacctcatagaaaagggtaaaaaagtcctaatccatcagaacagttctcactgttaaatttcagaaaactggaaagcaaaagttatgatttgggaacatctcattgatcaggcaagggaagcgagtgacaagagaaagaatcaatatttattggttcatcatgaacacaagcaaacagagatgatattatagtcccatatagctggtcttgtggtgaatatgagacatccatgtggtagataaaatggatcaaaatcacccacggtagtatgaataggagtgagaagatagtattggaaaaagttgattggccatacaaatcaatagtttcttaatatactaccgatattgcaaaacatagtataaggcaccaaaccactcgccattgcattgccacagatcacacgcgatgcaatcatctagaaacataataagatggctaagcacattaactattgaaattcaagaggaattcaggcagttgacaattatcacttctgttttctgaaaaatcaacatgcctacctaaattcccagagattattcatgaaaacaaaccaaccgaccataacatatgcatactcatgtcgcaggtaaaacatgcatatcaaaataaagcatgagaaagaagagaacctgcagaagggatctggaattcctcaagccacggtgggagaatacatggtgtgaggaaaccggtgaaaggcgaaaatgggccagtgctgcaacctatctgcgaacgtccgagcacctcaccccgctccatgtccacggcaacacaagagtcaccaattgtgaggtacattgtgctcgcattgagtgggtcaatgacaccaatccgtggcgtgtcatcctcctccgggtctgggtggcatccatccaccccgagccggctgagcgctacccggtgttccagcgtccagctgctgccattgtcatcaagggcaaaggagctgagcacgaatggctccttctgggacacctcggcgtagcgcagcctcccctcgctgacgccgacgaggcggaacctgcctagcttccgtatcccctccacgggctccgtcacactgcccctcggcagctggacgaattgcagctccggtcggtcgctgaacgggtcgacggagacgacgccccagctcacgtcgacccaccacagccggccggcgaaggccaccacctcgtgggagacgtccatctgcctggcgagtgggagcggggacggcaaacccaccagcttgtcccattcccctttctgcgagagaaaccggcgcatggcgatgcgccggttgtcttccccgtccacgctgagccacgcgacggcgtacctgtccggcggcccgtcggggcggtcagattgggtgaggattccggtgaactggcaccacgaggtgtccttggtgccgtcgatgtccggcatgcggaacagctggccggtgacagggttgcagacgaagcgcgtgacgtcgaaccgcctgtcgaagccggtcatctggcgcgccaggccgttggggtggacgccgacgacggggcccgtggagaggccgtcggtgaagtcgaggaggaggaggccgtcgccgctcgcgccgcgcacgcagcccccgaggaggcgcatctggctcctggggtcggtgaggggccggaggtcgaggaggtgcgcggggacgtggacgtgcgaggcgcgcgggggctcggcgagctggaacgacgcgcgcagcgccgccagggagctcctggccgcttccacgtggaagatcatcgcccaccgcgggcgcgagggcggcgcggccgtggagagggtgcggccggcggcggcggcggcggataggatcgagcggcggaggcggagcaggtggtgcattttggcggtggccggcgacgaggtggaaggggggagaagagggagggggggttttgctgcttttgtttgcggcgagcggagaaggcgagaggggggcggtcggtgcacgagggcttggttcatggacgggggcggtgcctagatgtggacccaggtgggttcacatgttagtgaaaggacgtggcttacgactgcgggaggcggagaccggaggggaaaaggctcgccactttttgaacgcattaactgccagatggcagatccccactggttgctgtgtgtgcttaatcccgtcagtcactaatctcccgccaaaacgctctggtccttttgggcccatacggcccgtatggttgggggaagttggattgagagtttagagcgacgaggctattaactattttgtttggttggaagatatgtaaattttggtgggatggagataagttttgcctaaacaaatctcacccatccgttttcattagaaattgggaaaggattcttcttagttaggagcagctgactttagatgataactgttcggacaaactgtggtggactctgtccaaaaatgggaaattcactgtgaaatctttctatagagctctcaaaatgcaacaggtcaattgtccacataaaaagttttggaaattcaaaattcctctgaaaattaaaattttcatttggctttttaccagaaacaagattcttaccaaagacaatctttttaaaagaggttggagaaaaggtgataacaaatgtgcttttttgataaggaggagacaatccagcacctgttttttttttttgagtgtcctttggccagaatgttatggaatgtcattgctgtagctttgaatctcaaaccttgtctaaacagaataaatctttttggttcttggctcaataatatagagaaattcacaaaaaaaccttgttgttactgggatagctgctgttatctggactatttggaagtccaaaaacaaagtttgttttgagaataaatttcctcaagatcctactgatttagtgtatatggcttgtaatttggtggattcctagacttgtctacagaaacaagaagcaagtcgaagaagtttgcagctgggaaccatggtactaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagctttcatttatgtaattagttttgtaagtagtctatatttaatactctaaattagtgtctaaagacagggactaaagttaaaacaccacctaagacaggtggcaagtgaagtattcaattcaagtcatggctggcgaggaggcatcagaagaattggaccagcttagtctctccctggcagtttgatcttgtttgatactccttggaatgtctgtttaatccctagtactctgtatctaggatcgtcatcttggttaggcctgtaatggttaggctgatggtcttctgttcctgtcccactcagtggtcaggtttgtcgttagttatctgttttttactacttctcaagacttgttgtaatgactatcatttctacaaagagaaatgggggcgccatcgccctagttctaaaaaaaaaatctaatattaaactaaactccatatcaatttccaccacctctaccaaacaatatattgggactaaaaatcaaattcccattttaatctcactatccattctctcgtctaaactcccagtccccttccctccagttgccagagtatgagagaggaaatgggagtttagaatattgagcattttaatctctgctccctcagtttcacaatgtaagtcattctagcatttcccacattcatattgatgctaatgaagtcttcattagcatcaatatgaa

SEQ ID NO: 23800 - DNA, 11518 bp, Oryza sativa
aatgctagaatgacttacactgtgaaacagaggaagtagtttggttggagggcttgggaatttcgaagggattgggattgggaattaatccgtccaactccccaccatcctaccttgttaattcacgagacttggtgagaattaaacacgagaagtctaaaacacccctcaacaatacccctgcaacctccaccgtccgctggtgcgagaaggcacaagatgcgcaaaacattcccattcaccgggtcgagaaggactgaaatgtgcgaaaaatcccctgccactagcacgagagtaaaacgtgcacaaaatcccttgccactcgcacgagaagaagtaaacgcgcgcaaaatccccatctcaatagcacttctctcgccctctccgtcgggtggccatcatgagagggaataaatcctgcgaaatatcaccatcttagcagcacttctcccattcacccgagaaaactacaacctttctcacacaagtttgttgtgttctcgaaaactccccctctctctcctatacagatccagaccgtgctgctaggtccaccgctgtcatgccttgtcttcgagtcggtccaggggatggaacataggcaacgggatgtgggggcggcgatggagtagagaccggatgaagcctagcccccctcccctcgaaggaaggagagagaggggtgacccactgacatgtgtgtcccactttttaaaatcttttttcctgattgacatgtaggccccacatattttgtttgaacttttatttttcttttaaatcttgcttctatgccatgtcaacgtcatgtgggacgaaaccaaaacaaccgtccaaaccaaattgggaccttgtatgcactggtgatacgttaaagaatgttattcaaactcgatgttaagacgagagatctaaagtaaacttattacctttaacgtttctagtggaccagcccatcttcctacgtaaacccaacagccggcccactcagattcccatcggcacggcacgtctccccctcctccgcacaagtctcggattcctccgcacgcagcttcccctcccgaagctccccaagtttgaaatttcgaacggtcggcggcggaaggatggagagggctaccacctccggaggcggcggcggcggcagccagccgccgcggggggtagggctgccgttggtggaggtgcaggcggcggcggcgtcgctgcggcggtcggaggtgttctacgtcgtgaaggagctcctcggcttcgtcctctacatgcaccaccagatccccgcgtaatcccccctcgatccgctcccatcctatccccccgcccttctctctttcaatctctctccctctcccaaatgctggggaagtggtcggtatagggatggatttggtgggtctctatgtgagtttttagcatctaggttacagtctaaacaatttgttcgagttcgaatctaattttctagagcaattgaggtggtactgaacttcggatttggtcaccagattttgatgggttttgttctagcaaccttagtgcttgtggatctaattgggatacaagttgcattgcatcaatccatcaaataggcaatggcctgactgaatggctgttctgctgtagcagagttgagaattccattaattcaaaatggctctagaaatatgcgtggcgttctggaccatactgttggcaatgaattgggcaacttcatcgatgatgatttgaaggttcacttttgtaacaaattgcttgcatttcctttgcttcctgggagatgtttggtattgatatgtggccttaggttgtgcattctctgttagatgaatatgactgttgattgttatgttattataaactgttaatttgacgagatactttaatttaccttattgtagcgtgttatctactcctggtcctgattacatgtgttggtgcaggtgtggtgttcttgtgctttcgttcttatgttttatgcacataataaaatagacaaaaaaaaattctggaagaaatcaaagtgtgtgtatccgttcttgtagaaatttctgctgtacgacttttttcccccgcaaatatgccaaaaaacttgcatatatttgtattaagaagaataaatagtaagagaacaaagtagcaacaaatatacatacacacacagagcttcaaaagaacaaatggtcagagactttatgtatgactgtttagtttctgtgtatgttctgggctctggttcttcatttgcaatacctgagcacatactcatgaccaacctagtttgtccagtacaacagaataatgttgatgcattggtgtgacgctgttattctatgatgtagggctaattttctggggcttaagttaggcacacagcattgttgtgcattggtgcttgacttctaggatgcgtacatcactgaagatgaaacctttgaagatgaaatctcctgctattgtgttgtttaaatttgttatagcacacctgcactgcaatcaaagaaaaagaatataagtgaacagcatttagcttggattatgtaattatccattttgcagatggccagattatatactaagttagggcagttatacactgctgtatgtaaaattatcacatgaatttgaagtctaatttgtttttctacattttcagggtattgcagaatcttgaaaatgaatttgcaagtttaaaggaggaaatggtaagttttgttctcagaaagaatgtcaccattagcatctacgcagtatttctttatcgagcctattaataatttgtggctatttatagacagagatggcattgccaccaggagaaatgaaaccatctgatcagagaaagtacaatacacggaaaagggaagtaagacggaggatcaagaagcaggagaagttaatgaatggcctctccagcgtattttctgctcttcagaaagcactcgatgaagttcctagcattgaaggagttctcctgatcctcggtggtagccttgtcaggcctctgtttgtctatgacattacaatttctcatggtagatttgatgctggaagtgccaatgagcgtggtgcaagcaaattagcgcagtccgtttctcgaaaggtgagctactttctggcttaatgctccatgaataactatcacccattagatcctagggtgactacatttctttagaatttggtagtttttctgaagtaccatagagttgagatctgaacgttgatggaattcacaatgctgtaacttttagtacctactttggacaacaatatggcaatagcatatctgaaatgttctagtgttgtagttttgctctactgtttggcattttggcatatgaccaaacagtgtaaggagaatcttgctatgtttttgccccattgctaggcttaattctatttttttttacttatcattgtgcatgtttcatcttcatatggtggtcctctttaaataataacatgcatatgtatatgtataggccattcgtgctcttatatcaagtggtgcagggagtttatcttatacaggtactggttcttctgttttactatatactagctctgttccaaaatataagaatttttagtggtggacatgggtattaaggaagtaggtggaattaaatgggagaaggttgtgattgtttgagaagtgaaaatatgtgaagaaattaaatgtggggagattgtgattagttgataagagaatgtaagtagagaagttgtattttgggacaaaatttgaatgctgaaattgttatattttgggacagtgggggtatttgattgggaatgccatcatccttttaccttaacgttttccctccaattgttttgaaggccctaccaagctgtttgttctagtcagatgtccctgtacattgaacttaccactggacttcctgccgaaacgtgattttcgttacagcaaaaaggttttttttttttctgaagttagtttatgttttttgtcagcttccttttgcaaaaagatctaatgtctccctgattaatacatgagccttaatcttttcaacacaggttgtacccctccagatgtgtataaaatgcaatatagcaggcatccaaatagataatcaacaaataacatcaattgttgatgcttcaagatgcacttcagaatctactatttctgaggttatctgtaaataattctggtcatctgttcccagttacccatttatcactatttgctttctgctgctatttcccctcctgtgtaatggtaaccaatagttcagtattgtcttaagtacggcaaaccttccctagtactatgcaagatagagtgctcttcctgagtccatgccactttattttcttaaaatcaaggcaggagcactgctgaattctactagaagaggtgaaattatgattacaagaagcccattagtgtaatcttattaaactgcatatgaatcttttgtgttttgaaggataaaagaaatttaatttaccaacatttgaattatgtgcttttgtgttttgttggcatcaagtattgcaaagaattattttaaggttgatacggttaggattttttctcagaaatcttacccattttagtttgttatgtgtacactggtttccttctattttttcccctgaaaaacatgtatgtgttttgatgacccctgttctgtttttagacctttgaacttccccctttttcagtctattaggcagagctcctgccattttcgttaaaaaaagaaaagagtgatctccagcggatcttttcttttgaacttaagtaaattcagttaacgaatattcattaattttccaggttccagtgtaagcatacgataagaggcctaccttgcaaggcgtcattagaagagtgatatggcccaagcatgttgaagacgcccagaaaacagtggatgatgtagcgatataactcctgttctgactttgtaaatgcatacggcattccgcgaaggatcatcattctgtatgttcgttccatttgtacagtgctatgaagttcagttcgctccattgcctaacaaagaagaatgaaaaacaagagcacaattaaagtttagtgaacctgaagtattgaattgaatctccacaccattttacttatgctcagttttattgcgagtttgcaacactacatatttacttttgaaactatgattgtgtttagaaccaggggtgtaaagttttggcatgtcacatcggatatacggacatgcatttgaagtattaaacgtagactaataacaaaacaaattacagaatccacctgtgaactgctagatgaatttattaagactaattaatatgtcattagcaaatgtttactgtagcatcacattgtcagatcatggagcaattaggcttacaagatttgtctcgcaatttacacgcaatctgtgtaattagttatttttttcgtttatatttaatacttcatgtatatgttcaaatattcgatgtgacagagtgaaaatttttaccaggggtctaaatagggcctatatgtttataagtagcagcatcctataactacataattgccacggactatatcagaaaatattgattttaaaagtccttatagccaagaaaaatcattcatcacaagtgattaaaaagtttgaaaaatccatatagggatctagactctagagcactatgctaagatttggtagtaatataagatgttctatagttagacacggttattaagaaagtgggtagaataaaatagggagaggtatttaaaaaactagagttgattttgtactcaattcatttttgcacgtcttctccaaaaaaaaaaacacgatgtacttcatccaggcttcgtccaagtctgatccggtgcagttggttggctccgaagcgtgcacgtccgtgcgagagtagagtaagagagtaaacacgatcatttcgttcttgcaaaactcacctaaaggaaaattaatctctttttttagaacttttttatctcttcgctttcctactggagcttgagggatcaaaaaggagaacgactcaagaagcgggtgtgctctagtctctagacaagtcgcctatgctcgctaattctcacggtttcgtttgatctggttgtagattattattggcttcttgctgcgtatcgacgcatcagggtttcgtcgatcttgtcggcgcatcagggtttctttgctctgcttcggccatgtctttgtggatgcgggcagcctccatcggaggatatggccatgggattggtggatggtttggatgtttactcaattaaatgagtaaattttacaatgggccacatattttgaccaaggtttcatcatcggctagggttaaatcaatgttttcacttaacaccatacatctttacataagtcttcagtttggactagggtgagcaaaacaagggaatatgtgagacagcttcatatgatttacacagggataattataaaatgcaaaacatttcatgttttcttccttcttttcttttcagtgtgtggtagttaactagttctattttctattttatttttattcattgtgccccaatgtatatatcattttgtgccacttttgaacatgttcacgtcattattttagtgtgatctgctgaataaaaagttgttttccgatttgctaatttctttctaaagatatttgtcttaatactgtggcactaaaattgatgattttaactatcttttctctgacaactacctttgatgtgttcaaccctactccaaagtgccaactaatgcaaacatatatggtgttaaggcctggtttagttcccaactttttcttctaacttccaacttttccatcacatcaaaactttcctacacatacaaactttcaacttttccatcacattgttcaaatttcaatcaaacttctaattttggcgtgaactaaacataccctaagtgaaaaggttggtgtggaccttgcccattgtgaaactttggtcaaaatacatggtgcaatgtgaaatttactccaattaaattgatgtgcgtcaatttcaattttagatttgctcctcctttgatcatgtatgtttgttacttccctgcagcattgcttgattgggaagctgaatcacctacaagtcttccctggtctatagtatacaattttggataaccgactgccaacttttagttcatctaattttagtttccaagatttatcttgtcaaaaaaatgaatctcagtcatgtaatatttatcataattttagtttttcccgtgacaatgcacaagcattttgagttaattctaatgtctaaaattggatttcataaataaaggttgtttacttcttacatgaaactttttatttaacaattgagatataaaattatgtttcatgtatgtgggaatgtattctgcgtttgtattgattttgaacttcaactctatcttttacattatggcaatattaattaactggacaatcaacttaaaattcttaggcttctcatccattatcgaatcttgagaaatcatatccctcatccaaaattgagagttgtcaacatgtttatgcacaaagttgagcgagtttgttattttgagttaggatatatcatttgaacatttaactcttttggattttatttaaacggtgcccctcttttcaaccgaacccaaatttcccttttttttataaaaaaaaatactcagcacgtgataggagggttgtgtttttacccttttttttttcccctatacgcgtctcacccagtcgcccgaccggcctcctctcctggccacggcgacgcctcctcccccggccacgccgcgaataccttgggtctctgcaatagtccaataccgatctgcggcagctactctgctcgtggaggagagccgccgccggaagccggaaggccgggtagcgccatggtgagatcccgagaaccctaatcctctccgatgattggattcgatggatctggcgatctaattcgtgtttctttttcctttttttttggtggggggcggtggtttagtcggcgctattcaacttcaattcgttcctgaccgtggtgctgctggtgatctgcacctgtacctacatcaagatccagttccccgccatcctcaacgaccgcaccgggtatttttttcttcgtttcactgtgaacttcctgatctgcgcgatttgttcttctttttagtcgtggaggcaaataatctaacccggaaaactaaaacagcgagatgtatgagaaaaatctatgtctttacagtggaaattgtgtctttcaggcgctgtattaacatgagacggctgtgtgcgctgacaaaaataaagcttattatcgtggatgaattgcatatagtttgtttgtggaccggattctctactaatgtggtttatagtaccctgcacgcaattgaattattgttcttagatgttgttcagaatatatacagatgtgtttgttagtgctagttatgcagaaactgaaagtttgcctgtgcatgaatggttgtggacaataaagtaacttagctttggtgactccaacttgatttgggcatgattgatctgtgcaagaaaccagtcaaatcaatcaccaacttatatgccatgaatcatgataataccatgtgctaactgttgtttgaaacagttagtgacaactgtacttgtcactgtgtttacaatttgttcttaacccttatttgaaatgccaaatggccaatggatcttgttgctttaataaagcagaactgtggaaggatatctgttaccatgtaatgtaataagctgatatattcctttttgtacttgaatttctccacagattccgtggtttcttttggaaagcagccagaataggtacgagtccttttcttcttccagctcgaatagcaccacctatcttgtttccattttgctaatatctcctgcatgttgaacggtcatttcatttttcactctgcaccattgggcactagattttttgttggtatatatattatcgaacatagtttcgtctatcaacctcaactgtaaatgttcactcattcaaattgtcagcacctaagttcattatttggtgtttagctgagctcttaatttcagcataggcttattatattatctatagaataatggtatataatacttttctatttagataattttaaaacaaaacaagtaaacgaaaataaatctgaatcatctcaaatttctgtagaagaatgttcataaatacattgttttcttttattttgtcagatagctattatttaactatcatgaaagtcagtagtcttaatttctcaaagaaaagcagccctcctgtgattatgtttgagatcttcaattgccattttttttcagctgtggagttctcgtgaaaatttgctatcatggtatgcttaaactatttagcaaaaagatcctggttagatatgcgttgctttattgtcatggtcctcatggtcaattcaataatatctctgttaggcacataatggccactttaatcttaaaaaacatggtgtccttagagatctatatggaatgaaggatagtgaaagtttacaaaacatttagtgatgataattggaatttgaagtctgacggtgcagcatttctttcttcgttcaaagtctaatggacctgctcatggatgatatcacattaatactaaagatatgctgactatcagccttgatgatcagtagttattcaaccaatgttttatcacctgctccttttggaactttacttgaaagcaaatagttcctatcagatttcctaccacttcctggttatttatcttgaacggttcttttcctatttgtattgaacttgattaacttggacaaatgaatttttataattctattaaggccaaagttactcagtgagaataactataacttattaactgcagctaaatatatattggtggaaacatttctgttttgtaactataattccattgtcactaagaaattcaggaactgctgctagttcatattgtgaatgtttttccacatctggatctcatttattgggttttcaactgtttatatgtaaaattgtaaacatggttgtccaaactgatagttatgtgctgtgggctgtggcgcaaggcccggtaaagctttgtgacagacatggctctgaagaccatgtggttattgtagacctcaagttaattaattgaaaagccagttctttagatatttcataatttggtacacaatcatgtcaattacattatttttgtacagtgataaagtttcttcatcagttcattgttaaaaatccacccatctttctatcatcccactatctactaagaaagaattctggccaaagagttctatttaatctatctctcgatcaacttgtcagccttgaagccttgtcattgccacagttgggcaagatctctactagcatcatgaccatagtgtgtgcataaaccctttgtctttgcctgcttgcccaactacacagcattttaccagagccacgttcatgagggattatttcatttgattgtctggttattaacatatatgttgtatgtgcaagtttttcaattactcaacagtgagataatgttgccaaataacatggtattatatatttatttaatgcatcatttgtttcctaggcatttggaattcatcttttgttggtttttctttatcaggtgaacgcttaagcccgtgggtagctcttgggtgctttgccatggggatatccactattttcttctgaggccttcatgattttaatccaggctgcagaagatttgtaggaagaacagtgtgattattattgcattgttttttgtgtttttggaggagcttttgtttcaatatagctgggatgtggagatacgagtctcgcaagtgccagttgttactctcagggtggtgcccttgtcaggaaagaagtgatactatggttgcaccatttaatggttatgttgtgtattgaactgtttatgtgcacatggcatgttcagaaaatgcttaaatgctcctaacaggatattgctatttctcagattctgcttaatgctatatggatgcgcaggtttgctgcactgtcagcataattgagcagttaaatgtactagataagatgtacttcaagctgatcgtttgtctatataccctaggcacaaccaatgtgcatgtgtgattttgtcaaggatgcaccattgagcatgtgtggttttttgtcaatgcgcacagccccgaccttggttatagggcaaggtcagagaagatatggtcatccatgtttcttagtgacaggctgggtggatggaatgagctgctccaatttttctttagggtggatggatgagaatggatagaataagaataatatactagtattaattaataataacacaatttattaattacttcctcgtttcataatgtaagttattctagcatttcctatattcatattggtgttaatgaatctatacctagattcattaaca

SEQ ID NO: 23801 - DNA, 17402 bp, Oryza sativa
  unsure (1)..(17402): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttgtcatcgagttgcatttactgacatgatggcttaggcttcgttcgagcgcatgaggaagagagaaagatagttttgttttccgggcgcacgtttcccgaactactaaacggtgtgttttttgcaaaaaatttctataggaaagttgctttaaaaaatcatattaatgcatttttgaagtttaaaataattaatactcaattaatcatgtgctaatggctcacctcgttttgtttatcttcccaatctcctcaatcccctccttgtcaaacacacccttagccttcatgtaaaagcagggcaagaatcaaaaagtggtgctgatgttctttcatggtgtaaatattttttttcatgtatgcattaggtggtgtttggttggagggactaaagtggggctaaactttagtccctctcacaaaaacataagtccctaccatagggacttgtactttcgtgagagggactaaatttagtctctagttcccaaatatagttcccaaatacccccttagtatgagaagctatacggaagttaggttgggttcggcaccccttttcccaacctctctccctcgttttccacgcacacacttttcaaactattaaacggttcgttttttgcaaaaagtttctatatgaaagttgcttaaaaaaaatcaaattaatccatttttgaaaaaaaagctaatacttaattaatcacatgctaatggactgctccgtttttcgtgcgttactgatctagtttggaacaactaaaatatgtacatattttagtggtcaaagttacatcctacaagcctacaactatgtattccatcctatatgctatattagtgagggcgatccactggcaaaatttttcactgtcacatcgaatgtttagacacatgcatggagtattaaatataaacgaaaaaaataactaattacacagattgcgtgtaaattgcgagacggatcttttaagcctaattgctccatgatttgacaatgtggtgctacagtaaacatttgctaatgacggattaattagacttaataaattcgtctcgtagtttacaggaggaatctgtaatttgttttgttattagtctacgtttaatacttcaaatgtgtgttcgtatatccgatgtgacacgccaaaactttacacccatatatctaaacaccccctgaatcaacttaacttagttatttctataaaattcaacatgcatttagtcctgtttggtcagtacacccatcaatacgttacatgaagttagcattccctattaattgctatatttttactcatttagtacttaattaatatgtaggcctgtaaagtgatgttacaagcatgtctaaattcttaatgcaatgagagggatatccatttctaatagtatagttttgtatttatatattatcattcttaatagttttgcattattctcattcttaaatataatttatgagttgtttcgttctactgtagatcatgattatcgactaccaattactattcccaacaggatcggtcataggacaccttattaatagctttcacactcctgaaggtgcttatatagcaaagtaatgaagtcttgtctttttagtgaaaattaaaacactgaatttcatttaactacatattcatattttttgcactaatatttttatgtcaacagaatgcaggttatgactattttcaaagtattttttggtagtttttcttggtctatattccaatggttctattcttcaggcagtggttgtggattttcaagctttccaacgtttggactggaactatataaacgcaggtgatagctatattccttttttaaaataatggtattagtcaatgattgagtatcaacatagtatcatcaacagatgatctagaacggtcacacagaaaattatatatctatacatatagcgtatcacgaaattctcttaacaatttgtatataagttgtgtatccatttccaaaacagaaatgattaaatatgtaagaaacaattagtaatttcacaatatttaatgccaatatagttattatgctgataactagagaaaagtggcaaggagttttcagaatagctagctagacaattgggccatacatgtcatgtgaaactgtgagactgaatatattgctcaatctggtctgcagatttaggggggtagacaataaaaaatgtagtcctgatttcatcgatggaagatggtcttacggattatggaaccatcgaattgctgctaattgtaggaattgatgcagatctcagtaaatccatgtacaaatttaaatatattttaaaggatataagcgtctgaattactaacatattgtattgtgtgtgcctacagattctacattgatttctctgcaacatatattggtgtaggaatgatgtgcccacatatagtcaattttgggttacttttcggggccatcatctcttggggatttctatatccttaccttgaaactaaacatggggagtggtatcaaactgatagcccttcaaacttagacggactcaatggatacaaggtacatttcttttcttaatataatggataaaaatccgacctacctctttatccacagatagccgaaagttacgagagttcttaaactccaagcctcaaaactgaggaactcagagaaacaataaagatatatatacgtaaataataagatcatatcaattgttggatcatctaataagattttatctcactcattttgtggtacgtactaaccaatgcacggaaagaattttgtcccccaaattaatagctacttcctccgtttcataatgtaagtctttctagcattgctcatatctatatgaatatgcgcaatgctagaaaaacttacattatgaaacgggggagtagtactaattgaaatgcatatgaaggtatcaagtatagtaatacctagtatattagaatttttgtcatgatccatgtatccaatttataacttgaacaaaccttctgatataatttccagatatatgcatgcggtggatgaaagccatattaattttggtagtttttcactagtgacacgaactattctaaacttcttgtttttttttctccaatggatataaacttacatggcaggtgttcatcagcgtgacactgatcgtcactgacggcctgataaactttctgatactcgtgacttcagctgcaattaacttctaccatataaggcaacagcaacagcaaacgtcagggctggccagctacatcagcaagaaccctagcatgaactacgacgaacgcaaaaggatcgagatgttcttgtccagcaagatcccaatgttcgtgccggtggcggcctacgtcgcatggacggccatcagcatggtcgcgatgccggccatgttcgaccagatcaagtactaccacgtcggcgtgctctacctcgccatacccgtggtcggcttctgcaacacctacgcgacggggctcaccgactggtcggtgtcgaacacctacgccaagttctcccccttcatcttcgcggcgtggatcgccaggccgggcgccatcgtcgccagcctcctcgtcagcgggatcaccatggcgtcgctgcacgtctcgtcgcaggcgatgcaggacctcaagtcggcgcacatgacgctgacgtcgccgcgcgccatgatcgccgggcaggtgttcggcgtggcgctcagctccgtggtcagcccctgcatcttccgcgcgttcgagaaggcggcgaagcccggggcgccgctggggtccaaggactccgtctacccgtgcccctacgccgggctgtaccgcgccatctgcatcatcggcatgggaggggtgaagggcctcccaaagtactgcgtcgagctctgcgtcatcgccgtcctggtgaccatcgccatcgacgccctggtgctggtctcgcagctcaaggggtggaggctccacctctacatcccgagcatgacggtgatcgcgctgccgttcttcgccgggtcgtacttcaccctcgacatgtgcctgggcggcctgctgctgctcctctggaagaagatcgacaccatgagcgccgagatcctgtcggccgccgtcgcagcgggcttgatctgcggcgaggggctcttcacgctgccatcggcgttgctcaacatgttcaaggtgctaccgccgatgtgcatgaagttcttgcccagtggacaagaggttgaggtggtggactcattcctgaacagctcgggaggaacagtacccaagacatgaccgatcgatgttgagatcaagttaatatatgcactcatcaaattaagattgactgttagtactccttaattggttaccacatctcggtggaaattaagtggtctatgaatcattattgatcattgtaaataatgatgcacgtatcgtattttacatatatatatgtcatgtaattgacataagtagacatgtgagccagctttggttgcaacatgtaagagatgcttgttatagttaagtgccacagaataaagttgtagttgaaatatgaattatactactattccacaaatgttcactgttttctaacataatgcagtacaaaatcttaaaagcttgtggtactcaacaggagtttctcagcatatttttctatgcaaagtgttgtattaatacaggtgatagggtagggttagcttttgactcttgtaacgtatcaactctttaaatatagaggacaccacaatgtaactatgcatggtgacgaaaatgcaatgtaggcactcacgaggaggatggcagcattgtcataggcctatagcagttaggtgtactattgattgaggagtagcatccataattagagtgtcaagatttatgctttggctataaacctcgttaacaaatgtgttcttaagcatatatgagttgatcaatggttgaagtgtgtgcaaaagagtgcgaaattattggtattctacatgtcacatccatcaattctaattctaattcaaatttctattctattttaacccctagcatagttttgatagacctcgtacaaatcttaaagcaaatggttaaaactactttctggacactcattgtaaccgtttccaccctgtaaacattaggtatgttgccctcagcagcatctgtttcatcaatatagaaataaggaacagaatcagagaaatcggttcaacaaacagacgctatttttgctccacagcgacactacattccctcaccacctcccaattcagaccaacccatgcattgttcctaggagagccaacccaggagaccacccacttgtgccatcacaacacaacccaaaaaccctccaggaggttgcctccattgacctggagctttaatcgccatggatgcgatgatcggcgatcccatgtcagcgacatcggtggaggcggtgttcgagaagcagccatcgccggaattcagggagctggtgacgccacgggccatggccgtggcggtggtgctcagcgtcgtcatctgcttcgtcggcatgaggatccagatgacggccgggatagtgccggcactcaacatgcctgccagcatcctcagcttcttcctcctcaagtggctcatcaggctgctacagagttgtggctttcccatgctgccattcacacgccaggaaaatatgttcctcctgacttgcatcatcacctgcctcaacctggccctcacaagtaagcatcagcattatatgcctgggtaaatattgcgaaaacatacttctcccacaagtataggaaatactacatgttatatatttagatggaaaagcctacaactgtgctactacttgtgaaagaaaaagaaaaaaaaactagatagactgactcaatcaccagcctcaggtggctctctcccttacagcgtacagctgaaagggcacataaaactagcacctgagcatgcgacctcatacaaatcacctcatcttacaagttatcagtcaactaaactggggaggtgacaaaacagtaggtttctttacagttatccttcaaccagttgtggctttgtgatatgtgaaacaagaacagaaactattttattttctggcagttcaatcaggactattaagtattaactactttaaattctgctagttgagttgcagttttgaaaatctagcttaaaagtattagtgttagccatagtagttcttcagggtgtcaagagttacatggttcatcgaaattatttatcttctgccaggttctcaagcagccatcccaacatgaaaatcttgttgcaaaagccagaaagattaaaaaaacagagttcaaaatatcggataatcaaaacttctctggtctaaggacaacaaaacaaaattttggtcctaaaatattccatgaaactgttctgaatgatgtttgtctaacaaaacttggatttgcaaaaaatgtgcaaattaaaatgcaaccaaaaattttcttttttctccttttaaatgtattgggactttgttctcatcaataatacaattatctatgcatgagtaatgacaagataaattaataaattcctcagaagtacgtgaaatattcttttcttaagaagttatttgaataacctggaggggcaacataaatcaaaactttggaaattactaaaaagcttgataagaaggccagaagataagtgaatctataggtagttagatttaactttccgtaggaaataatgacataaacaaaacgtaaacactattgccaacaaaaataatgaagaacagtaaatatgaagtagatatataatatattatgttttaaacaaaggttccatacataaatgaaccttttacccagttagtagttagtactagtctcactctaaactccacataggagcccagtggaaacaactactaccactatcccaaaataattgtaattctagattgtttagtatatattaagttttgagaaaaaagactatgatacccctcattaaatagtatatagataaaactagaaggatggttgagggtagaatgaaaagtgattggtaggacaattattactctattgtcacaactattttgggacaaatttgaatcctagaaatacaattattatgggacggaggtagtatgaaatttaatctaggcttattatatcagcaagttccagtcataattaaccatctattttgaatatcatgggtgctgccagaaaagacggagaaaatttagaggactattaccatacgatcacactcacgtagttaaaatctccagtagtaactgtatttcctcgattactgccacaggataatttcatgcctctaaaaccaagagaaattttataattaaggtagtaaagagacataaaagatgtgatttgaacttggagatttgtcatatgagatatgaaattgattattgtggttattgtaaatgcatattcacctgggtccatccatttatacagacaataccttttgaaataaaaaatattgatatatcaaaaaacaaaacattcagtagagaaagtagcatacctataaaaccaaacttttggggaagttgtgcgcctaaaaaataggttttggaagggggaggagagattgaattatcaagaattgtttttatcttttgaaaccatttttattaacttcgaattaaatccttccataacttatatttaaaagtaaaccttttggacacaaggtatttaagagcccaaaattggaatacttttttcaaaacaaaatactcaaataatttgtagccagttttttttttttacattttgtatctctttctagtttaactggcctattttcttgttacattttttaggtggttttgcgaccaatatcattggaatgacttctacggtggccagatcacttgctgatgatccagatccaagagatattatggaccatgtaccaatcggaaaatggatagtatacctattccttgttggtatgacgggagtgttaataaatgtgccatttaaccaggtttcttctttcactgattgatcatttttttttaattttagaagtttctacttaacatttctaagattgttttgcattattctcatccttaaacataattcataagttgatttccttatactgcaggtcatgattattgactacaaattactatttccaacaggaacagttatagctcagcttattaatagctttcatacccctgaaggagcttacgtagcaaagtaatgaagtcttgttttcttagtaaaaaattgacagattgaatttcatttaactatattcatgattttgtgcactaatatttgcatgtaatccagaatgcaggttgcgaccattttcaaagtattttttggcagtttttcttggtctatgttccagtggttctatactgcaggcgatgattgtggatttcagcactttccaacatttggactaggattatacaaacacaggtgataaatatattcaattctgctaaagaacgatgttacatgcgttacagttgtgtcctcctcaccttcacagaaagatgacattttatagactatatattaatcaatgtttttgagtatcaacatattatcaatttatcatacacaaaagatctgaatggttatagagaaaactgtgtaaatagtttattacacaattatctcaatagtgtgtatgcaagtcatgtatttctataaaaaaagaattatttgacatatataagtctaagatcgtcatgttcataaaagacatgacactaaatatgaaaatggctaatgacaattagatcatacacgtcctatgaaatggcaacattgaattgatcaatgtgatttatttactataggctagggtagggaataaataactcagtccaaatttcattgatggttcataggaatcttatgcattacggaatcattgaattgatgccatttgtaggaattgagtttgacaatgattagtcaatccatgtacaggtttgaatatattttacaggataagcatatcagtcgaagtgaggtactaacacacacatatatatatatatatatgctgtacctacaggttctactttgatttctctgcgacatatattggtctgggaatgatttgtccacatatagtaaattttggattattttttggggccatcatctcttggggatttctatatcctttccttgaaactaaacgtgggcaatggtatcaaactgacagccctacaagtttgaatggacaaaatggatacaaggtatgtacgaaaaaaattaaaatgaagcatactactgaagggttgtctaaaatttatcagtccttttctgctactaatcaatgcaaagacatatttttcccaccaattattttagctactctactaaaatgcatctgaaggtgtccaagcatgccaacatctcacacccataataaccaattaagttgaacaaaccgtacgatgatacgaacatatgtgtaattgctctttcttttaatatgcaacaacttccactcttctatctgtgagttggttgcaaacctgcaaacaaggggaaaaaagacatgcatgaaaactaggtaattgctataagttggaccaagtatatgtatcttaccaccttactggggttaaaattacacattatcattctaccaatgcaaatttcatggtactgtacattcttgttgttgttgttgatggtatgttatagtaactagtgtcattgcatcaaaaatcaagaatacataaattcaaatgttgttgttgatggtatgttatagtaactagtgttattgcatcaaaaatcaagaatacataaattcaaaagttggcatcattgcagaagaaaggagaaaattcatacatacactttcatgtaatacagatcagggaggtattgcattcattaacaatctgagcacatacttcatatcatatatttcgtttagtatattacacttgactaagaattttgagattccaatcaagcttttcacctttaaatttaatttcaccatgagctgtatctgttgctactaccaaacatgtgcatagtcattgcagcacttttgatgatgtaggctatattgctgtcttgatcaatttgctagctactttttcactagtgagacatactcttctaagcttttttttttctatggatataacttatataacaggtgttcatcagtgtgacactgatcattactgatgggatgataaactttctaacactcatcactacagcatcaattaacttctatcaattaaggaaagagcatgatttagggcttgccaactatttcaagaaacacccaagcctcaactatgatgatcgcaagaggattgaggtgttcttggctaaccggatcccaatccctgtgccagtggcagcctatatcacatgtgcagccatcagcacgattgcaatcccagccatgttcaaccagatcaaattctaccatctggccgtgctttacatggtcatcccagtcgtgaccttctgcaacacctatgcgacagggctcaccgactggtcggtggcaccaacctatgctaagtttaccaccttcgtctttgcagcatggatcgccaagcctggcgctgtcgtggccagcctccttgcgagcggggtgatcgtggcggcactccacatctcgtcgcaagcgatgcaggacctcaagtcgggccacatgacgctaacgtcgccacgcgccatggtcaccggacagatcttcggcgtggccgttggctccatcctctgcccatgcgtcttccttgccttccagtccacaacgaagcccaacgcaccggtgggttcaaagcagtccgattacccatgccctttcgcgggtctataccgcgccatcggggtgatcggcactggaggggtgaaagagctgccaaagcactgcatgacattctgtgtcgttgccttctgcgtgacggtcatcattgacgctgtcgtgctggtctctcagaagaggggttggagcatccacaggtacatccccagcatgacggtgattgcgctgccgtttttcgctggctcctacttcaccatcgatatgtgcgtggggagccttttgctgcttgcctggacaagaatgaatgcaaaaagtgcagagatgctgtcatcggccgttgcggcaggcttgatatgtggagaagggctgttcacactgccatcagcgttgctcaacatgttcaaggtgcaaccaccgatgtgcatgaagttcctatccggtggcgaagaagttgaggcagcggactcattcttgaacaatttgggaacatccagaacatgatgagaaatgcactcaaagatttaccagtagaaaatggactatgatcgttgtaaatgatgcacatattttacatatgtcatgtaacttaagttgacatgtgagcgagcttggttaacatgtaggagatgcatgatatagtggagtgccaccgcgtaaagttctagaaaataaaggggcattatattctgcagaagttcactgtcatctaaaaggtaactgagaaaatgagaagaactagaacatggagttttttttttagtgagatcagaaattaaatttgtcgtaaatcaagcagtaaactggcaaatatattacaacaatctttgatattcatcggtttatcgaccaaatcttagtgagctgtttttagtttaggctttggatgcaaatccatggattggaatgttgcttctggcagagggaaagcggaaactcaccagcaattgaggcggagcatgttctccgatccggcagcgacgcgagatcatctttgttcccctggtgatagcgtagcagaggcgtcagataaggtatggtggggtggggatacggccatgggggtggtgaggaaggcgaacctcgctatggcgacatcaacaaccgtgggcagcggcggcggtggcggtggtggctctgcgcctgactgcgcggcaacggcggcaagcccctggggcgcggcgccgtggcagagaggttgctgtgtttgggctgcagagaaccccttgaccacccgtccaacgacgcggcgattccagcgcggtgccaggtgttcgtgcccccacgacggcgatggctgcttcgccggtgccggcaccgtcaccgatgtggcctccagagagttctggcggcaaggcgaagctctcaccatggtcggcggcgccgcttgcgaaccacccctctaccctcggtcgtggctgagcagcgtcgctgtggaggacgacgagagacggccggattcgaggagacgaggaatttggggattggagttggacgaagacagtttgggctcaacccaccgttccatcgaattaaatttgaaaatatacattgttttttaatattttacgtttatatacatgcatgtaaaatattcgcacaaatataccttctctgtatgatggaaacgcgggaccgagacagtgccgcgctttcattctgcggaaccggcagtcgcgcagcacagccgtgtggcaccgctcgctcccgcagcccgggagagcggcagcgtggtataggcagctgcacacggtcgaggtgaccgcctccacggcaccgatgcacggaaccgatccggtcacgcgacatcatggcgcgggaccgtgccggtcgcgcaacaccgtcccgtcccgtgtgtgcgcgtgtcgcggttgacgcgccatgcaagcatcacatgtcgagcacgcatgcaggcagttgatccagtcaaatcccaggcactagcttaggggtgtgttcggcacctccattttccaacccatctctctcatttttcactcgcacgcttttcaaacagctaaacggtgtgttttttaaaaagtttttatgcgaaagttgcttaaaaaatttaaattaatatatttttaaaaaatttagctaatgcttaattaatcacgcgctaatggaccactccattttccgcgcattcctggttgggaacctatactagcgaacacaccctaggcctatttaaatcccgccctaaaatttttcaccatgttacatcaaacgtttgaacacatgcataaagtattaaatataagctaaaaaaataattaattacatagattgtgactaatttgcgcgacgaatcttttaagcctaattacttcatgatttaacaatgtggtgctacagtaaacatttgctaataacgaattaattaggtttaataaatcccttaagctagtgactatgtattgtagggtttgactggatcaactgcctgcatgcgaccatgcgtgcttgacaggtgatgcttgcatggtgcgcgtcgaccgcgacatgtacacgtgcacgcgcgggacgggacgggacggtgccacacgccatggtgccgcgcgaccggatcggtcccgcgcatcggtgccgtgcgaccgtctcagcaccgcgtgcagccgccctccaccacgctgccgctctcctgggctgctggagcgagcggtgccacacggatgtgctacgcgaccgccggtcccacagaatgaaagcgcggcaccgcttcgatcccgcgttcccatcatacggaggaggtatatttgtgcaaatattttacatgcatgtatataaacataaaatattaaaaaacaatgtatcttttcaaatttaattcccgttccatccaaggaataaaattcatcgccgagcctaaaatttgtccccaaactgaaatactagagaatggatccctcaatttacaaaacaggatcatcatccacaagtttagagacgaatttcagactttacgacaaatttgagagacctaaaataaacttatcccttccatccaatgaaaatctgtgagctggatttgtcaggcccaaaaaattgcaacaaaatcctaagaaaaaaataattattatgcttccctttacgatgctgttaacaaccaaatttgataacatcggcgtcaggaaagaagattagatcgaagcaaagtcggaggcggagatcgagttcgaaaacagagcaggaatcggctggagaccagatcggctacgattaggattggctgggtctgagtcggactaggtaagccggtgtagccgattccgacaatgcaacttgatgaatgagatatcaggttgaattgaggcgcttcaaggtgattgccgcacatggatagagtcctgagaaggcaattgtatctattaattaggatgttttatgtgatctccttagagatacgcttgggcaaaagtctgccgcaaagacgtatggtatcttagagtttgttagagatagtagttgtatccgttatggacatatcttgtaattctcgggtataaatagacccgagccctatataacttcgaacacacatgttcaatacaatttcggcgcaccgccacccttttgctttagttctgtttcaacgagttcttgctttcgggttgagttgcatcggttttgatcttcaacaagaggcaaaacttgttatgacggcttgtattctcaggattagtgcttctatctttatgacactctaatcttgtttatgtaattcgtagagttatcatatatcttacataatctctggtaatatcgctatctaacctacaatcgactaacatctatcgaagagggcagctgattaggttagattttgacgttgatttagattatataagatatctaccactctatgaaacttccagcggcttgattgtctagatattgttcttcttttcatacttaatgctgcatcagttgagtttgatctattaagtcgtgcttagaatatcaatctctagcctgccttctggttgccgattagggtagcatcgaagtttcagccgatcttatccgatttaactatatttgctctatatgcttcattgacatgttaaatctgccctttatgccaagatattgctgtatctaagtatattaggcctttgtttgatatattatacctgttttaatatcctgatagagtagtatcggagtattagccgatacatgctagatctatctgatcggctatgctataaacatatatagtcctgttagtaatatatatttcgatctaagtgatttatactgtctcggcatggcgaccgatctatcccaatcacttgatttaagtatatatcgatataagaactatatattggaaatatctacagccgatcgaatagatttagttctttattgtctatttacaactgccgatcgattcacatatgacatcggctcaaagataaatgatatgtcatcggcgcctagccgatcggctatcatttatagatttaaccgaggtttctttgcttctatttcttattgattacaggatcaaatcaactggcacgctagcacaccccaaggcgagctttggacctgcactggagttaagcagatctcccaggcctcgtgttttctgtcaacagatgccctgactccgattttcctccctcaacctaaatcggatatgacgactcactcacctataaaaaattgatttattttatctatccaaatggttttgattgatttagcctctcttctcttttggcacactcttttggcacgcctggtgggacatttgagaagtcagccaacaattcttcctcatggccaagaaacaaccaccaccaccatctagcccatgctctgttaaggacaagatgctgaagttaggattgactgacgtcaatgaaggaaacgtcgtgccgatcgatccagaaaaattcacacctgagcagaagaaagagtttgaagcaatattgcagcaagcacgggatcagttcttgaaatcattcatgcagacccgcaaggggacacttgttcagaagtacaaaataaaagtggttgctgatgatcctgggaccagttcttctaaggatggagatgggaaacaagctccagacggctcggctcagccgagtatcaaaggtgctaccgacggctctctaggaaatcaaggcgacaattctcaaggagtccatggagtacaaggtgacggggtgcatggagttcaaggtgacggtgctcaggggctgcagggaggaaatcttaatcagaatagtgatgtggcacaggattttttcaataacttccaagatcaggttgattacgctgtgcatcatgctttgatcaatcagtctggggtgttagtcaataccttatcaaacatgatgaagtcaatagccgatggttcaatagctgagcatcaggctgcaggcccggtttatttgcacggaggtgtcttcccaaattatcggtctttgattacagatgttcagccatctactcaggcggttccctccgttgcaccaacaactcagccaacagcgccgacatcaactcccctacctgcttcatcagcgatggcgccaggccagccgatgaaccctcggttgttaatgagagagcagccacagcatggcgggcaggttacgagtcggctgacccaagatcaggttgctgccatgtttctgccatctcaacctgttgttgatccaatacagcagtagccgattcaacagacactcccaattcagcaggttgtacaaccaattcggcaacaggtcatgcaaccagttcaacaaacaccaccaaggcagcagcccctgcagccgattcagcagacgccgttaagacagcaaatcgttcagcctatccagcaccaaggttcaataagcgcatcggccgggtttgcaacgcctggtggtcagcctgtacaacaatttttaagccaagatgtcccagaacatctggttcaccacgtacagccagatggcacagtaatgcctcaagttgttcctgagcacttggtacgcaatatccagccgaaccttcataattaccaagggggtaacttgaattatcaatatcagcctccttccccgcaagcccaatatcagccagggggattggctcaacctcagtttgcgtctcaatacggtcagttcgagcccatgcaacagtagtcacaaggggcagctcggcaacgaccgtgggccgatgtgattgctgacgtaatgagggaacagtttgggcttaaaccaaaagagactggaagcttgtatcggcagcc

SEQ ID NO: 23802 - DNA, 6262 bp, Oryza sativa
  unsure (1)..(6262): unsure at all n locations
aaagttctggaaaagaagagaagtatgactttgatattactaaagctgacaagatctttgatctgctactccgagagaagcaaattcaacttcctactagtcatacaatcccatcggctgaggaattaggcaaaaagaggtattgcaaatggcataattctggatctcattctactaacgattgcaaggtttttagacagcagattcaggtggccattgagggaggcaagattaggtttgatgattccaaaaagccgatgaaggtcgatggtaacccttttcctgttaatatggtgcattcagctagccaaacagccgatagggtccgtgcaaggggttttcaagcgaattcggctaagattatcgacaaatatcagaggaagtatgacaagcagtaggagaggcatcatgaagaatacgaagatggttttgatcctcattggggttgtgagttctttagattctgctggaatgaaggtacgaggttgccatctattgaaaactgccctgggtgcagagatatcgtcgagagctcaagccgatcatataataggggtaatcggctaaggcagacaagagtttctgttcatcaatgattgggtccagtgaatcaagatcatggccaagaggacaatgtaatcaggaagaatcaatggtgtccttctggtattttcacgaagaatcagaagataagggttcaaagattgaggaacagggagcgccttcaggaggttgaacaagaaattaatcatcggctgaggaaagcaaagccaaggcaggagtggcgtgttaagaatcaggttcctgtagccgatgatgttgcagccgatgaggtgaagaggttggcaaaagggaagagtgttgtgacagcaccggtcaacatggtctttaccttgctagccgaattcgggatcgatcaagccgatgtcaacgaggtggaagaggaatcggctaagttggttctatcaccagaacaggcagtgttcgagaaacccgaggggacagagaatcggcatcttaaaccattgtatataaacggctacgtcaatgggaagccgatgtctaaaatgatggttgatggtggggccgcggtaaatttgatgccttatgctacattcaggaagttgggtagaaatgccgaggatctcatcaagacaaacatggtgctcaaagacttggtggtaatccatcggaaaccaaaggtgttctgaatgtggagctgacagtcggcagtaagactattcctactacgttttttgtcatcgatgggaagggttcttacagcttgttgcttggaagggattggattcatgctaattgttgcattccttcaactatgcatcaatgtttgattcaatggcaaggcgacaagatagagatcgtgccagccgacaggtcagtaatgttgccagtgccaatttaactctttgggagatggatggccttgattgtttatctggaaaagtctgggatggagattttctaaaagtgtccgattctgatatatagccaattgaagatggagaacccaagctattattttgagggcgtcgtggagggttcaaatgtctacaataaggatacagtagatgatctcaatgacaagcaaggtcaaggtttcatgtcggccgatgatttggaagaaatagacataggtccaggcgatcggccaaggccgacatttattagtaagaacttatctctagagtttagaaccaagctgatagagcacttaaaagagtttagagattgcttcgcttgggaatattatgagatgcctggactcagccgatcgattgttgaacatcggctacctatcaaaccaggggttagaccacgccagcaacctccgaggagatgtaaagccgatatgcttgaaccggttaaggctgagattaaatgattgtatgatgctggttttattcgtccttgctgatacgctgaatgggtttctagtatagttccagttattaagaagaatggcaaggtcagggtgtgcattgatttccgagatctgaataaagctacaccgaaggacgaatacccaatgcagtagccgatcagctggttgatgctgcatcagggaacaaaattttgagttttatagatggaaacgcaggatataatcaaatctttatgactgaagaagatatgcataagacagcttttagatgccctggtgcaatcggcttatttgaatgggttgtcatgactttcggcttgaagagtgctggagctacatatcaaagagccatgaattacatatatcatgatttaatcggctggttggttgaagtctacatcgatgatgtggttgttaagtctaaagaaatagaggaccatatagccgatttgaggaaggttttcgagagaaccagaaaatatggcctgaagatgaacccgacaaaatgtgcttttggtgtatcggctggccagttttgggatttcttgttcatgaaagagggatcgaggtaactcaaaggagtgttaatgcgatcaagaagattcagcctccggagaataagacagaattacaagagatgatcggcaagataaattttgtcagaagatttatttctaatttgtctagaagattagaaccttttacaccattgttgagattgaaaacccgatnccaggcccagagttttttttttaaaaccctttttgtgggggggggggggggcgagagtagcaaaatgctttggataatattaaggaatatcttagctctcctcctattttgattcctccacagaaaggaataccgtttaggttatatttatcggccggtgagaagtcaatcggcttagtcttgattcaggagttggaagggaaggaacgagttgtattctatctcagtcgtcggctcttgaatgctgaaacttggtactcccctgtggagaagttatgcttatgtctatatttttcgtgtacaaggttgaggcattatctactatccaacgagtgtactgttatatgcaaagccgacgttgtcaagtacatgctatcggctccaatattgaaaggaagggttggaaagtggatattttccttaaccgagtttgatcatcggtatgagtcgctgaaggcgattaagggacaagctatagccgattttattgtggaacatcgtgatgattcaatcggctcggttgaaatagtgccatggactttattctttgatggatcggtgtgtactcatggttgtggtatcggtctggttataatttcccctaggggggcttatttcgagtttgcttatactattaaaccgtatgcgactaataatcaagctgagtatgaagcagtgctcaaagggttgcaattactcaagaaagttgaagccgaaaccattgaaatcatgggggattctctgctagtaatcagtcaattggcaggagagtatgaatgcaagaatgatacattgatggtttataatgagaagtgccaagaactaaagaaggagtttcggctggttactttaaagcatgtctctcgagaacaaaatattgaagctaatgatttggcccatggggcatcggggtataagccgatgatcaaagatgttaaagttgaaattgcagcaatgacagccgatgattggaggtatgatgtgcatcagtgttcgttcaagaacatataatctaccgatttggtattcctcaaactattacaactgatcagggttcaatcttcgtgtctgacgagtttgttcagtttgccgatagcatgggtatcaaattgttgaattcttcaccttattatgcacaaggtaatgggcaaaccgaggcgtctaataaaagtttgatcaaattgattaagcggaaaatttctgattatcctcggcaatggcatactcggttggccgaaacattgtggtcttataggatggcttgtcatgggtcaatccaagtccctccttacaaacatgtttatgggcatgaggctgttttgccgtgggaggttagaatcggctctcgaagaacggaattacaaaacgatttaacaactgatgagtattacaaccttatggccgatgagaaggaggatctggttcagtcatgattgcgagcccttgcaaaggttaccaaggataaggaacatgttgctcggcattataataagaaagtggtacctaaagatttttcggaaggagaacttgtatggaaattgattttgacgattggtactcgtgatagtaaattcggcaagtggtcgccgaattgggaaggaccgttccaaatttataaggttgtgtctaagggagcatatatgttgcaagggcttgatggtgaagtctatgggcgagcgctcaatggcaaatattcaaagaaatattacccaagtgtttgggttaacgcatgatcggctagcattgccgatgcatgacagccgatgagtttacaccgccttgagatggccgatatggttatatcgcccttagttgttttccatggtgtaatcggttgtggtttgccgatgtacaatggccgatattgttatatcacccttagttgttttataattttatcaatgcttttgacattgtaaaattaggggggcacatatatatcaaaatgcaatgaaaattttttgaggcaaatttttttagcgaatttcgaagtcatattaatcggcgaaaaggattgtcaagataacaaagtactagaacgttatagccgattacaaaaatttctaagtcctattacacaaaagttattgagacaagtatcgctggatagccaaaatagccctttgcctaatttgttctacttcttcaatagcttaggcatcttgagcatcagttctagagatgactttcagggacttggttaggtcagcaacattcttgatagccgattgagccttactttttgttcttcaattgattttgggagatcggctagctttttgtgttccatatctagctcggcattgcattcttcaagttgtgccaagagctcaatcttgcgagcttcgagccgatcaatattggatttgatcggaccttcagatagctgatcaagtgtggttttttcttcatgcacaagctgccgattagcttggattgtggcctcaatctctttgcgctcacggcgttcggctagtcttagcttggctttttccagcttgaactgatgttgctcgagataagcggctggagttaggacatcggccaaatcttcgagaatcagagcttgaacttcatgcagccgtgacctaattgatccacagtcaactaccaagttatctaaagaggaggcttctagccgatgagagatatcttcaagtgttcttctcacgtcatcatataggggagctagagctttgcttgaagtatcttcttctgcttcattaaggtaatccctgatgtcaaaagagaagagatcggctagaacctgcagagacaatttcagaaagagtaagagctgggtaaaatgtagccgatcagattgttgagacaaaggaaaacttactgggatagcaggagcaactggttgttcttcctcctcgatgtgatgactccccacagccgatggagtctggtcacttgacggttgctgtacaggaggagaagcaggaggaggctgtagaatagacaagtgttatatagagctggttgagtttgattaagtaaaagaattaaaaacattttactggtggagccgacttggcaatcgttgctgctggcttttcttcacagcagttttctttttctgcatccacaaagtctatcagtaattagccgaagagggaagtaattttagaagaagtcaaagagagatacttactcttgtaaaatgaacgggggcagaaggagttggaggcgtttgcttgggtgaagccgatggtgttttttctgtgtcactcatttcggctacagcctggtcaacatcttcaccaatttcctcttcatctaaagcttgttcaatagatggatccaaggcgggtagatcatcagccggcttatcagtcgacttagttttcttgaatttggcctttttctttggagctaaggccaaggtactcacggccgatgatctggtttttcttttcttgcctgcatcggctggttccctggttaggctgtgaaggagagttgaagtcttgggggcatggtagccgataacaggggagataatccacatccattcggaattagacctaaagcatattcgatgttcttgccattgttactttgatgagaggggaggactctgttgtctgcaaaacaggagcaaaagattagtcaagtaat

SEQ ID NO: 23803 - DNA, 2618 bp, Oryza sativa
ccgattgatgaaatagatgcagcttccattcaccccaccatctgtcaaagtttttgcttctaaatcctgccaactcaatattatcaatgctacccagagggggtcctggtaggttaagtagtcgatccatcattagagtggatgtgatttgtcctcggcactgaatcttgtcggcaaagaataagccgattgggagttggcccaatccaagttgtctggccgagctcattgggtgataaaactcgtaggagacttggatgtttctcccttgatgaatgccgacaggaaggatgcatgggctgattgcagctataagaacttctctggatttttggaatttttcatgattaatgtcttcaaatctaaagtctgatggaagttcaaggtctgctgagtcttcataaggaaaccagattcgtgcatctttcttaaaaccttcgtagaatctgcagaaccagtccttgagcagctcagccgatagcttcgctccagcatcggttggtgtggatgcatattctccatatgacatgcatctgcgatgggtgcgctcttctccgtcatcttccacaattggctctggcaatgggaattcagcttctattacagagggccgattgacaaccttcatgactatcaggtttaaccaagtttgcaacagccaccatggttcacctgctccaactattgagccgacggctattttagccgatgcattgttcaacatttggtacagatagccgagaaggatttggcccaaaggaaattctttctttgattctaaggcttcggctacaaactgccagttggttgtagggccacaactggatccacagaagaggaacttttccaaccacatgagcaagaaagctacatgctctcgaggagtaacagatccttggcccatatatgccgccacatagccagaccagccacctatacttttggtcttgaagtcaaattggttcttggtgttcatactcatagggttagccgatgaagttacatctaatctagtaatcatggtaatgccgattaaagttggagtcatcagcccttggttgaataagaaagcattgatggtgttggaccagaagtagatggcggcagtcatcagaggttcatccttagcagaattggctatggtgagagcaagcgcttggccgattccaatcttatcccagtgaactttcttactagccgatacgcattggtaccaggtgatccagctcttatcaggagtaggtttttcaagagatggccaagacttgaaggtattcttccagtgacccaggttagggttggctagtctaaaggggatccggttggtttcaccgatgatgaaatcagtggggtcgagattgccgattgggccaagaaaatagtggtttttgtgcgaaaggctgggaatcgcgactaggttggagagatgctacaaatccaaaacaaccgaggaaaagagagcgatataagataagagaaaatcgatctgctgctaagaaaggggatctagccgacgaagacttacctcagcgtactcagctgatggcgcatcagatgggttggtggaggacgacatcgctgcgggcggaaatctcgccgaagatgaagtcgcctggaattcgcttttgcatcggaggagtcgccggagagagagaggacaaagtttcgcttgagcggtgaaaacggaagtcacggtgtgagatttctcgagggtgatggttaatatttaaagcacggcagtaacggtcggaaaacagcaaagtgcgaaacttgcttggagtcgatttacagcaaatccgaaacattaccaaatattccggacttgggggccatgtgttaacaaccaaatttggtaacatcggcgtcaagaaagaagattagatcgaagcgaagtcggaggcggagatcgagttcgaaaacagagcaggaatcggctggagtccagatcggctacgattaggatcggctgggtctgagtcggactaggtaagccgatgtagccgattccgacaatgcaacttgatgtatgatatcgggttgaattgaggcatttcaaggtgattgccgcacatggatagagtcctgagaaggcaattgtatctattaattaggatgttttatgtaatctccttagagatacgcttgggcaaaagtctgccgcaaagacttatggtatcttagagtttgttagagatagtagtcgtgtccgttatggacatatcttgtaattctcgggtataaatagacccgagccctatgtaacttttaacacacacgttcaatacaatttcggtgcatcgccacccttttgctttagttttgtttcgacgagttcttgctttcgggttgagctgcatcggtttcgatcttcagcaagaggtaaaacttattatgacggcttgtattctcgggattagtgcttctatctttatgacactctaatcttgtttatgtaattcgtcgagttatcatatatcttacataatctctggcaatatcgctatctaatctacaatcggctaacatctatcgaagagggcagccgattaggttagattttgacgttgattcagattatataagatatctaccactctatgaaacttccagtggcttga

SEQ ID NO: 23804 - DNA, 755 bp, Oryza sativa
tcattgataaggttggaagttgtgttgtagtatatcttagcctcgctcccatgctcgcattgaacgtgttacatgcccttagagaaaaggaccgacctagccctatcgctactcgtgatggctcaggctactacatcctcatcgtcattcgctagtccaactcacgctgcaagtacatcctcatcatcattcgccagtccaactcacgctgcaagaagaagcctgtagctacgacaacgaatatgatgccaagggagaggactatctttaaacacctctagtcgacggatttggtctctctagcctagtcatctccccctccccctaaccatcatgaaaatgccagaggtggagctcgagctctaacttgacatggaggtcgtcgacgaggagcgaaggaagactgccatggtggaggagacgggctagcatgcgacagtaccaaagaccattttctacgataggagggtagtcatcttcgaggaagagaggtgggttggccaccaatctcattgcctagtgcccaccttttcgtcgttgaccgatgagagagagggaagagaggctaaatcaatcaaaaccatttggatagataaaataaatcgattttttataggtgagtaagtcttcatatccgatttaggttgagggaggaaaatcggagtcagggcatctgttgacagaaaacacgaggcctgggagatctgcttaactccagtgcaggtccaaagctcgccttcgggtgtgctagcgtg

SEQ ID NO: 23805 - DNA, 5432 bp, Oryza sativa
  unsure (1)..(5432): unsure at all n locations
tcttattagagctctgatgagctcccactgattgtattatttatttaatggaagcatactatcttatttttcataaacttgaatcacttaattttacttagtgaattagcatttaagtaataatagatgtcagaaatttctaagggtgaagtgtctcgatctcaatgagacgtccattctcccctagaaatgtggccgaataataaggccataatttcgacaacgtctcataataattcaacccaaaataatgccattaaatcaggacattaagcatgtccctatttcttgcaaagagcttacacaagaatatttcaagagtagcatacataggacatcgaggcaatttgaattccccttgcgaggaatatgagctttattatcattaaatttggaagttgcaacacttccccttagtgaagctccatctttgccatcaaatgcaagattaacaggatcttacttagtttgcctcttagtcttctatatttcttattgatttgcagaatgatgaaccaagtcaattatggtccactttgtcttagtattacaactctgaaaatgaccgtagtctaatgggagaagaatcatatgaaatggacaagtggcgcatttgaaatgtgcaatgtccatcccactaagtttgcacgccatgtgatttatttcttgtgctacctttaaattatggcggcaaatgtgcataggcactaaatttgtactaagcattagtcttgacaaacttctaaatttcatctcaacatttgctagacgcaatgtcatgctcaaaattctccccttaacactaacagggatgataatctcaatatttatgagtgacatgcgaaacatagcattatattggccttctcccaggctaaagatgcctcttgagtttaggaaaaattagtgacattagctgcgggagtcacaaggaatcctttgttaatgctaagtcatactcaaataggccttaggctcagttaagtcaatgaggaataataataataattccatagactttaactgataaataaaattaagtggcactattatttgtggttgcttgtgcaaattacgtacaatagtacactaacttacacaacaataacttaatctttatttcgctttgtatcaccattgggcagagacaaaacgaaggaatcaataaatgaaattacttataatccaaaatcaagtcaccgttgggcagaaatgattagggaataaacattaatgtcttaagtcacatcaccaaaaggtagaagtgataaagtaaataatttaaaatcccaaatcaaatcaccatacggtagaaatgattaggaaatgacgccattagtgatgccatagaattaaaattaaaatccttagccatataaccgttgggcagaaatggtaaaggaattaagcttactaatagattagatcctcgatcacatcaccgcaaggtagaagtgataaaaggaattaatgcactaatggcataaataaaattctaagtcatatcaccattaaggctaaaatgacagagaaaattaaaataatgattgacaatacttagatttcttcccttaattacatcaccgttgggcagaaataattaaggaaataacaatcttaatgaaatcatctttctttctagataaacttcccgttggttccatttatctagaaataatttactcggtattccaactaatcttaaataataagcattgataattgcatataattagtttactatggcttaatcaatcatatgcaaaataaacttagaatttcatagtcaaaacaccattggtcataaataattatgagtaatcttaaaattaattccttaattatatcaccatttggtagaaaataactaaggaaaaaaattataattgacatgcaattataataacgtgggttaaatatatcttcagaactttatggctttctagtcgaatttctcgttggttccattcgactataaataattaagttattaaggaaatgactatcataatgatgttgacatgaaatcataaatactttctagttaaatttccattcaactagaaataaattaattggcttaaggaaataataatcttaataaatattgacatgaaatcatattaatgttggtcaaatataatatcatatcattaatttctttctgagtgaccaaataattgatcataattttctagcaattttaaatggctaagaaagctcataaatgaatttatggaaataaataaaacattaaattcacgggcttaagattaaaattaataagagcccactcttattggtgaggccgtcccaaaacggaccggtccacttattgttgcgcggcgctgaggtggccgcagcccagatcggctcggcccattaacggcgacggcccgacgcgggagcgaggacggccgtcggatcaaacggacggccaagatttcgcccgcgccgaagaaatcgcgtgccaggggggaatgggtgtaaccctaaccctagctcattcttgtccccttctcttcccgattcggcgtccggcgagcgagtgagcgaatcggcggcgatgttgcgactgcggtccggcgagacggcacgcgcgtgcggcggcgagcgccgcagcggctccacctcagctggctggggggcgcgcccgagggcgacgccaagccgcgtgctacagcgtcggcggtccggcgaggcggcgcgctagcgacgggaagcgtctatgcggccggacctcgtcggcgccgggggggggggggcggagcacgaaggcagccgccaagccgacgcttcccatccccggtgagggacggtggagagacgagctccaaggcggcgcgcgcacggcggtcaaccggcgcggccctgaggaggccggagagctccggcaagcttagggggtctaaatccggtaattaacccgaactcaaaacctaattttgacttgaatttggatttaattcgggtatttgtgacttagggttcttcccccaaaaattagggttcctcatttggggattttaggccgattggatccggcttattggggattctgggaaatttcaatcttgtttattcccttttgcttaacagtggggaatttcaatctagtttataccctgttttccccaatttacttcttaatccactgttcttatatgataagaacctagggtttatgagttgggaacaatgagagtttcaatctggtttatctcactcgttctccgcttagtaaaatttgagagaaaaaaaaactctctctgattgaatttctccttcccttactgatttctagccgaagctatgatttacttaagcatgaaccctaattcgatctaattaacttaaatatgacataatgctcaacacaaagcaactttaagaactaataaacagaataaggggcttaacagattaatcatggcatcatgccgggcttaacagattagggttcatcacttcattggcacagtggcttcaatcagggatgatgggatcaagtggatcaagtagctaagattaggctctgataccacaatgttggaatttaatccaactaattaattgagtcttagcctaaacatgatcaccttctgcttatgcggaaattaatttatcactgacctgagatgaagccattgcttctcttctttcttcttcttttgtgagatacctcacgaaccccttccagtgtctaatcgatcgggcgattgatttagggtttagggttggagagagttaagtcgtcacccagcctccctcctctttctttatatagcgacactggtggggctcgggggtttatctcaatctaaaattcgaatctattttgtaccgatcacacaaaacagatttatctcttagtttgtttcttgtttcttgttaggataggaaaaccggtgggattttaaccttatcctaactaaccggcattagccgataaaatcaaccaacatttggaacctgtgttataggcccataacaatgtgctttgtcccatacatctcatgtagtcccacttcaaacccatgtacggccagcctatctaagggccaaatgcagattataaacaaccggacctctttttttcagcaaaaataaaagaatttgacgactcaatgccagacggatttttttttttttgaagttaaaagagagagctacagcactgatcacacctttagaagcaaaagctaggatagatttacgccctgctagctcagctaaaccaaaacgaggaaaaaggataatgaccgcaactaaacaacttacatggaacattcaaccattcaagcacatatatttctcatcatctaaaaaaacacataaattgcattatataaatttcatcaactccactacgatttgctcccatttaattgtaaccggcgttgaatactttctgaatgactacaagtataactggtagctatacgcgagatgacaagaaaaacgagagcaaagagtgcactgcattcgcggcgggccgcggggcgggcgtaccttaaattctccagccgtttccggcagcgacggggccagccaccgtctcaccgagacacggcggcgcgcgggcaccggggtcgatctccgccaactagctcgcgcgcgctctctgtctcagggtagctgagccgaggcaacggagcaaaccaaacagtcgccaggcgccagcaagcggggcaacacgcgcgcgcgggggtgggggggggggggggggcncnccntttgtggncttgngggnngctgggggncggggtggctgtntctgttgggcatgtgcgccgctgcccgcagttggttaagtaggcggggcgcggtggtggcattgtgttgcggcacgccgcctcctgtcgtttggacgtgtcgggctcgtcggcactcggcacgttggcttttgcagaggcctcggtgtcctgccttccttccgagggagggggccgaggaagcaatgggctccgagttccgaggggtggtggcgtaggcgtgtagccaagctaacccgaggctgagccccccacccgctctctgcactgcactttcggaagaaatatacagtaaaaaccatatagggccatgtttagatccctcataaaattttacaccctatcacattaaatatttgatacatatatagagtattaaataaataactaattacatagattgcgtgtaaattatgagacgaatcttttaatcctaattacgccatgatttgataatgtggtgctacaataaacatttgctaatgacggattaattaggcttaataaattcgtctcacggtttacaggcggattctgtaatttattttgttattagactacgtttaatactataaatgtgtgtccgtatacctgatgtgacacgccaaaactttacaccctggatctaaacacaccctttgttccatgggtgaaaag

SEQ ID NO: 23806 - DNA, 30121 bp, Oryza sativa
tatcaaatcatggcgcaattaggtttaaaagattcgtctcgcaatttatacgtaatctgtgtaattagtttttttttctatatttaatactccatacatgtatccaaaaattcgatatgatagggtgaaaagtttttacgtgaaaactaaacagagtctacgtaatgaaaacctgaaaactatcgttgaatcgaaaaaatagatgtatgagattcatcaaacatcattataagtaaaaaaaaaatattctccgtaaaacttttacttatgaataaacttatgagtaagatttttactcgtgaggatataaacgaatctcagatttatttttcaatccacttatagttccagatttatattacaccatatattttcctgcgctttcaccatatattaccatatattttcctgcgcttctactgttctatatgctgcttctgcttccttccgcccgggcttttgtcatctctgcggcccatgcagttgcagactgccacccgcgttatgccattgccttttggtttcacactacgcgagcgccgcgcactagctgcgtacaccgaaaaggcagctgcgtacaccaaatggctgccgagtttgtcgatcaatctagcccgtacaacttccaacgaacggccgcgggtcgattgttttactccatcaccatgcatgatgtttgcaaccatgacaacacagagatggctgatggcacgcatcggcgtacgaagatggtgtcaccgtagaagaaaagagattagtctgagggcggagacgacgaggctctgacacgtgtaggctacgtgccatgctcgcagtttaccggtccaactcaagctgaacagtacgattaatatgctagccgtgtgcctgtgtgaatccgatccgatatcctcattgcaagggagtctactgctttatctagacctgttgcctattgggtcacaatgtcacatgaagcaatcacgttcggcacgagctgcccactggcgcgcctcattgtcacttcgacgatttttagttctttctttatcgcagtttaacccagatcgattggacgacaaactgcgtaccgtcaaatactactgcctccagcttactgtatgaatcactcgactaatagaaaatacatacgtacggataaacaataggaaacacatgcatagatgatgtataaaaagtagcatacggcatttaagaaagcttcgtgatcaagcattcatttcccgttccgtgatgtttgaccaggcataccactcctgacaaatctttgggcatgcaggtgtgtctggatgagaagaaatgacaagactgatgactcccaaacaaaaaaatttctctgtcacattgaatacctagacacatgaaatattaaatatagataaaaaattaattacacggattatgtataaattgcgagacaaatcttttaatcctaattgcgctatgatttgataatatggtgctactgtaaacatttactaataatggattaattaggcttaataaattcgtctcgcggtttccatgtagaatcaattatttcaaatctaaaatatatatttaaagtgactttattatagaatttttttaaaacacacactatacattttgtagttcggaaagcatgcacgttaaaaaaaaaggactccctccccccccctcctcctccggcgttaggtctccttagaattggataaaatttctaaactagagaattaatcctttctaaactagagaattaatcctaaggataaaatagtatgaaccctttgggatggtgaaatattttaacacgtggtctcacctaatatatatttaaaaattcctttgagaaatttcaatgttacacccccttctctcaccgttcactctttaataaattaatataaaaatattatattttccaaacaagattctacgtaattcctatggttttaattgctgtagtgctcaattaataatgacatctcacttttacatttttcctattcctatatttcactgcgtttgtgttctaatagagcccttaagttcttttgctccttccggtcacaaatataaatataagcatttctaaagaaaatcaaataaatatatttttaaatatataataataaataatcaatttatcacactctaataacccacctcgtttcgcgtgccagaataagctgaccaatttcagccatctcgaacatagacttcaaatgagtacccgacgagtgaggtcatcaattacaggtgagtccattttgccttcctcaactgtagctccggtcttaatttcttcccttaactacaaaaccatatatgaggttcacttaactgacaaattggtttgtttttcctcgctaagtgattttatcctacgtggtgtctactgcctaggtggcacattaacatgttctccatctttccccgcaaaaaaaaaaacttgttctaaatattacgtggcgtcaatgtgttacgtggcattaaaaacaatgaactaaaatataaatattgcggccatatgtcatgatctcagcactcttcctcccctcttactattcttttctctaccctttctctatctatgctcatacaggccccgcattgttccctctccaacgtcgttaggtgactagggggcaagccacgccgcctttgatgcgcttgccatcccaccaccgaacccctgagccacttgctgtcaggtccttcccggcccccgagccaccaaccgaagaggagaaggagctccagaacgacatcgcaagatagacgttggccctgatatgctgtaccgcaacgacgaagatagagcgggtcgatcaaatcaacgccaaggaggcggctacgcacgtgtgtcgatgcaactcgagcagagattgtgttgggcccgaacccatcttggtcacacacgggtggaattgtaggcgagctccatcttgagcttatcccagacgagaggcaactttagcggcgacattaggggctttgtatggcctaagagagccgtgtgcgcatgtttagtaccatcttgctagtttagcactggtggtgtgtgtatgtgggcccgcccgtcggttgggctgggctgcgcggttctggagggagggctataacactttgtctacagatgacggtggagcctaggaggcgtgtccttgtcccaccatcacgtgcgccatcgcctcccttaccgcccattgccacatcaattttgataatttggcccttttactaaactagaccttgacaaatactataactagaaatagacttttacctctgtgtcataggccttggtgatgaggcccaacatcttagcgccaagcccattagcgctggcacctctgacattttaaaatgatgctagacccacctagaaaagcaagtgagtgtgatgcagtggtaagtggtatttgttttgccttgaagatcataattcgaatccccactgcagcatgatattttttatgggaggctgggaattccctaatggtgaaaaacacacacacacatacagagagagagagagagagagagtcacaacggtgaaactgaagacctggtgaggaaaaaagaagaataaacaagaaatggcgagtaaaaaaaaagaaaaccaaagaggtcacgagagtatgggtttcaaacccaaaaccttccggtttacaagggagaaatttaccactaggccaattaataaaatttgttaagggacaacctaacatctttttaatatacagtgctcaacgccaagacccatggtgctaaggtagatattcaattttggttatagttttttttcaagatctattataaaataagtattatgaaagggtcaaagtgtgaagttctcggccattgctgtctagggagcactgtcatccacctagtcaagcgcgtaattcacccaaggtcatcgatgccttggtagttggcagaggagagcttacggcaacatgttggtcactataaacctctcaagactaggatcgtgacctgagcgggttggtcgaccgcctcccccgccctcacaaggatgggcagatgagctcgagctcgaagaggctagccagtcaccattgttgggcaagctttagcttgagctcgttgatgtgtgtggaaagggaatgggggagaaaaagagaggggcacggacctataaggtccatatattgacttagccatttggactaggatgaactagccatgtcagctgaaaccactcgagagagagtcgatgtgcactcattttataatttggaggagcctctatgcactagtctcatagttgaattggacctttcccattgttgatgcagctcaactttttcgtgcctatatgtgggctgagtggcaccaagcttttaacccgagtaggattttgcgatggacacgatacgaaagaggcctagcagcgatccaattacactctcaccgtctcacggcccaatatcagaaaataaaataccgtgccgatttataattaaaattaaaaatatactgttcatttaatttttttctcatgaatattcaggatgcaaaaatttttacgtaaatgtaccattgatctcgtacaaacattgcgcaagaataatgtcgtggacggtattgcgcggcgaaaatgtgagaccgcgcggtctcgcattatgggagagcgagactaatcattattagttaattaggataattagtctctaattactattagttaattgtcaattaagtaattaagcactaatcaaatgaagccgttggaagatgtcgctgtttgatttcgcgagaccatatagtctcgctcttccattgcgcgcgaccacgcggtttcgcactttaatttcaacgcgcgataccgcccacgacgtcacacccacctcattttcgcataacggttgtgcgagatcgacggtatatttatgtaaaaaattttacattccgaatatttatgagaaaaaattgaatgaacagtatattttcaaatttaattatgccgatttattgttttgtatgaacggttgtgaatgaacagtctttaattcacctacgcggaaaagaaaacacaatctatatattcaacactagcctgatcggagcacagactgcggtgcatatcagaagttagaaattcacaggattttaagttcgattttctagtttagcaaatcggaggtttattccatcaacaactacaagcaccgcttggacctatattcctccccaatctgtgagtttgtgttcccctctctgtgtagcgaaacaggacacgaactcgatctgtctacaaatctcgcggctcctcgccgagcaggagctcccggacgatcttgtcgcccaacccgtcggcgcacatgaagaggtggccgccctcggggtgctcgtggtaccgtacccacgggagcttctccgccacgtagcgctgcgcctccacccgcacgatcttgtcctcgcgcccttgccagatgctgacgacgccgtccccgttggggaacgggttctcgatcgccgtcgggtcgaactcccacgccccgaacaggatcgtcgcgtcgcggcacagcgagtggtaggctccctgcttcgtcgccctcccctgaaacagtttacacgcacggcgagcccgtgtcaaagcgactctctgtttcgttttcatttaaggtttattctgcacgagtgcgtctttttttactcctaagttttagtatagttggtggacatgggatccggtgcaggtgcttaccctgtccaattggccagttctctgaatctcagctaggatctcccagtccttttcagtgaaagcctcgggcttcccctccacgatcggtgagatcctgaaccacttttgattgaaccaggcgtagaacagccaaggcatgtggtgcgcgatccagaacgtcctccggtccccgacgtccagcttgcggtacgcactggccgacacactggcgggcatcggccaccagtagttcaccgccggcacgaccagcgccacgccggccagcctgcaatcgtccaacctctcatcagatactgaaaaagaaaagaccgatcagatgaactgatgctgtgatgcatatgttttgacctgtaagggatgtagttgaggcagctccacgcaacgtagccgcccatggaagtcccaaccacatagaacttctccccgagctgcagcttgtcggcgagctcctcgacgtccgtggcgtcgctcttcagcccccgcttcgggttggcgtcgctgtcgccatacccagccctgtcgaagtacagcaggtaaatccccagctcctctgccagctcctgcagttaaattaaacagaggggatcaaggtataattcacaaccaagaactacatcgacgatcgcgcatgcaagtttagcagcagcagttgttacttgggacaccgggaagtcggattccttggtggaggcgaagccatgggagaaaatgatcttgtacttggcgatctccctgccgaccccggcttccctgtaggccaggtgccggccgtccttgagctggactctcggagaggagaccggtggccctcccggaccgcccaagatcggcggcggcggcggccgcgcgaccttgtacgcccagcccagcagcgccactgcagtgatcagcactaacttggagagcgcaaccatcgcgaattcctggtcgatctacgaacctgcagagatcgaaggcagtgaaattaaagaaacttagtataacgcaggtgacgccccgatgattagccggagtccgagcatgcttaacacggtgcaggcaacatcaacatttataccaggaaatcgtagagacggagcggttcttctcacaatctcatttgtcagttttactcgtcagtgtgcagcgtgaagtggtcacctctcgtggagtcgtggtcaggtttacatgtgaagtgtctatgtcgaacaccggcagtggatcagacgatcagtgaatggtacgataatgattgtaccgtggtgttctgccggggtgtagagttggtcgaactcgcgggatcgatcttgcagatcgcggctatgagatccacatatctacatcatcacccatatccatgtcaattgtacctgatgtctccaagactccacttgtacacgcggggactggtacgattgctacgaatggtggtaccggctggcaggctgaattggccgtaactgcgtttttttgtgtaaggtgcaactgccgagtccgttctggctgctgagctgtgtgctaccggggggagcaacaagaacagcgtgatgttgattttgtttgcagtccgatcgatctcgctcgatctgttcgtttgagacgacaggaggcactggcgtcttctgagaggattgttttactgtgctcctaattaacacatgattgttactgttcgaaatgatatcgcacaatgcacatccttagtccataaaagtattaggttggtacttgtccatgatttattgctgacttctcttgatggaagttagagtatatggattgcagagaaagtgtggacaggctaggcttaacaggcaatacaatcatggagctgggcagctggacttggccatataaagataagtagataacgacagatcaagaactcttgcccgggtcatcatacgaaactagaggaataaagattccatgagaaaaatcgctgttcatccgttccgataataggaatggaacaatgaagagggaaaagatgttcgttcagaaatgaagtgagagaagataggaaaagtctcgcgcgcatacttacagttttgagggaaaaaaagagcagcaagatgaacatccggtgaaacactatttttgtatatggttgaggcaaagtggccaaccagttcgtctccctcctcgctgtgctccgcctccgcacttctgccggccggctcgcctccccgatccccgctgctgaacctcgccgcgcttccgccgccacgctcgagctcgccccaggcggctgtggatctcatccatccatatatctcaagcaggacattttgccagccactgattggtccacttgtgtattctcagaaaaaaaacaacccgtccacttgtcagttgtcactgttagaattgaagataaatcttgaaattacaaacggtaaaaaagaaaatgaaaaaaaaaactccctgcactgcgctacttgcctactctcctctttctcgctatacgcacatacatcagtcattgaaatgtggactaaaatcaggttcttggtccttccaacggaatcaaggaaatacaattactcaagaaaaagataaaaatctagagctttccaacatatacctgataaaaaatcacacaggaatgtttagcttatattcatatggttatctaaatcgcttattagcaaataaaaaattattcatgagtaatttttttatatatgtatccttagagactcaaaagcaaatgatataaaataaattatatcaaattcaaaattaaattctaaaattcaaaatttggcttataaggataagtataagccaaacaataaggccgtaaaagaaccggtgaaaaggatctatctcaatgtaaaaatagatagggaaaatagaaacagatctgaacaggaaaaaaatattcctagataagaaaaacagaaacaagcggtgtatcgtagccgccacaaaattggagacaacgaagacggtagccatgacattttccggatcctttggaagctgttcattcaggggagcaagggtatcaagtcgtcgacgactagccgtgatggtttattagttcgtaaatgcggatgctggacgcatcaaccagccgatgaacaccaaggtcgagcatatccatgccgtccatagcaacaatggccacaagctcaagctcgacaaaatcgacaaaaagggagggagcaaggaggtctccagtaggatacctcaatggggaggttcgaggggcaacgtcgttgttgccgccatcatcttcctattgctctcgctggcatcgtcttcctcattggttattgtatcccttttttatgagctcagacatgcattatcggtagccatggctccaagacgccagatctaacagccttcaactctcaatggccacaagctccaacgacagcgacaaacaacaaagcacgatggaactagtgagctgtgatggtgacaaggcatcgagatccttccgccttttcttttcctttatatttccttttcaccctattaagctggtgatcaaataacaaagttgtttactgtttcgtagttcttacagtggatttccaatcttttcttttgaaaactataaagtcccaatccacagttaaaatattttatctataataagttgtgagagtaacctcacattcatagtgtgttagttttattacgtgatggattttatttgtttagctgattaaattcaacaatgttaggttttagcacaatttaaagtattatagacttagtacaatgtctctatatattgagataatcgagagagggaggtgtcaaagaaaaacggtgtcgccatggagcccaggacccacctagatatctgatagaaaaaacgatttagaaaatgcttctcttcatatattaacgagaaatcacattgaccaaataaaaaaaatctatgacgcttcacgtaccattatgtaattttttgaaaaaaaaaaggtctacgaaagggtacagaagtaagttgtagactttatataattcaaaccaaaaaaatagatcaaaatcatgattctaagatgcattcctaataagacatgtgttttctccaatgtgtgaccactccgggtccacaccagtcatgcgcaccatgcctgcgcaactgcgacacacgtgcctatgaaaccgcgagagtcgactctgataccattttgtaacgtcccgcctctccgaggccaggcccgcttatatctggtagcttttataggtcatagactgccctcacagaccaacacaagttttttcccatcccaaattgctccaggccaagcacgcttaacctcatagttctttggagatcaacaacaggcgcgctcgatcgagcatgaaaacaaataaaatgagagtgagaactaagcaaaaaaaaaaggtatgtgtgcaacaaaggtttaatggaaaaaaaaacaattatcatgaaattcatgcaaaactcctcggtaggaaagaaaaggatagaaagtaagtaaagggaagatgggagaaaaaaaagtaatgagagaaaacaaggtgatttgaataaaattagatttgtgtcttgatcatttttaggtatttttttatttgtttagctgattaaattcaacattgttaatttgttaacacaaataaaagtattataggcaatttgttaacacaaataaaagtattataggcttagtacaatgttcctatatattaagataattaagaggggaggtgtcaaagaaaaacggtgtcgccatgtagcccagaacccacctaggtatctgatagaacaaaatggtttagaaatgcttctattcatatattaacaagaaatcacattgaccaaataaagaatctatgacgcttcacgtaccattatgtactttctggagaaaaaagatttacaataaacaataaaattaaagggtatagaagtaagtaggaaaaaaaccaatatcaaaatcgtgattctaagatgtgttcctaataaaacatgtgttttctccaaacgatcacaggtgtgctcgactgagcatgaaaacaaagaaaatgagagtgagaactaagtataaaaaaaggagtgtatgcaacaaaggattgatggaacaaaaatacaattatcatgaaatttatgaaaaactcctcggtagaaaagaaaagggatagaaagtaaggaaagggaagatgggagaaaacaaaataatgagagaaaactaggggtttgaataaaagtagatttgtgtcttgattttacaccctatttcttagcacttacatatcatttttaggtatatgttagattttagttttcattttttaaaatattcatctgatcgaaactatgtattgctaatactcgatgttacacaggctaaatacccagcgtgccaacgtgcgcgctgattttctagtctattctatcagcaggccagcaatgtttggtatctaatgggcccgtcggaccacttatcggaggacttgacattgggccatatcacttactgggcaagattgggccgatcagcgtattgtccatgaaggctggagagaacgacgaaacggggctccaaaagcccgcatgtgctcataggtcgttatggccttatgggccttgccggaattagccaattaggccttacaattccaacgtccgacgtcgtctattagagacgttcagctcatctcatcatcccccaaaggcctaagcccccacgatccccatgccgccgtgcagcgcactcgtatattccacgcgacgcgagagactcgaccgagtccaacacgggcgctgcttttgaatcacctcgccactaactttctacggtttggtccaggtttaatgatggcgccaccgtttcaaaaggcgaccgatcgatccaaatcgctagctcgtccatgtacgctgcacgcgtatgcctacctacgcgcgcgcgcgcagctcgtgcatgcacccgccttgagcccttgacacgtcccagctcaagctcaagagctttgaacggttgatggttggcgcgcggcgtggtgttgtaacgaaccatgattttttttttctcccttccttcggtgcggtctggtcacccagactggcgcccatcggtcggtcgatcgcctttttgacggagtctcgcgcgcgggccacctgatcaagggcgtcgctcgttctactgggagtaaggtaaagttgcactctgccatgtcggcataagtatttttccggctcccgccgatcttgccgatcacgagggcgatcactgaatagagagagagagagagtagatcattgatagagcaagtttatagtatagccaactactggttacaaattatctatagtcaacttaatagctaattcatataatagttacctataaatatatactacacaatcaatatctggtcccaccagtcatacacacatgcgtcttggagttcgtgttacagctggctacaagtctgtagtccgcactcttatctcttctcttttatcttcttaaaatattgtacctgcttttagagggagtcatcatgaaatgagttggttcaaataacatggatttttttgttccttgctctcctccctcgcgatcgggaaaaatccacaacgaccgcttgtttttggcttttcggcggcagcagcagcagcactgcgttgccccgcgtatggcagtgtatagcattctggcgtatagtgggaagtggatttttgttccaaagagacattctcttgttttgtgcatcttgtgtaaaaacttttgagctcttcttgcgtgtgtacactaaataacaaaaagaaaaattaatcagaaaataaatccaaaacagaacggcaaaaagaaataaaaaaactggacaccgctgccgccgtaggtgcaccggacaaagacacacgaacaattctatcgggtaaaaaaataacaaatttaattgtaaatatacatatattaatttaaattttgtttgtaatttttgttacaatctgtaaaagttgaattttaacttgtatatttgtggattgatacattacatattgatctatcttatttatattttttcataacatgtaaccaacggtggacatccactcgagttaaaatagtttccccaattctatcctctgtctccctgattccctacccggtgtactgcacttggccaaccgatcagccctgcagtcgcgacgacgctcctgcagccgcgcggcacgcgtgggccgccgatgcaaggtccgaaaccaggctagctaggtacgccgcacgcagcagccaccagcacgtacgccacaaatagcaccagcagccagcgatcctcagcgaagaagggccacgcagctagcaagcgcgaacatattcacactctcacgcgctatcccatgatcccaattcccaaccctggcggcggatttgcccaatttggctcgtgtgtgaaagcctccaaaagaacaaaaaaaccatcaagaagcggccttgcatatactacgtactaagagacatacacccaaaggcatataaatggcccccagctcccagccagccatttcagtttcttcaagaccgtgacacatgcactccttgacattaggctatatacacatttcttctagttcttcctccccctcctcatctcccatcttccccacgccaccaaaccccgagaacaagaaagctatataccatctctcatgcgagtaaataattaagtgagagctctctgtgtgcgtataagtagagatcgatcggtataatcgaggactacatgaggatggggctgcggacctgcagcgccatggaaggtgaggtcgtcgccgcctcgcctttcttcgagtggctcaagccaccgccgcggccggcgtcatcctcgtcgtggtcgtcgtctttctcctcgtcgtcctcgatggcttccagggatcaagaaacagtagtacctggtgaagatggcggaggtgaaattcaagaagatcataagagcggtatgacttgtttgccgctgctcagcatgctcgaggaggggaattcgaagaggcatgagcaccctgtgaaagaagagatcatgagcagtgcacacgcagccggggtagtggagcctggcgtggagttgaatatcggcttgccggttacaggatctagcgctcaggaggtcaccatggaggaggacgatgaggaggaggatgacgacgacgtaggggaggaggagatggacgagtggaagcctatgcatggcggttgcaaggtggagggggatgaagagcagtacggcgaggcggtggcgtcggtggaagggtcgagcagcatcaccgccgtgggggatatgttcggcggggtcggggcggagagcggcgtggcgatgagcagccggtattggatcccgacgccggcgcagatcctcgtcggcccggtgcagttcatctgccatgtctgtaacaaaaccttcaacagatacaacaacatgcaggtactacatgacgtccttgatctttgtcagctagcttccattttgatttttacctagtacatcccatgttttcataaattttgaaattcttatatgctcatctttggaaaaggaaatcccccgcagataaatctagttttagaaaatatattttcaactgtgagtctgtgaccgacacggacatcacaaactcacaaactgaatctacaggtggtgtgactgcctgaagtgttacgtatctgagaatgtacaaaacacacaattatttcgtatacaaatccccacaatgagatattctcgtgcttcggcgctaataagtgatcgaacactaacacacactatataaccacttcattcgtttcttcaattattcagaacacatactccaattatcgtatagctctctgatcgatcgtacgttgcaatattaattgatgatgtggggatgatgatgatgcagatgcacatgtgggggcacgggcgggagtaccgcaagggcccggagtcgctcaaggggacgcagacactggcgatgctgaagctgccgtgctactgctgcgcggcggggtgcaagaacaacgtcgcccacccgagggcgcggccgctcaaggacttccgcaccctgcagacgcactacaagcgcaagcacggcgccaagcccttccgctgccgccgctgcgccaagcccttcgccgtcaagggcgactggcgcacgcacgagaagaactgcggcaagcgctggttctgcgcctgcggctccgacttcaagcacaagcgctccctcaacgaccacgtccgctccttcggtgcccaccacctccccgtcgccgaatccgccgccgccgccgccaccacccccgccgacaaagaccgcatcataagcttccaacggtgagaaatatcgatcggtcgaggtcgacgatgatcgatcatgatgtgtaggctgcagttacctggttcgttactaagtctatgtatacgtgagcactgctgctcgcgtatatatctacttagtaagttaaccatgcaattgtccagcatatagacaacaagttaatcaaactatagctactagctagagagtaatgtatgctgatatgtgcatgcatccgtggggatttaggaggaaatttaagcagactattagcacacaataattaaggtggctttcagccggtgccgatcgaaagctgtgagcctgtgaagtagatgaattttcttctgccagagtgtgagctgtttagtgaggctatgtccccagctttgtatcggagaaaatttctcagcttcacaggctaattaaacaggtaatttggaacctattttaatttacatgcatttattaaacgattattgatcaatgagagagctgattaattcttaacttatatcgatcggatactgcttaatttaccatcatatatctgtgtagttcttgattaattacccttttcccccatgaagtaatcttttttttattaattatgcatgcatgcactacaattttttttatcatcagtatatatataattttgttttcttgaaatctgcctgtttcaaaatttatagaagagcaagtagaatcatggagttctgataagatgactgaaataatgctatatgttgaagtcatttctgtggttttccatgcatgatcgaaattcttgggtcgatcatacatctgcaggggaattctccttttgataggagaaatagtgaataattatgttcatatatccatgtgagaccgatatataatggttcaagttacataccagtactgattattagcaactttaaataagctcccacattaatcggagaattagcgaataaattggctataaatccaagtgggagcaagataatatatatataatggctaagattaaaataagagcaagttgttagttagatttttcataaattttaaatcatgacaatactatagtgaaggctccaaaccatgtataactttgtaatatcaactcctaatccccaaactgttaaatgaaaacctaaaattaagactccatgggaatcgcaaatttttatttattaattgaaaaactttaaattattaaattaaaaaactttaaattattaaattaagaaaatataaagaaactgaaatgttattaggtagattctacatgatctttttgtaagatctatgtttcaatttaacctatgaccattaattaagttagattattttatttttatgtaaatacaataaagttcacgtataacctataccggaatttcgatggagattattagaccgttttggaatgatacacatgttacgaaccagttgtaaataaaccatgcattaggcagaaaattttgccagttagcaatacccatgtataaaattgtccgagtacaattttttctttactgagaatagagtgtttatattaaccctgatggactaaaaaggttaatttagattgtcacccttagcaactgcttcatgccacctgcagctagcatatgacaaccccggggaatgatttttgcaggtaggagtaactgttcgtctgcaatctaaagaaaatcaattacgtagtactccctccgtcctatataatataaaggattctgaaataatgtgacatatatattctagtactataaatttggacagagagtattaggatgtgtcacattcttcatatataatatcttatattttgggatagaggaaatagtggatacgagtggttgctagctctgtttaatctctaaagcaactcctgctaattgccacaggcgatatatgtaggtttgcagttagacacctaactaatttcgactcctacgactctactagttgatcacttgagtcaggctagctataggatagcatgcgacgtggaggatgctatgcaaattttggcatgggttgtgtttagatttaaactttggatccaaacttttaactttttctattatatcaatctatcatacacataacttttcagtcaaatcgtaccaattttaacctaaacttttaattttgaaagaaattaaacatagccctggtatgtggtgcaccgtgcacgccttatatggcgtttgctagcgccatagccgtagctagcaaaaatttcaacattcttcgcggaggcatatgtggcgaagtcaaacttagaaaacgacggattcacgcgcagctagatactagctagccaccgatcgcgtcatcagacacggccaaaaatcaaaaggctaatctggactcaagtgcggcgcggtgcacctagattaagcgtaaacgcgcgcggagacacccaccaacccggactaattattatgagggctgctaccccacgggattccgttgcttctagcagtcacgggataactaaaaatcccgagagatttaataagcaccatcaatttcgtggggaagcccacactatcctgcgattccaccttatccaatcctccctggtaccttgggtaaggtaccgaggtggtacctagtacactgatatcagctggtaccccggtatcgactaatacctggtacctgggtatcgattgatacctggtaccatgggtattgagctgatacctaggtatcaggccttggtacctgggtatcgactgatacctggtaccctgggtatcgagctgatacctaggtatcaggccttggtacctgggtatcagtgtaatatccaaagagagaggaggaggaggagtcgcgggtcagggaggttgagcagcggggcggcgacggaggaagaggaagaggaggcaatatatctggtgcctaccttgtgccattccgtcgctcgtcgtcgtgcctcgctccaaaccgccgaacccgtggctccatcgacgccacctagagcagctcctcgtcgctcatgttgtgccaagcgctcgcccccggtggccgcgtcccccactccctgaccgtaggaggcgccagcgccgccgaggaggagcagggcggcagcggcgaggaagccaatgacaagaacgacaaagaggaggagcggcttgaggagcttgatggggaggcttctcggctgtcgtcgcccgtggtggtcgggagccccgctggctgtcgtccaggtcgtccgcgggggttggtggtgacgacaccgtcgtcgtcgtcgccatcgttgccaccgccgtcgtcgccgtcgccgtctccgtgctcatgggtggcagtcacagagagagagatcgagtggaggggaagagacagagacagagagagagagagcgagtggaggggaagcgacactgagagaggggaagaggagataaggcagtactactatcccgtctctacgggatgccgttaggtagtttttttgaattattatggcaagaatatatatattggctttatcgagctaagagcccaggtgctttccctcgtccacatttctaaaggcttctgcgtgggggtaattaacgacgacgtaataacgagctttttatttttggatcgaccagttagtccaactttgtggctcccctggaccgcaaccagctggtcacacacacgcagcgatgtggagcagcttgtatcgtctccagccttcacttggagtctttgtgtgagtgcgatggtaagcacggaaaaggaattttggatcgtgtaattaaatggtttctgtgtagtatctgtgttagtgcgctaccttgaccacgtgaaaacaatgtgatcgagtaaaactactagtccatgtgcatgcatgtttaccagagtctcatcatgtatacgcccgggcagtatgttagcaaaatgaaaaaggaaatggcttaatatatatacttacgccgtatgcataacactcacgcatgatcgatgtacagtaatcctccatgctgtatctactgcctcgtcatgggtctgaacatgtaccgacgacgacgatgggtcgggggaatgtcaaaaaggggaagcgcgcgttggcaaaggtatcgtgaactcgcgatcggtcgatcgagcaacaggcggccggggccgggggaaggtgaccggtggtccggtgcaacgcatatgcctcccctcgcgttaattctttcctgcctcgcgcatatataccgtacgtgctacatggggagaatataagggcctgtttagttgtggtgaaataaaacttttttgtgtcacatcgggtgtttgaccggatgtcaaaagaggttttcggatacaaatgaaaaaaaaactaatttcataactcgcctgaaaaccgcgagacgaatcttttgagcctaattaaatcgtcattagcatatgtgggttaatgtaacacttatggctaatcatagactaattagactcaaaagattcgtctcgtgattttaatgtagattgttcaattaatttttttatctatatttaatatgctccacacatatgtgaagagattcgatgtgatgtttttgtgaaaagtttttgggactaaacagagccttaagaagaacccgctgcgcaccaccaaagtggtacagtgatcaatcgatttaacccattaagcattattaacccaccacgagcgcttgtcggttaaataatcggccgcccatgaatgatccccatttcggccgcccggccgaccgcgcgccggccaatcggaccaaggaaatcacgcgtgcacgtggcaccagcagccacagcggcgcgagatgcgggtacgatatacgtacgcatgcgtgaccgcgcgacgactgatgggaacgcgtagtaacgtacagtgcggctggggctaattttagctagctagctctgacgtgcggttcacttgtttgtttgcgattgtgtcccgcaagcgatatgtatagtgctcgatcgagcgaattgattaaggccaggtgtacacgagatcctagctacaagtagtaatttggattttggattttaatcatgcgtagcaaattagggacgaaatctctctctcgacagcgcatgcagcagagcagcagcagttatacaaggatgcatgttcacatggacaaacgcggtttaccgtacgttgcatgtacacgtgttggatctgatcaacgtcatggtcacacgtaggaaacgaataaccgatcggtgctatatatacgtgcagcagcggggccatatatacgtgcacgatgtgcactgacatatgcatgtgtgaatatgtgatcagatttcgtgcgtactgctagttgcatatttcatctcgttcacggtcaccgagtctcaggggatcatgattatagacgccggatgagaacgactttaaccagaagactattgagacaagggccaaaagcgagtaggggtctcgttttgtttcacacattgtcaggagctctctgcagacatgttgtccaaaatctttcatgcaccttccaatctccttttcaacatcggcaagtttaaggccatagttcgattctcatgcattttcctgtctctacattctgctatttgcggcagcaaagccaaataatgcatcatgcatgcatatttctacccatgctgtacttgccctgttgcccaacgggacaatatattgctcgaaccaactaatcacgtacaaataccgattaattaaccataatattcatcataatcagcaatgttttatgcaaagcaaaacccctctaccttggggacgatataggtgcagatgctggtgcaatctcaagatgacaagttcatttttaaaaccgttctaatctgcatgctctcgtcacaatacgtactagtataaaattccagacaagataaacttagcaatccaatgaagattgcagctgccgaccggtagaaccaaattatcctttacagtaaaataatccacaaacataatcagtgttatcctggctgagtatggtttgggatatagacgtatgtgatttctgttgagattatgggcatataatgatttaatttattccataaataaatcatgacattacatatgaaaactagcatgaacgcatcattagatctacacatgtaaactacgcagaataacatgaacagatcaaatatgcgtaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatcagcaaaacaaaactgcaaaaggaggctgcatctgcgcaagggtgaggagccaatttttcggaccattcgacgcgtacgtcgtgcacgcgcgccgcccgccctgccgccctgccaggcgaggcgagcgagtgcgcgcgtgtgtttcccctcttctctccaccacacatgcttcaagtggctaggagggcatcctcccttttaaggaggtccccatctcctagaataagcaaggtggtactaaactccacatgcatgtcatcccatgaggtgggcttttgtgattttccaaagaattaatcttcgagtgggctaaggcccattcattaattccaacaatttcatagcatgcccgcggcaggtatgcaaggaaatgttgagcaaaacaatattagacaatgtgcgacaatcacatcaggcagattactgaatttgacgacctgttaatttattttgagcctgcatgcgcccatagctcgaccactagatgcactcagaaaagcggtcctcaaaatctcaagaaaggaataaagctgtgtcggtttgacatctaatttggtcctcgtacagcttacctgacggaaataatctacgccgtccttctcaaaataatataagtatttttagacttcagcataatttttgagatactactttaaccaataatatttataaaattaagatattttaaataaaaaaagttgcatgttagaatagtttgtttaataataaatctagtgacatcaattttacatgattgatttttttttttgttattaatagccaacgtttaaagtatttgacttggcactattctaaaaatgcttatattttgggacaaggagtacttatctgttttaatatataagaaaatttgattgaatgcgatatattctaatactacgaatgtagacatgctccttgcattgtctaaattcatagtactgaagatgtgtcttatctaaccaaaatatcttatatttggggtggagggagtagaagaactgatgcctacttccatctatccacaataggtttatcttgcaccctcttatttatcctaaaataaattcatttagcaatcattcaatcaaagtttataaaattaaagaacagttatcttagaactaaataaagtgaataattatactagaatatgataaagcggtagtgtattttagttgttttatattttattagtatgtatgagataaataaagaataaatttattttatgatatatggagtatatatttcgttttcagtatcagttgagcttattacaacatcacttttacacagacttgctaggaccctaggggtatataactttgatataagacagatgatactgtcaatttatgctgcatgtgccctctgtcgacgagtgatactcgcggaccagaagaatagggtattggggtacgttagaacaggatctacgtagtacgacatcaaaacagacaaaagacaatgattacactggttcaagccccttatcagataatagtcctagtccagtttatatgggattgatgatgatgagaacagattacaaagagagtaaccgaacagacaataccgatgagatcgtagtcgagggactcgacaagatctcccggcgagttggctccgtggactccggcttcgtaaactttggtgggtgtgttggcgatgaggtgcgatgccttttgcccctccctaggggtcccttttataccgtgggataccttgacccttaagtaaaacttggagatatgtaaaccgacacgatatactatagattttaccctttccgagtaggacttttgcaattccttaacttcgtggagatattttccctaatttgaggtgaattcctaacggtgtatacagaaaccaaccgtatacgtgaaggtataccttatcggtatattccataagtcgtaggatagagggtatgccttatctgtaaccctgacaccctccatcccaaaacaaactaatcttatactagaatgtgatatatcttagtacaaagtataacaaattgaaacatattttatatcagatttattgtattaggatgttgatttattttgagatagagcgatggagtacttaactttctcctgtcaaccaccgtgttgaaggtagtactatacagtattctttcactgatcagtcaaagtctccattaaaaacgacaatacatagctgtctgaatgcattgggttatctgtactttatgtaattgactgcagaggaggtggttccgagttccgaccttccggcgtagtggcgacaaacaatggacttccagtgagcttgcatcagaacatagtcacgctggcgaagcacgcacaaactcgttcgatagctgcacgtacgtctcacactgtcagacacacacacacacacactttcaatctttcatggctctgattacattcaaacagtcaaactctgcctttggacaagtagagtcttcaggatggaccatattaaaaagttaatcaacgaagaaaaaatcgtatgcaactatgcattgaacaggaaaaatacaatagatgacagcaggtcaatggtagtaactgggtgaacatatgtgtaggagttcaacttggttgaaccctgtaattttttttctctttctgagaattttcggttgccgtctactcttctgagttatgggtggtaaatatcacaatcagccatttagctcccaagtcaaattaaccacctaccacaaaataaccactactggtatacactcgaaacagcaccttaactggttgacactgagtctgtgacatttgtctgtctctttcattctctgaataataaaataagctcggcgtccatggcatcatgacatgctcagctcagttgctacgagtcactagtcacactgctggctctaaggttgggttctagatttattgattttgtctctgtactcactgattctggtttagcccggttgttggagggaggctgtaattctacactcggacctttactgggctgtgttgtcatcgtttcaataggctgaatcttcaccggactctttttaggaactgaagcccatcttcatactactccaatagtccaatctgctcagctgcggagttcagacttcagactacagccataaactggcaatctgtacctgacatacgcactccaatgtcacagcagcactagcagcaacaaagcatgatgcaccacgaagccggcaaggactggtggaaggctgggagcatcagtgagctccaaaacatgactaggctgtcaaatcactttattaggatacaccgattagtggcagaagttgcaaaagttccttgtcaggcaagcgataagcagcttttaggtactgattcgagtattcttttaatgctaactgcagtagcacgggcgcgtcctttgaatcaatcctggtaatagtagtaggttcatggtgtaaaacacatatggctgtgttcgctatgggttgttcccagtagcacggaaaatagagcgatctattagcacgtgatcaattaagtattagctaattttttaaaaaaaaatggattaatttgatttttttaagcaactttcgtataaaaactttttaaaaaaactcaccgtttagcagtttgaaaagcgtgcgtgcagaaaacgaggaatataggttgggaaaatggacgcccgtacacagccatatgcgtggtcgtcgttccaagtttcaaccaaagtacatagtggtaaagaacaggtaataggaccatctatctactcagaccccagtacagtggtaatattactcatttactctattgattgtactgtagtaacagctaacaagtggtctcacatgtggactatacatgtactacttgcatctcaaatgctcaccatggagctggaagaaactcaatatgacatgaatcaaagtctcaaagggtgtctactgtggcgtgcctaatctaggtataggcatgtaacaagttgaggcatgcaatcaaacacatatttcatactgagatcaaaacacaagattcagattgtaatgtatataggcaaatcctcctactcctttcgaatggttatatgaaaaggaaactttcaagtgatatttgtcgaaaattaagcaatacaagcaaagagcatccggatcatcctgaccaagtgcaaccattaacaatttagcatatgattcatcgaaatggatagccatttcaaagtaggagtatactatatcaggatcattttgtgtatggatcccgagttcataaaagaacctccccatttcaagagagtagcccctcagtatcagtacacgctagcacttcgatcactataatagggacgattatttgagtcaatcactaggcgggatcggaaagatacaaacagaagagtccttaagacaaggataaatgtcaaaagtgatataaagttgttataatttgtagtacttagtacttttagtttaaaataagctccagcacactcaatatcatgccgggagtttccttaaacttaataaaccaccgcgtgatgtatagcggatcagcagatgtgtattccctccgttctataaaaaaaaaccaaactagtaccggatgtgacacattctaatacaacgaatctggatctagaatatgttacatcctgtactaaattcgaaaaccaatctagtaccggatgtgacacatcctagtacaacgaatctggatctagaatatattacatccaatactaaattcgtttttttcatgacggagggagtaacacggtggaccaaatcatcaatcgcttactccgtatttcacacattgatctggattaaataacaacggtgaagtggttactcccataatgtatcctcatcatgatgtgtgaaggtacatgaggtgcggaactggcgcatccacgaacatggtggattcacttcaaagaaacaaggagaatattgttgtcagatcaaatcatggccggccatgagatcgtttagttacagtgggaaaacatcgagtatactagggaggttttgggatttagggactaaactttagtccctctcacaaaagtataagtccctccctagagacttacggtatgtttttgagatctctcccaaacatcccctataaagtacacaaatacaaatcctctagattcactgttaagtttgtagtgttgctccctgaaatatcaaagcatctttttctcagcacaggtaatacattaaagtcatagtagtgcgttcaccgcaaagaatttataaaaatgaaatgaacatagtactacaaaacataggagtggcaactggcaacacatacatgcacaaaccaacctagtgcaaagcttcgagccttcggttagcaatcggattagagaggtagaagaagtgcattggcagggaaggacttgcacaagttattttccgaggtgaaatgagcagtcaaattggaatttggaaggtacacagatgacacaatgcaaagctaaagttgtatttgccatttgggaaacatggagagcaaagttgcagcaaggctgtatagaagatgtacaattgattcttcatgaaattacgaagaaagatcagtctaaattacagttacagtgccaaaagcggaagaaatcgtcctcgtatgctaatggagggatcctaatgcttagtacacacctccaatcccaccatcatatcaaaatttcgctactatttcaattcgtctatcaatctaatcacaaaaaataacccaccttacgaagcaacattttacactgagccactaatacaacacaatcctccaccggaaaaaagtggcataacgtcgagcaccttgcgcgcacgcgctctaatggtagaacacgacgggcgggacggcgataccggcgtcgttgaggaaggggactacctccggccggtcggcgaggtcgcggtagaaggcgtactccgccttgtagtcgtggaggtccagctccgccttctggttgctgtggtaatggtgcttcgcgtcggccgccttcccgaacccgaacacgctcaccctgtcgcacactcccacggcgaccatgatggcctgcatccccgacgagtagtggaacatggccgcgtcgcgcgtgctgctccactcctcggccgcgcgccccgtctcggcgacgaagcggcggagcgagtagtacttgacgatgcgcgcgcagaggacgtcgaggcgtggatcggtgacggagatggatgcggcgtggagggagcgggaggaggcgttgcaggaggcgacgtcgaggaagtgcgcggcctggcagatgtagagcaggatggggacgccgtcgccgtaggggtggcagaagcagttgggacggcgggcgcagagatggaggacgttgctgttgatgaaggagaggttggtcttggcgccgacgttggcggcgaagccggagatgcgggcgttgttgaggcggaagacggcggcgtgggagtcgatgagggcgccgtggctggcgccgaggaggatgccgctgttgcccacgacggcgcaggaggggatgcggccggggagggagaggagggaagggagattgcggaggacgccggggtcgtgccggcggaggcggtgccaggagcggagcgcgcggcggagggatgggtcgaggtggagctcctggcgcgggagcgggtggaggagggggtcgtggtcgtgatccgggtggtggccgcgccggtagacggggaactggtggtggcggaggtgaaggtggagcctgtcgccccggaggcgccacgcgcgggcgcgcgcggacgacgccgggaggcggccctcgaggaggtcgtccacgtcgcggcgcagcggcgcctccgatggatcggccgcggcaaggcggaggagcgtggcgttgaggcgcgcgggatcaagcggcggcagcggcgcgagcacgggagccgggcccaccgacctgcgcaacacggaggggaacgaggccgcggcgcacagcacgacgaagaggagcaccgcgaacgggcgccgcagcggccgcttcatcgccgccgccgccgccgcagcatccgccgccgcgggctaagtgggtcggggccgccgcatggggggcggcgcatcagggagagagacacagggagggttgtgttccgttccgtgccgtgcgagctgagctccgagtgccgcgcggtgtggggcgacgagttttttatcggacgcgatgcgttccggttcgcgaggtggtactaaaatagggagcgtgatatgtttgcagtttgcggttggttggaccttgggttcgggggaacgggggatccaatgtgctctggttgggttcgtgcattggagggagtatataatgattctctgcagggaacagggctgcgggcgtgggtcccacaacaagcctgtacgcatgacaggtggggccgtcggtatgagttgctaagcttggcgtggccacgtggtgtccagcgtagcgttcgatgtgtgtgattcatgcagaaacgcaatgaactctgtacctcgcgccacatgacgctttttatgattgttatacggcctcctcggagtattaacaacctgcatccagtgttttacgtgtgcaagctacacgttcaaaaaaactagtactactagtagtagcgtatgttttcggcgtgtaagctatgacaaaaacagagaaatttcgttgtgttttacgtgtctgtatagtagaatttaaactcgtcgcaatcgattcattgaattctttccaactcagccagcctaggccggtagacttggggtcaactttggccggaaccaatccgcctcggttaatccacgccctgatgttgccgcccccagccgtcctggtcttggtcttgtcttgtttatcaaacatcagaggttcagaagcgttcaaccctctcaggccgtacctttgttaatcttatattagcgataataaccaccgctgtaggttacagagatcggcgcaggtggatggatagatatgctcctattctattacaacaaactcaatctagccttatctaatcatatctatccatctaaccatgccgtgtgcatcacacaaatacatatcacatgtttaacaccctccctcaatcataactttcctaagttaagattgtacttaaaattctccaactgtcgaactgacaaagcctttgtaaaaccatctgcaacttgatctcctgtaggcacaaaatcaatttctaacaatttccttgaaactctttctcgaacaaaatgataatcaacctctatgtgtttagttctggcatgaaacacaggattagcagaaagatacttagctcctaaattatcacaccacaactttgccatagatggactctcaacttgcaattctgccaataaagtctgtacccacataatctctgctgtagcattagccaaagctttatattctgactctgtactagatctagaaacagtagcttgtttccgtgcactccatgacacaagattatctcctaagaatactgcaaaacctcctgtacatctcctgtcatctagggcaaccagcccaatctgcatctgaacaagcacttactaacatag

SEQ ID NO: 23807 - DNA, 2658 bp, Oryza sativa
taaagccataaactctgcatccatagcttttttccaattattatcttttaaagcgtcatctaaattttctggctctccagtaacagtgagaaaagtagtcctatatttaactgtaccatcagtataaactttttccttacgaataatgccactttgcaacctcgtagccggtctagatattacctggtgctgttgttgctgtgtatctacctcccctgcaacagaagcatcaagagacgtggatggctcctgtgagtcagaggaagcagtaggagacgtggcatctggagattgcatggccacgggtgagtgcgccggtgtgagctcgacatgcaaccgatcaggagagcaggaggactctacggtggcctccacacgacgctggaggacgctcgaagacgctgcgtcagaggtgtgaggggagtcagccgctggatctttcgtggcagctgtggctgcgtccgcaccatctggagctgcattatttgctgccaaattttcctgtagcgataattcatctccagaaatttgattagcaggattagtaggaacattagccacagtggtactcatttgttgcaccccaggaataataggaatatcaagatgggatggcaataataaaatttcagaacgcaattttgcaccggcattgggatgaagtgaggcaaagggaaaaacattctcataaaaaattacatcacgggatatgtaaacgcgaccggtggaaggatctagacatttgaaccccttatgaaggggactgtaacctagaaaggtacattgtttggaacggaattgtaatttgcgagcattatatggtcggagatgaggccaacatgcacacccaaatacacaaagaatattatagtcaggagtttgtttaaacagacgttccaaaggcgttgcatatttcaagagtctgctaggagtacgattaatgagataaacagcagaagtaaaagcctcatcccaaaactttaatggcatagatgagtaagcaagaagagcaagacccatttctacaatatgcctatgttttctttcagctgagccattttgctggtgtgtgtgaggacaagacacatgatgagtaatacctattttggtaaagaaggaattaagtttctcatattctcctccccagtcagattgcatcgctaggatttttctgttaaacaatcgttcaacaagagcctgaaactcatggaacttttggataacttcagatttaaacttaattaaataaatccaagtaaacttgctgaaatcatcaataaaactcacataatactgtttgcctccaacagaagtgggggcaggaccccaaacatcagaataaataagttccaaaggatgactagatatactagatgatatagaataaggcaattgatgactctttgccttttgacaagcatcacacacagactgtttattagactcaactaaacatgggagattatttttgctaatgaccttctctacaattggagaggagggatgaccgagacgactgtgccacctttcaaaagatggcttggagactccataaacttctttggttgagtgtgcatgtggcggtgtagatggaagagcatagagacgaccacggcagggccccctaagcagaagtttcttcgtggctagatccttaagattgaaatatttagaatatagttccataaaggcagaattatcagaaacaagacgttgagcagaaactaaatttttgttagccttaggaacatgtaaaatattgcgtaaatgaatatcacgactgggggttttaacaatagagtgaccaatatggctaatttccatacctgcaccgctagcggtatgcacttgatcatgtcctttgtagcgatcacgaacgatgagcttctccaactctcctgtcacgtgatcagttgccccagtatccacataccagttggtatcgataccataggaggtggctgcagaacctgcatacttctcatctggaacaaaatcctcatcataacgataccaacagttgattaccgtatgtcctcgcttgtaacatagctggcacttgggcctagtgtcgacgccacctccttgacgtcctccattgaagccgccattcccgcgaccacccttgccgcggtttgcgctgttgttgcctccattgccgccgcgtccacggttgttcccaccgcgtccgcgttggcctccgttgccgccggtggtgccgcgccctcgattcgccaggtttgctgacgactcgccgccgtgacggagattgttgcgctgctcaaagctgagcagttgagagaaagcctccccgaaggacatcggctcagatttgccgacgattgaggagatcaccggttcatacgtgtcgtcgaggccggcaatgatgtaggagatgagatcttcgtcgtcgacgaccttgccagccgccgtcatgtcatcaccaagtgctctcatcttggcgacatattctgtgatggagagatcgccctttttggtgttggagagagcgatccgagtgttgatgaagcgtgcccttgtcatggaggtatacatctcctccagcatgctccaggcggcagctgcagtgccgcaggtggccacctgcgccagaacatctttggacagggtgctcagtagaagccctaggatctgctg

SEQ ID NO: 23808 - DNA, 9311 bp, Oryza sativa
accgacgccaggacttgcgctttccatagcgcatagttgtttttggctaatttctctgagattgtgtttcctccgaaaggattagtggctgccatcttggacgacgagctggccatagattggatcgggatttgtttagtggaaaggctctgataccatatcaaacatcagaggttcagaagcgttcaaccctctcgggccgcacctttgttaatcttatattagcgataataaccaccgctgtgggttacagagatcggcgcaggtggatggatagatatgctcctattctgttacaacaaactcaatctagccttatctaatcatatctatccatctaaccatgccgtgtgcatcacacaaatacatatcacatgtttaacattgttcactcgatcccctcagatggtcgaagccgtttggattaatccggtttacgtcgctctcctttgttccgccgtgcagctcgatttctcggattatcattggcacggcggcaacgtggagtcgtcgcgtttgccgctggattaatctgtctctgtccaccactacgacaactagaactccagtgattatttattctttgcagtgtgtttcccccgccataatcctcggcctcgcatcttctaatctagtcgggatccacaatggcaagcactaagaatcttttttcaagcactttgatcagctcaggattgatatggaaatcggaaccttcagttcagtgctcgctcgctctttagctggcgtaaagtgttgttgcgaatgcattgcacgccaagattagtttcagctgggtgatcatgagatcattactgttggcctgccgagcagttggtcgattttacgtgatgtctatgactaaaaccaaatttgacgaggcatgtctgtgacctgcgaagcttagcacacgaaaatgactggacgaacgaacacgatacaaaagccaattctgtcacaccatcatggaaaggaaacgatgaatggagacggctgtagacggtatccagtaaagctgaatatttcgtggcagagaaagctctatcttctggtagaaagatgcattccatgttgtcctggggagcaatgggcgcggttatatacaggcgtgtggaatggcgctactaccatgttggacacgccatgttggacactgcctgaacctgaaaaagttgtattcctccgttttataagagataacgctcttaactttagaacactccgttttctaatagataacactatgaacttttagacacacgtataattatttatattatttaaaactttaatgcagatgcataaggtaccgtaatgtttttttaactgttcggagtggcttgtcgtcggcttcagctctgcagagccagcaaagcactttgtgttggtatatctgaaaactcaaatggaaatgattgaattaggatgtttgcagctcgtagagaccttttttatatataaaagttactccctccgttttataatgcaagtcattctagcattgctcacattaacatctatataaatatgggcaatgctaaaatggcttacattatgaaacggaggaagtagtcgatatagcggaacgacgactaatcttctcgatcgcttcaatcaatgatcacccaagacacgtcagataacgacacaagaacacacaatatttgttaacgaggtttagccgaagcttatgtcctggggttttgattatgggcgctcctcaacccatataactcctagccgctacaagtccatggccacaccaccatcatctccatgcctctctatttaagagagttgctaggttatagagtccgactctacctctaccccctaccacctattacaactttaaatccaactgtaaccaaatagaattagtatattcgacatctattctaacaattttcttagatctcccccgttccttgcgagtaattgtcaatgggcatggatgatttgaaggatgctgttgatggcaggttcacagattctattgtggaggacatctgctgccagaagagatgttcacaatgcagagattattgcggagaggaaatgatctggtaactcggccagtttaatcaaacatttgacagcatatcttaggggactcagtggctcaggaagttaatcagcacagaacaccattggcatgcaaacctgaaaaggttatgctgcatgaaactgactggacatacaacccctgtatgactgcatcaagaaatagtgaatcaccatcttcagtagattgtctttggggtttgactgctctctatttgatcggtacagatatgatgatactacatgttagctagcatctcatctagaacaaacatcatagcccaagacatacaactttcctagtttcctggcatagagtggagcaattacacattctagtttcaacgagaagggaatccatgttaagcacttgtgcattagataaaaagatactactccggcaggcagcatcagagaaactgaccggatagcatcagaacggaaaactgcaaaggtttccaacatcttctctctaaaaaaagaaggtagcatgaatcatctagatatttgctactccaacaacatatgcattccaagcatctgcttgattgaaatgctgtaattcttcatatttcacatcacggttggcattatattctttagcatttccacttgattgggtatttggcatctccctgatccagacatggattgatttaaatccagcttcctccaagcagtctttgatttctggtatcgaccacctacaaaggagcaacatgaatttcgaatttgaaggtatccttcctctttgcacaggactaagatgtcctgatactccagtgcaactctaaaacaaagttaacatgcgaggaagtcatgcaggtagtgtagggtgtgttacacacagcacttgaaaaacaatcccgtacatcatactcttcattatgaagagtgcaaagatatagcacgtgaaaaatctcctcagagatatagtagatgtagaagtggttggtatcaatatatcacagaggtaataaagtggcattgcctttggttgttccctgtgttataatttgggaagaagatgtaaatgggtaatgaactctctgttatcttgagttaggcctaaagggaaaatatagattacaagattggcctagaaacgggaaatgactacaatacccttgactaatacacatgtattctaaacaccttgcacatgatattaataccaatctagtttcccccctgaacctgtagaccggaggaccggactaagcaaaatattttcaactttatattttaataagaatttctatagttctttttgacagttacaaccttgcaggttttccataacacggtgaagatccactaaggaaacaggagagcaataataattatgaaatataccattctcaatagtatgtgatcaacttacaggcgccaatggtacgtgaaagcatgccgtaacatttgcttctttccagcttggaagtggagactgatccttgtttggtgacttatgatatcgaactcttcttgctcccagaaatactgaatgcatagttgtatcttgtatgtaagaacagtaatataaatctatatataatctcattctcattctccaaatcgcacgccattgataattggacaactctatctgttgtttatttcaactagaataaactacacaagggaaaaacctatatgactgataagtgaaatggacatcgagtcataaaaaggaggcacaaaatctcaccataaagggtaacaacatagcatatatactttacaattatttcagaatagctagattgaagttgtataaaaatatagctaaccgctttagaatctataaaaaggaggcatggtcaatagaaaattgtatttcggactaaaacattcttttatgttgcatactactactactgcaacatctttatgttggaataagcagattctacaagcagatagtgtgaattttcataaaaaagaacgcagttttttcagggcattatatgcctaccacatttctatctggtgagcaagaagatagcatttagtggattcgtaactagtataagggctaataactaacacaacatcactcacagtgaagctggggaacctcctctgcagacgtagcttgcgttcagatgatgtgccaccatacacatccattacaaatataccacctcgttttgacagtgcattgaaagcatgcctaaaatacaaaaccaagtcctttctcctgtggagacaacagcaactgtagttgaatgcacaaataatgtctcttgccggcaaaaccaaatccgacatggttgaattggctgagcattttgggctagcaggatccaactgatcacagatgttacttgctaaagagtcattatcattgtttacgtgcagatcttgcatggcatcacagatcttttgcttgactaggcgagctacatttggctgtagaacatttccatggaaaagtagcattcttgaatacccatcagctccaatcttgctcaggttgttttcaagacaccactcaagtgactcaaggtccaaatctaagccaactgctgtacgccttgcatcagtacgaagccactcagcactgccaacaggaaatcaaacaatatatcatgaccaagaagccaaaaacacatgcatcacacagtcacacactaaagttaactgatctcttgattgttgagcatcattgatcaaagttctccaaagaataaccattcaagcatttggcacatttcttgctaatggaactgctgaagtcttcaaccacacatgcaatgtgtgaaaaatgacagacatggacttcatcgaaaagtttagtgcattgacctgaggagggccgtgccacagaaatcctcttggaagtgcagagggacgcgcccgccgacgtacataaggaagaacttctgcaggtagctaatgtccccttttggcgactaaacacagacgcatactgttagcatttcgtcgaacaggttcggtgcacggagacttaatttcaccgatctatcccactagtgaagctagcgagattacctggacggagagttggtacaggtggaacttggaaggcatggaacctacttcccgctgctcctggtcacctccatccacacccccttcgtgttcgtcctcggctgctgcttcgtcggtgtcgtcaccgtcggagtcctcgtggtgtggcggtggagcatcatagcagatgaaggcaactcgtcaccatcctcgtcgccgccgccgccgccgccgcggaagcgtgaggcacggcggcctcggccttgccggtgcgactccgtcttcttcccgttcttgcccatcggaaatgtctagtgtgtttagcgagcggggggcgaggggtttaggaagaccttttcagaagagaaattttgcattcaagtcctccccttcatctgtatttctgccatcttatcaaagacacccccgcctcgctgagccgtcgaacaccatggacgcgcctccgcccgcgcaaccggacgccgccgcggcggcgccggcggcgccgcccacttcgacctcggcttctgccccctcatccgcgccacagcctaatcccaccccttccgcctccaccgccgcgccgcccacccccgacaccacccttgccccggcccccaatcccaccccagcccccgtccaaaccctagaaaccccagctccaagccccgccagtgcgcggccgccggtgccccgcatgaggcctccgtacactcacctggcctcgcccatcacgatgtcctcctctccggccacgggcgcggcctcttcctcctctgcttccgctccggccgccacctctgcgtcctcatctgccatgccacggggaggtgtagcccttgggctaccagcgcacccgcgtgcgccgcagacgcccgtcggctacaccgggttcgtgccgccgccgacactcgccgcgcagttcggctcgatgcatcgggtcctgaccagcccccaccatcctctacacaggtctgtatttgatgcttgatccgcacttttatattctggtgtgattaagctctcggtagtatgaggttttcatttggtcaggaaataactgatctggatgacagcaagaattacattcttttatataataatggacacgtatgatctggatgcccatggtgtagtaaatttcttggaggaaaccatgacttagtaggattatcttgcttgatgtcacatgcttgttatctgcagttttgtggaacccatttttcaattttagttatccttattcagcatgggggtctgaatgtgggatggagaccaacaagtcttcgcgaaatctgtaccttggtgatttggctgcttaaatcctaccccctgatgttttagctaatttctttcagccaacaatcccagaaattgtcaaatccagctgacatttgtgtgcgtagaagaaatgtagatgcatctgacagttcagctgcgtaaaacattaagtggagcttattgaactctaatattgttcttctgtgacttactaattactactgttctaaacgactatagttgttaatacttcttcatctttggtacttataatattttagttggtgctaatgaactaatgatgattggttggttacgggcatgttcagattgtagccaaaataaacctttggcaagatggcaatattgccaaaattttggcaggatttcttatgtatttaccaaatttggcaacaaactaaacgtagccaaaattttggcaactttgccaaaaaatggtatggttgaaaatggcatcaaagtgaacaggccctacatgctccatctcctctcgcataaaattttttacaccaacacattcatcctctctagagatcattaattcccagttcccacgcagccaactcaaatgtacatacaaaaaaaaacatatatagtccgaaaagttgttcaatataatccagtataaagagagccaatttccattgcaaagtacatgcacgctgttagttgaaacatattgcaccttttctctattgttttgaattcagtgaagattcttagtaatgattatggtcttcagcctaggcagccttcccctgggatccaaaatattgggacagttggttccattaacacatctcaggtgagaccaggagcaatctctagtctgccacagcagacaaggccaaattttccatcttcaacagcaccatctccatctgatagccagattgcaagttcacaagtaagaaactttcacttgtaaaaagcaaagactggtctatctataggcaaataagctttctgtttcagttatatgatgtacctaattatgtgaataagattatttacaatataacttatgcttccttgtacatattttgtcatttttccttggcaactgtaactcatttatgagtttaccttgttctgtgaataatgagatcaattggaacttgcaccattgtttattttttgtatttttcattcctcaatccagttacaagggaacactcctcttattaaacctaacttcatttaactatattccaacagaaaacccccatccaagctttggcaagaccaccatctatggcttcttccccctcgatgcctttacagcaaactccgccaaatgtatctgctccacttaggccccctcaacataggccacatccaagaccataccatgctcctgcaatttcgcacccacagaatgcacttttaacacagcagcagcaaaaactaccacaacatcaacatttgcagcaacagcagcagcagcagcagcagcaacaaaaactacagcaacagcagcagcagcagcaacaaaaactacagcagcagcagcagcagccagcaacaaaagctacagcagcagcagcagcaacaacaaaatcagccacaacattcctcgcagcaaagtcaacagactacaacactcagaaaccagcaacaaatttctcagcagcaaactgctcgtacccctgtctcaatggctcagaagctagattctcctgctgtactaaaagctactaatgtgcaatctggagacatggcttcagtcgatgtggatgctggaggatctggtaatcgactgctttccaagaggagtatacatgaattagttgcacaggtacacaacttcctgaactgaaacctgaaagtatacccttctttagtaatgaaaaaaacacagttaaaccatatctaatatccaaagaaaaccacgcaatagaaaacagaaaaaaaaaaagggcacactatcttaacagattttttgtttaatctacattggttaaggaccaagtaaaaatcttttcaaaataatgttgttgattcagaagtgcttacgataattgatgatctgtgtgaaatctatgttccagtgtacttgaacaggtagaggaagtaggctgttacctgtaataagtatgttagatatgatagcatatactgttgctaatactttgtcataaaatttatctgggtcatgattgtctagagttgttgagtgtaggggctgcaaccataggggttcacggatgttatgggtattgtaggttcataaaccccactgcctgtgatggatttagttggttcttttaccaatatttatcagttatggatcatcatcacttaagtagaaataggcattttattatttgcaaaagttaagtgtcatcataactttctcatgctgtgatcttccaacagattgatccttcagaaaagcttgatcctgaagttgaagatgttcttattgacattgcagaagattttgttgaatctgtaagccccttccctccaccatcattgctgttctccaatagtttctttttgcaagtatgcttattacggggatgtgttctctggttcttcttgtgtgaggaaatagtaaacactgcctaatggttgctagaggcctagaagctctgggtcgaagttatgctgtctttagatatagaagaaagttgtcaccctttaatcatcagcaacatgtgaatttgtcatcctggtgtatctaggatgtcttctgtaccttttttttaattagctgttttgagcaggttgcaacatttgcttgttctttagcaaaacatagaaagtcaagcattttagaagcaaaagatgtactcctccatgcaggtaacttgaatatttttgttcttctagaatctttgtggtgatgctatcaaggcatagcatttcaaattttcaattgcatttttcatatgattgaattgtcatccattgcagagagaagctggaatattaccttgccaggc

SEQ ID NO: 23809 - DNA, 23611 bp, Oryza sativa
tttgcagcatgtcaatgatattcacagggagaggcttactctggtaactgttcttcccatcttatatcttggaaacatattgttttgattccctctattcaaagtagtacaaactgtgaattgacaaatatcctaatctattctcaatgctgtttcaaaattaacctattgatggtcatttctcatcaccaaatacagcgttctgccgatacgtccatttgattgttgtctttgcttgcggtgtgatatgttattgttttgtctgaacctgtccagatcaagaagtcaatggccagcgaaagtaacgcaaagggctctgctgcgcaagctgcagctaaccagaaaaatcagacacccaagccacctgccacaggctctccatgaaagaaattcaataggattaccctccaaatcctgagccatcaatgcattgtcatcatattcggtgtttggacgatatgtgctgtagtacatcttcaactaattggcattggcttgttgtattataggactgtacaactgttgggaccgttagtaggactgcaagattacatgtacaaatgctttttctgaagagtagatctattgaaatgctaattcagttattttgggttcagctgcaagttgcaaccgttcagccgtggtaatactcaaaacttgcaatggcatggtgctccaattcaggatttctgcttgagaaattgggaatcacatcgggccccagacgaacagtcattctatagctgatgcctggctatggggcagcggccaacagctgctcaccagtcactcccttggagtggagcgttacttctgtctgaccctatcttgtgtcaactgatctgtcattggctactcattgccgtgaaaccaataatatgtactctgttctgtctaagcccagagaagaaatgccgtttggacttttgcctaaatttgattctctacaaataaccaatattaggattctagccatttgagtcacgtcatcagaaataaatatcttccttgatccgtcctcctcactgcagaacacccatcctgcacgtcgcttttgctctacaaatgctgcaaggtgacccgcatcctcccttgattccatccacgaacgtcgcttaatcaggtgtccatctgtacgactgtaccctcgccgcagtcaagtcatcttcggcgtcaccgcctcaacggtaccgcgtcgcgaggccgtgacgttttcactgatgatgctgcctcgctctcgaccggtcggccacgatggcgatcgctttgttccaaagagacagtacgagggtgcggcccctcgcgaaccaccacccatcgttccccgccaattgtgacttgtgtgaggccgcctcggcgcgcgcggaaaccaccagacctcgtcgtcttccctggctggctacatcgaccgcgggatcaaccctgtccttacctttccctggagagttggagacattatctcgtgcagtcacgtgtcgcgcccgcccccgcgcgcgcgctcacgaatcggtcggaggctggccgtggcgggggcggcattgcgatttgcgagcgaacggctgtcctctcaggctctcaccaaacgaaggccacacagaccgccacgctgattcaggcgtacgatccgcacagggcgaggcaggcagcccgggcccggggccggccggttccggtgcgaggcgcctctcgcggcggtgacaaaggacgggacggagcccgcgcgcgccaaccgtcgcgccccgcgctcgccacgacgagacggcgatgcgcgcggtgaggccgtgatccaaagaaaaccttccggccggccgcccggctgtcggctagtgagacgttgctgttgccactcgcctctgctccgcgcgccacacgtgggtagtagtaatgcgcgcgtttttctcgctgccgctgcgtccatcgtctctctccgctgctgatggcgcgagacgttgtcgtacggcggaacgaggacgaaaggatgatggctcataaactcggcggtggttgttgtggccatctcgtgtcggaggtcggcatccgtccgtcgtagtagcagcgtagcacacgttcggtcgtccgccccagcacaaggaacagtgtagcttgtacggcagcatcacatgaagcccacctctttacacgaggatgaatgagcctcgaaagagtcgaatccatctcgagtttggggcctttgggccagtggtcactcacggcagggggacatcgataccacaccaacattttgttatgtatttgccactataattaatcacgtgttaatgtactgttccatttttcatgtataggagatgggttcccaatactcacccccgaaaacagcctaaagtgtctctctttatggaccacggttagatgtgctcactccgccattgatacctatcaagaaaagcatgcatacaatggacagcagtttaaatccacttgtcaactgggtcgggtcctacactgaactttgaacataaagacagatgcttccagagattatcgcccagccaaccggcaaggccccattgtttattgcctttggacctgagttcattcagacatcgattgtgttacttgaagcaaattgtacgttgattactactttcttcgttccataaaaatttaaagtagttctggatatgatatatcataatactatgaatttagacacatctctatctagattcgttgtactaaaatgtgtcacatctagctttatattcggtttttttattggacggagggagtactaagaggctttcatagtctctagtctcatcttagaatgtgctgttgcgatgctaacattatttttattctttatgatacagctcgttagtttacgccgatttcaactttccatagcttttcatatgccgtgcaatggaagaagtatgatggaaaaaatgttaagttaaactttttaaaagcttaaccattttataaaaaaatatatagcaacactatagcataaaattagtttcattacgtctaatgttgaacaattttttatattttttattgtgcattgaaaatattgttatattttctataaattaaattaaacataaaaaattaatttaaaaaagttaaaatgacttatagtatgaaataggggcagtatttgtcaacctcccagtttggtgcttatacgtaaatatgttatactactagaaaaaccgcgtggctttgccacgcatggtacccctttatttgaaaggaaaatataggatttttttattctgtataggaacaatatttttttctatagaaattttttctatatgattttttgaaccaaaggattattgaaaactattaaatcctatcaaatttctaaggaatgcccaaattcatattagattttgagatttttaccatgaggtctgacggagcgtggggctcctcaccgggagaccgcgcaggcccccctttgccggttcggccgggggccctgggtgaggttctaagctcctagtctgtggaaagttcgcgagattggaaaaagcacaagacacgggcgatgtatacaggttcgggccgctgagaagcgtaataccctactcctgtgttttggtggatctatgtatgaagaagctacaaaagagctggagaaccagagagctcttaccctctccctctctgatcgttctggatcccaaaaaaaaatcatcccctttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagttcatcaatctgcatgtttgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggtgcctcggccctcggggccgagacgggagcggtccgacccctcggggagacaaagggaagggcggccgtatcaccctcgggcccgaccccccccccccccgagggggttaggccacgtgggtgatcgtgtctgcctcaagtctctaagtcatgatactcccggtcccatgtcaccgacaaggtctaatatcataaaaagtctctcatgagtttatctctctcatcctatgtaatcaacttcatgtaatctgaatgccccatccatctcaagtgctctatctctctctttctttttttcttccaacatacaagtcctatactcctatgcaatccgaatgcccttaactttcttatttctttatttatcattcctatttcgatacattttctatctatgtttttcctatccaataatccgaacaagccctgaaaatggttgggatgaatagccccttttttttcttatgcttaagcttatgtcaaattttgtattttaaaacttaattttaaagttgattttgtgctttgtttttcatcgaagtttatattgtagcatttgcttttgtattttttttaattagtgataagcggttgagcatatacgtagatgaaaagatagtgccagaagtgatgtcaggctgttcgtaatggtctcagcgcattctctcccacaacttttttttagggggggcatttgcaaatttgccattgtttttttcaatttggtaaggatgccactcgaatgacagttctagtggtatttttgtaattttctagtggcagtcttacaataacgatttaaaatagtgataaatttgccattgcctcttttttttttctagttcatgcatcgatcaacatgcatcgggtatttgcatgcatacataatatctcgtttcacctagtgtgttcttgtcatcttgtgccatcacatagcccgctgagccatgacctatgtacctaaatcatctactaattgcttgattgatactccagaaaattttggacgcccgttgcacgcacgcacacgagcatttccggattgctgcacgcgcgctagcaagatcgagcctgttccacgaaataggtgttgccatgtggcataattttccttgcgatttcttgcatggaattcgtattataagattatgccattagctgaaccagtcattaccattctggtagtacacgttccgagtctgactacctaaatgcccctgactgttgcagcgtgatgaagcaaagcatataattgcattcagatttcagagcgaagagaagtaaacatcgattgaatgcggatggtccgtgacccagccttgattgcacataagttggtacttatgtagacagaactaacacaattagaccatccaatgagtgaaactaatcatcttgtgggagcacaaatccctgccggggaggccccaatgtccctgttccatgtccaatatggcctttattgtcatgctgtctggtaagatcgatcttaatcgagctaaacattagtcgaggaattaacaatcacatgcacccttctttgatttgcgtatagataggatgatttagcttataaagccaagatgcgccatttcacgtgtggaatagcactccgattcggaccgaaaaagaccgaaggaattcgacggtaaacatgttagaagatagtaaaatgcaggtatctacgtcaagaaaatgttcctaaaacagtttatgacggatctagaaccaatcttccacagtgtagtttatggctggtttttgcctctagtttatgagcacagtggtttcatggtatcatcagtcatcacgtcccacccaatggaactgttcaaccacgtccaatgatgcagtggacagttctttccacacctaacttataacttgtttattttttacatgtgacctataagccacgttaaatgttaaattttgatttttagaacttaatttaaaattaattcagcgtgttttttttctttttttcatcacacgcttttatacaattgtttttttattggtcatgtatcttcggcttataagccgtagcctaatacttaataaatgattttttttttgcgataggacttaataaatgacttctaagcaggccccagacgtccatgtgtgagttcatgtgcaggaatagccccctaggcgagagtacaagacttcttttcataagatggctcagttcttgctgccatttctttatcagattatcatgcctgacgtggtatagaatacctaaacggctgggcaccttttaaggccgtgtttagttctaaaatttttcttcaaactttcaacttttctatcacatcaaaactttcctacacacacaaacttctaacttttccatcacatcgttttaatttcaaccgaacttccaattttagtgtgaactaaactaagcctaagttgtgaaactgagaggcacgggcagcagtagcactcaactggagatctgtctcactgttctcgtagtactcatagttcctaccatgtgagatcagatacaactatggctgtgtttagttccacgttaaaattgaaagtttgactaaaattgaaagtttaaagaaaaaagttaaaaatttatgtgtgtaggaaagttttgatgtgatggaaaagttgaaagtttgaagaaaaagttgggaattaaacaagcactatacaatgtgtttttgccaatgctacatgatgtatgcccacctttactctctctctctctcagcctcggttatctcgatatatttgcatgaatcttgaatcaaaacccttattgtatatatatacatcttagaccaaatataaatatgtcatagtacaatactatgtttacgtaaaaacaccaatcaaatatactaagaccgaaggagcaaggatatcaaagataaaaaaatggtggtccagggcttgaggctgcatggttgcatgggcttaaatttatttaaaggaaccacacaagacaatacaatgtttaaatagtgcatgtaaaaattacaagactactactctgaaaagaaaaaaaaacacaatactgtcaccatgcaccgacagcacctacacacaaccaagaaaaaggtctagcacaggatcggccaccgctagactaacaaaggagcaacaattgtgccacgcgcctagcaccactccctaaaaatcgagcacctagcctcttgaacatcaccaagacgaaaggttgtagaaggagagggtaagaaatatccctctccctcgcacagacctgcgacctgccaccatctaagggcttcgcaccaactgtttgaaaagcatatgaggcagtaaaggggcctcctagacgacacctccaatgacagacgcaacatagggagtgtcattgtcgtccgtccagatcttcaagctagaggatcatgacaaaggtttttactatgaagtccaatcaggtagggagggaggcgtctcgacaatgcccttaagagggaacacgtcgccaagagacatcatccttgtcggctcaacgaccaggcaatgctttcacctgccgtattgggtttagattaagcacacaactgtggaaaatctcacctgccgtatctcacgagttatatctaatcaaatttgaataattgagtaaattttacaaaaccatacgttctgggacattcgtaacaaaaaccccagattttgcaacttgtttcaaagaacctaagttttagtgcaaaatgcttcataaaaccccatattaatgcatatatcttttgtttggcaattatacttatggataatacatgtatataaaaataatgtcatatttttaagtagatacatatattagttactttctcaataaacgtcaattaccaattacatattgttgggtctatgtactccattcacgtgatgctgatacagtaaattgggggagttaggaagtaaaaagaataaatggtatagaaatatgtattctcggcctatatgcttgaaaatattggatattataatgaaattggagtattttgtacaagtatgaggtttgtggaacactttgccctaaaatttgtggtttcttgaaataaattttacacacggagctttgtgatatagatgtttaaaaccaattggttttataaatacacctaataactagatctatctagaacagcaagggaaccatcaagcggcattatttcgcattagttctgtatgagcttttatgtcaaacatcttttatgtaaacacatcttaaaatgttacggaaaatgaaaaaaatgttctcgataatatcttttgtgctctccaaaacatcacatagtgggtcatactccctccgtccctaaatatttgacgctattgacttttttaaacatgtttgaccattcgtcttattcaaaaacttttgtaaaatatatgaaactataagtatacataaaagtataattagcaatgaatcaaatggtaggaaaagaattaataatcatttaaattttttggataagatgaacgatcaaatatgtttaaaaaaatcaacggtgtcaaatatttagggatggagggagtatcaagaaaaccatgccaagtaggagtaccaaacaaagccatgtgtcaccatttggtgatgagaatttcaagccctgaccgatcgccatcacgagggggagagcaggttttcaccctctttcgttttgtctgatgtgcctatcacggttcaaatcattcgttttcttgttataattatcgtgcttacagcaacgcttgtcctcttgtgtcatgcttgcaggcggatgattaaagtatgacgtggcttggttattcttatgctaattataggtgtgatattaaaaaaaacacttattcttcagggcagtgtaggtgttgtactgcagtgcaatattgtaagagaaaacaattaaggtatagccattgtccagtccaaagtttctgcctgccaggaatactaaaatctagaatcatcaaccgtctgaatctttcatatattctactgaaaaggaactggagagaaaaacaaaataacgtcatcttgcagtactacatccctctgttatatatattttagaactctgtttgtttagcttgttttgattgtttagctggtgcatatctacctaaatgacacgtgctagcaatcatggttctatgattgtttgtgctatatatggctaataattaagttgtggaaaatgactagagcaacaaaaataatttataagtattttttatatatttttgttattagtgatttacatgtcaataacaaaagaataggctacaatggaagaaaaatatcaaaatactctaaaagttcaaaaaaaaattatggatgataaaccaacaagcagacgatgaaaggtgactgcttgagttgcggcttatagagcttaattttagaaaaaaaaattggtattttctatttgattacctttattttttaattgcccaaagtataagtatacaaaaatattttctgttgctcccgttattattttgaacttatccgtaacctaaaaatgccatccaagctgttccaaaattttgatagcaaacaaaataatcagagagaaaagaagtggtccactgatctatcatccctggagacttttctaaatgacattttatttgtgaaatttgataccatggaggcccctcttaaccatgctttactttagttagctacattgagctttacaccaagactaccaagttcgaatagaaaggcacaccttgatcacctaccagagggccgaaggcagacctagctacaccataagatggcccctgctttggccgttcttcttcaagcaacgtgtacacgacacaaaggaaaagaaatagattttgagtgcggcatttaattatcactaaattgatccggcttgctggccatgccgagatctggtgcacatctttcaactctcccatctcacaaatagcaaacagtaagaccggttgttggtgcagtgcccatggtgtagtacgtcctccccagtcaccacgaaaagaccccgaaatcatttggtttacggaaagatatcggtgtaaaaaaacgcaacaggacaagaaaggtcaccattaatcgaatgcttctggacgttagaaaagaaaaatatatagcgtttggaggataagcgagcgagggagagaaagtgagcacgagcgacaaaagagcgtagatcctagatggcgtataaacacaatcatagtgtttatttttgtaggtcctgcaagtgggcgatcgacgacgtgtgatctccgcccgtggtgttgacaaatccgaattgcactcgtgccacacctccgtgatggtgccatctgtgctaccgtcttctcttctctttgtctcgatatgtactgtcgtcgtttctatggatacatatacgccggtcgtgttctgcgtcaagtcattgcaagctagctaccacgatcgggagctgtaattgtgtaattgtgtacgtgttttgatgcgcataccgctgcgcgcgaccgatccgtgcgtggattaattggccgaggcgagcgcggcggttgcgctcgttttcctgaagtgtgtcaactgtcacgtgccggcgaacccgtgccttctagacgtgccggccgcgcgtcggctgcacgtccctgtcaggcacacacacacacacaatcagagcagcggcgcgcgcgcggtatccatccctgtcgccttgccgagccgcgccatctgggaggatcggatcggttgccatgcggcgtacgtccctcgctgctcgcttcgatcgattaccggcgccgcggggcattgccttgccgccggtccgcgcgcgtctcgttgcgttgtgtgggcactgcacaggttgactccgagcggtcgcgaatggccgtaaacctcgcgcgcgaggcgatcaactcaaccggagcggagccccgcgcgcggcagggccatgcgtgcgcgcgtgcagcggttggcgcgtttgtccgtatcgtttaacggttggtggccggaggtggggggaccccgggcgcggtcgaaaggaagcggatggatgggcgggccacggggggaattggcagcgcaaccgcagcgtgccggaatcgtggcgatgtcagggtcaaggcgcccccggtgcccgaaacggggaaaagagacgagtcgtcgactgtcgtgtcggcaaacacctgcatgccgccggtctagggctaacagacaggtgatccggattcgtcctcggcttcatccttccaggttaggcatatcgatatagacggctttttagttctactaaaatttggtaacagcctaatggttacaagagtctcagtagcacatgtggtccttgattcgactccccacaaaagtggattttttagaatttaacggcgttgtgctttcagtggtaagcgacgtaaccgtcgacaacaaggcgcctgtggtgacttcgtcaatctctcaaggatttgccggcctagtcttcgaagatactcataggggtaagttttacgtgcgtgtgtttatagggggtgagtgcgcgtgcgttgtgagtgtctgcgttgtactgtgtaattcttgaaaatgctttagtctggccgaccaatgcgaaggggaaaatcagacggcttgctgaaaatatcaatatcagccaacccactaaatacccaatgctctatctatatggtttctttctcctctctgctgcatactcggtctgcacacagccaaccacttatgtgtagcaatttttttattttttttcttatgatccgattatacattatattacttacaattaaatctttttatcaagatctcacatgattatattctgataaatatatacatatgttgcataaaatatggtctttgtgttatggtcagtttttcaccagtgttacatttgatcgaaacatttttatcaagcagtgaaatattttttatcaagtgataaaacacccaaaacattttttttattgagcgatgaaacatctgattttttttatatgttttgaagcaccattcaatatttcgcaaatatgagatatctgggccgtagtatcctcaggtaattctaataaactaaacatagccattgccactgtactaaaatttgataattccaaaattccaaaccaagcacgtccatcggtaccaaaatttgataacaccaatatttattatatataaaattttgataaggatgattttaacaataaaaaagttaacaattccatagttgtaggtcccaagtctaaatagatgacgtttagcctcctgaaatcatgatattggattaaatattcaaatacgtacactgttcatacaaaatttcaagaatataacaaaattttaagaatatacctttaaagaaatagaaaatatacccatgtcatcactagctgcgatgacatttgcatgacaagctagttgggctttgtagggtcgttagacttatcgccatatggcggcaatgagggtatcaccacttgctgtgacgagacaggtatatttttagaattttctttaaaatatgtattcatgaagatttatgagagaaaaatattttgaaaaaaaaatatgacattgcgctagctacaatatccaacaagaatagacaatcggcgtgcttacaggagtactcagaaaactcaacctcgtactacagcatgacacatcctaatacaacgaatctagatatactttatgttcaaatttgttgtattaaaatgtgtatattctagtattaggttgtatttttttgggacggagggattattagcaaatgacatgagagtctgattggctacaaatcctctcagtcggatcatgtacggagtaacgcctgcggtatgaatattcagagtttcagacaactttaacaccttctagtaaaagtgcaacagttcagatagaaataacctttggaaaagtgcgcccaaagcaacaaatttgcacaaaatcagtacagataatcgggacataaaacgacaaaatgaagggcctatcattgaacagcggtaagaaaaggatatcttccctccttttatctccagtgaccagtaggatagacatccggtccatccggacattggtcgagcacaccaggcctactgctgccaatgttattactatcaggtccctctgcgacaactatttcaaagatgacgggtataacaatctttgtcttaagcggttgacactgacagcgacgtaatatgtacatgtgatctatatagtacatcttcaaggcacagctagaaataatcattgaatggcaacaaggacaagaactatatagaatacaaacggtgggtcctttcgtaattcaatcagatacgtccacagaaggcagaaccacttttgcctgaagaaaaacagaacttaattaattaagattattagaaccactattattcaggaatctaataatacactcaccatgcattgcatgtagtacgcatctcgcaatatagtgtgggatatcggtgccagggcaacacgtgtctacattaactcatctctcttcgccgcaacatatattggcttggctctggtccagcatgatgacagaaatatataagcacagctcaccaaccctgagtagatatcttttagattgataaggtaaccagataaataagtagactaaaaatattcacgaacacgtatatcaccttgcatcattgcgctgtcatgacggcgtcttctagctatcttcggtcatcatgataaaaatttcacataactacgtatgttttttttatcaaactgacagcagactatatttaagcaattatattacaaaacaacagatttagagtttaaatcctactccctccggttttattttaattgatgttttggataatgacacggtctacaagatatatgtttgaccttatttttctattataatatgtataataaacaaatacatgtttacttttattatagtgctttaaaagataaatctatatatattgttctagttcctttaatctaaatatttttaaagttattgatggtcaaagttataaaagtttgaactcaaccttgtccaaaacgtcaattaatatagaaccggagggagtagtattattttgtgaaaattttgttagtaatccttacttttatgacatatcattttaaatctataatttcatgatgtagtttgtaatagtttggtcaaaatatatgtagttttgtgaaatttactttaatatttataaatgtagtgttagtaatcgattttcccaatcctttggtcttggttatgtttaactagactaaaaattataaaatcagatatgctacttcacattcgatacaaaacatgaggtaaaatcttacggactcgtcctgttcttttgtccaacaagagttggatgaatattaagatttttatggtatgctttttaaactgctaaacggtgtgtttcgtgcgaaaactttatatatgaaagttgctctaaaatatcatattaatctatttttcaagtttgtaataattcaaactcaatggagaaaagaacaccacctagtgcgccagtaccttagactacatctctaacgtgttctccatgatctccaacaagcctatatggttaggtttctgtgggttaggtcatggtttgagtggggtgggggagaggggagagggaatgaagaggggaatagttctctggtacttcctccgttcttaaatattttgacgccgttgatttttttaaacatgtttgaccatttgtcttattaaaaaattaagtaattattaattattttttatcatttgattcattattaaatatatatacatatagttttacatatttcataaatttttacatatttcataattttttttaaataagatgaatggtcaaacatgtttaaaaaagtaacagcgttaaatatttaaaaaccgagctagtaatttagagggaagcttagagtggcgaaggtctggcgatgggcaacggagtcggaacgtaatatagttaaattatccatagaagacatatattggacaatattttagtaccaactgaccaacacaagctcacatggcttgctccaactgtacatacgtgtctacaccaccatgcacgttttgggaatcttgttgcgcaggataggataaaatactgaagtgatgaaactattaattagcatgcgacatacctgattagatttaagtatctgatcaagtcaagatatcatatttgtgcactagattcggtgggtcgtcggttgatgacagtgatgttatatatatgaaacttcccatgcatatttagaacgatataactgtttaatttcactgcatctgtctcaaaatatagctaacttttttaatttcaattcaaaattacatctccaaaataatactataattaatgtccccaaattatactattatcgtggggtagctaaataatcgtccgctgcagacatatagcttatgaaattacatttccaactatattgctaacatcctcccgttgttaaatcgtggaccagctaaattcgggttgttttggtggctaaactttgttatacttttgacaaccaaatctgatcaagtgagataaatgtttagggtcttattgattgcccaaaagcttattaattataatcctaacggtttattagtgataaaaaatattttttctgtaaaacttttatatatgtgtttttaacaacttaaaagtcaatgataaaaaagaaactagattaaaaatatcttaaaataaacttcaaagctacttcatccatttcatattacaagccgttttgattttcttctagtcaaacttctttaagtttgatcaaatttgtagaaaaaattagcaacatctacaacatcatattatcactactaaaaaatcgatttttcatggtgtcaacctattttttttctctaacagccatacatgatcaccgtcaatgaaaatactccgagggatgaggggctatggaccgccagtgaaaatggatcttcgctggtagccgcagcgaatatgtacaacttttcgctggcaacccacttaaacagccgtcaacaaaaattcgattttcgttggtggccactagagagcattgctagtgaaaatatcgccacattaaaaaaaatccaccgccacccaacacctcctcctcagctccttttcccaactccccctcttcctctagacccacccagccctcctccctcaccggcgacagctccctctcctcctccctccccaccgtcggtagctcgcgcaagcggtggtggcgaagagaagcacggggggcggggatctggcgcagggaggggtggcggcggcggagataagtgcgggcggcgaagattcgacgccgggagggggcggcgactgaggagagaagtgtgcatgcttattcctcctcctcaagggcgcgtacatgacgacgagcaaggcgtcatcgtcctcttcgcgctcctcgacaagaccggcatcctccctatcgaccatggcatcatctacgcgctgctgcttggcgggctggtgctcgatgtggatgccatcctcatgctcctctcctccaaccagatgatcttcttcttcgacagaaagccaaagctggcgtggcttgtagggtggccaaggccgtgctgctgcggccaaggcgatggttggagtggatggatttttttttcatatttttttgtgatctgtgaatggatatgtgtttaatttgtgatttgtgaatggactagggtgggagaggattttggatttggagtggggtattttggatttgtgtgggggatttttgctggcggttctctttacggacccaccagcaatattttcgtaagtggttaattccagcctatgaaaatactctattttcactaaccttttcttgccagcgattgggctggccgctagctaaaatataaattgtccgccaacaaaaaaagctttttttagtagtgttagttttattagatgcaacgttgaatatattttgatgttatgtttattttgtattgaaaatgttaccatttttatctaaacttgatcaaatataaaaatatctgactagaaaaaaaatcaaaatgacttataatatgaaacaagtgaagttttttaaattttaaattttgctttggcctattctctttaggacaaccaataggccattagcttacagcataactatgtcatgtcacacctttttagccaataaatccatacgtagacatatctttgcagcataaatattactcccccgtcccataatataagcgattttgagtttttgtttgtactgtttgaccactcgtcatattaaaaaagtttgtggcaaaatataaagcccgtaaaaatgtgttgcgtccaagtttttctgaaggttctgtggcaaaatatgatgctgtccaaagagttcctcggagtcggagactacggttaaaatatactgatgtgcaaacaactgtacggtcaactctttagtcatgatatatatccgacgtggacacgagtaaattcctgcagtgcgccctgccgtcgataagctctctcgaccggccagtcggtagttagctcgtgtaggtgcactgtaccacacgtgctgatccgatccttttggttcatttgaactggtactacctcgaccagagagcgaggctatttatctcccctggaatcgtagatcgtcacatagggacgaggacactgaaggctacgtgcactggccactggccaaagcaggaaggtactccctccgtcccataagtgattttgataatttgcttccactgtttaaccacttatcttattaaaaaaattatataaatataaaaaacaagaagttattcttaaaatactttagataataaagtaagtcacaaataaaataaatatgagtaaatttcatcatgggctatattttttttaccagtgtttcatattgggctagggctaagtcaagattttcactttacaccatgtttctttgccaattgccaagagttgcactttggggtagggtatgtttacaacctgggcatgtgtgactgacctcgccgtagatattatgattggattgtgatggcactcaattcaaacaactttttgatgcgcggtgtggcacggtttaggtagagatggctaagcccactcatgacatgacgaaagaaggagatgtgtgctatcgtttcatgcgtgcagaacttccttcgcatatctaggtgttgccacattgcaataatctctattacaagcttgccgacgtccacaatccaatcatctccatcacaagcttgccggcgtcctcccttatctcctgatctactgacatgtgagagcatctagtccaaagtgaaagcttttggtaaaagaaactagcccaaagtgaaaactttgtctttaggatggtccatgttgaaacttaggtaaaaatacctagaccaatgtgcaatttactcaataaataataattctaattttttaataagacgagtggttaaacagtacaagtaaaatgtaaaaatcccttatattagaaaacggagggagtacgtggtttcaattctctctcttccgttcagttgtgttctctgccgagtgatgctttggagctctctactatcactaaaaataatataaatcgtttgctattaaaggtaaatcggtaatttactaatccatggattagggataactttgttatttataatttttttctagatcgatatatggccattcattctgttgtctctataaaaaaggcaaaaaggaataaaaatattgtcacaattaaataattattatatctatctagacctattttttacaataataccctctacgtttgtagtacggctaactagaataatagtataaatagatctatactcttcgatccaatgagattaatggtttatattgtcttatattgtcttttagagtaaatttcaaagtacatatactttgatcaaattatcacataactacagattaacttgatgtatcacaaaactacacatttaagatgaagtgtcacaaaactacttgtttagtaacacaactacaagtttagaaccaatttagtcacacaacaataatgtttatagctccagcataattttgtgataacttcaatattaaatatatagttttgtgatatttaaccttaaatatgtaattttgtgataaatatggtgttaaatccgtacttttatgatacacattttaaatttgtatttttgtgataatttaatcaaaataccaatagttttatgaaatttacttatttttttattaccaaaagagaacatcctaatggggctcgggggtaaaaacccaccggcgcaggggcgatgcatgtgtccactgcagcgacggaatcatgcagatgaaattatcaagcacatgctccgcctcgccaactgaaacacccccacacgggatggcgggaatcaaacatgggaggaggggaataacaacgtgctgaatgggggcctaccggaacaattgagcggtcaaaacgtccttgcgcgcgcacacggacgtgacacgcgacctctcaatctctcactcatatatacccaacccaccccttatcacgggcgacgagacgtcccgctggtataaaacggccccctcccgggacgccacgatcgtcacaagcaaacgcacgcgcccccgcctatgaaagcccgcgcgcaccacgcacacacgcacgcacgcagtcgcaggcgccgcagctcgtctccatgggtgtcgtcgaggcagaggcgttgcatggggcggtggaggccctggctgggtcgctgcagccgcacgtggccaccgccttcttcgtgttctcggcgtgcacggtggccctcgccgcgctccttgccgtggtgcgcctgcgcccgccgtggtggtgcgactgcaccgtgtgcgaggccttcctgacggcgtcgtgggcgggagagttcgacaacctctgcgactggtacgcccacctgctgcgcacctcgccggcgcagaccgtgcacgtgcacgtcctccgcaacgtgctcaccgccaacccggtcaccgtcgaccacgtgctccgcgcccgcttcgacaactatcccaagggcgctcccttctccgccatcctcgccgacttcctcggccgcgggatatttaacgtcgacggtgacgcgtggctcttccagcgcaagctcgccgctgccgagctcgcctctccggcgctccgcgccttcgcggcgcgtgtcgtggcctccgagctgaggtgccgcctcatccctctgctccactctgcttcacgtgagggcaacggcaaggtgctcgacctgcaagacatgttccgccgcttcgccttcgacagcatatgcaagatctcgtttggcctcgaccctggctgcctcgagctgtcgatgcctgtatcgacgctcgtggaagcgttcgacacggcgtcgacactctccgcgcggcgggcgacggtgcccatgcagataatctggaggctgaagcggttcttgaacgtcggggacgaaaggaagctccgggacgcggtccgtttggtcgacgcgctcgcggcggaggtcatccgacaacggcggaagcttggcggcgctgccaccggcagcgacctcctttcacgcttcatgggctccatcgacgacgacaagtacctccgcgacatcgtcgtcagcttcatgctcgccggccgcgacaccatcgcctcggcgctcaccgccttctttctgctcctctccgatcacccagaggtcgccaccgccatccgagacgaggtcgcccgcgtcacgggcgacggcaaccgaaccatggccgccacattcgacaagctcaaggacatgcactatgtgcacgccgcgatgtacgagagcatgcgcctgttcccgccagtgcagttcgattccaagtttgccgccggcgacgatacgctgccggacggcacggtcgtcgcgaagggcacccgggtgacctaccacgcctacgccatgggccggatggagtccgtatggggccccgactgcgccgagttccggccggagcgatggctccgggacggccggttcgtcccggagagcccgtaccgttacccggtgttccaggcgggcgttcgcgtctgcatcggcaaggagctagccctcatggagatgaaagccgtcatcgtcgccgtcgtccggagcttcgacatcgaggcgatcgcgcggagctcgcggcggcccaagttcgcgccgggcctgaccgccacgttcgcaggcggcttgccggtgagagtgcgccggcggcgagcacgtgcgagcgggcacaacccgccaatttaataggtagagcaaacaaactggttcgtgtcatcacgatttgttcttctgtgcttcttttcgaactggaatattaattaggttacatgcatcatgtcgattatgatcgatgactccgtgaccactcgtgagtggctgagtgcgttggcacttggcagcaccaaacttgatgctggacgactagtcagttgcctccaccactcgagatggagcggtagattctgggaatcgatcgattgcgaacctatcagaccaaatcgcgcgtagcccgactcgtctgcgatcaaatcaatccccggcgccgttcgatcggttcattcaaagaagaacatatacgggacaaaaatggaactggagaagaggaatcagcgaacggcaacactgtcgtagacagtagagtagactcgaagtcgtttgctagctatagctaagcgcgcggcgcaaatctaatatgatttcctctgcgtggaaagagatcaatttagcgattattatagtggtaaattgaaatgcgaggcgtggccgtggcacagaatctaggcgtggtagctagtgagtatagtatgcgacgagcaggcttttggagcagaggcgcagagcgttgcacgcatatgttcgagtacggcgacataaacagatgctaattcttggtggtcggggtgggtctcggggggagaagaaccaacgcggcgcacatgtgctcgtggggcggccgctggctgctcgtgttagatcctcctcgtggtcctgccgtccgtcccaacttcgtctgggcctctcgccaaccaagtgccattaaactagtacgcagtaccagcagctgcaagaagcccgggtgcacgttttcttttgcatccagagcagccaaggacgcaatggcagtaaaagataggtaaggtggggactctctccctttacttattatccttcttgatctacaggaactaagctaggcaaattccatggcgcttccgaagaaggcagacctgagatttccacatgccaaaaggttaggatgccaagtgccaataagactccaactccacgcttgattccgttcatcggctgtatggtcagctcgactgtcgatcgatcccgtcaaaattgttacctccctctcaagttacatataagtaaaaagttgttatgttttaagacaaatgtgataagtaaaagtttgagaagagaatctcgaaggaaaaagtatgaattacccccctgaattattgtggttgaccgaattatcccctgaacccgaaaaccagacatttttcaccctgaactttcaataccggacgatttacccccttcgacccaaaccagagcggttttgtcctacgtggcgcatgcgtggcaatccagtcagtattttctctttttttttaaatggtggggcccacctgtcatatataccctctcatctccttctccacaacccctcttttactctctctctctctctgcaagcaggggcagctcgcgacggcgggtggtcagcgcgcgcggaggcgggcagtcggcggcgcgcggcagcggagcccgacctggatagctacagcccaccacctgggatgctgaggcgtcggcagcgtgggacagagccagcggcaaggtggcggagctagtgatctgccccatctacgccaacctccccgccgagctgcaggccaagatcttcgagccagcgccggcgggcgcgcgcaaggtggtgctcgccaccaacatcgccgacgccgagacgccgtacaacccgcgcacagcgatggagtcgtttctcgtcgcgccggtgtccagggcgtcggcggagcagcgcgcctgccggtcgggtatccaggtccgagtagcagctgccgtagctaggtggctgggagggtgaaccggtccacgccgccgccgccgcctccgcatccagtgccgccgccgccgcctccgcaactgctgtgattgacgaaacgttgggtgtgctttatcgatcaaatcgtgtgttaatccccatttg

SEQ ID NO: 23810 - DNA, 29699 bp, Oryza sativa
tgcggtgttcgtctcgatctgtaacttcaaccagaattcccaatgccttccaaggacaagtgtgtgcgtgcgcgcatgttcaacaccatcatatcactatctaaaatgtgattcctccgcatcacatcgccgtcgccgatgcggacggcgcaggcggtgccggccttgaggcctcctgctctgcttccaggtcgaccgggacagcgacaccatcggggcgtacgtgtgcaacccaacgacaaggcggtgggcctccttgacgcagccggcgaccccgtggccccgcagacacgacggcgcgttcatcgccttcgacccggccgtctcgcagacacgacggctggcttgtggcgtggttggacgtacgccgacgctggatttgctcataccggagtcgtcgtccggagaagacgagctagcgccgtcgccggaggagaggacgttgcttctgcgcgtgttctctgtgtcccacgctgccgccgcctccgcatcccaggtcgtgggctgtagctgccaggtccggctccgccgccgcgcgctgaccacccgtcgccgtgagctgccctgctcgccgagagagggagagagagagagagtgaaagaggggaagaggagaaggagatgagagggtatatatatgataggtgggccccaccattaaaaaacgagaaaatactgactggattgtcacgcatgcatcgggtaattcgtactctttccaatctcgaaacccatgcaccacgaatctagagagatggagtgcgccatcacaccttgcattggttttacacgagtttgttggatggttgcgtttgaccctgtcctcccgcatcaaagctcataagatggaccaggtcaatcttcagtgtgtccagcagaaacaatttcttgtcagacatttccactgtaaactggtagcagtaaatggtttttgccggcatccatttcgtttggtcccgtctgtagatttttcatcggctgaaaatgacaatgcgtgtgccaggattcaggattcaggttaaagctgcagtttcctcataattaaaagttttttcaaacaatctagtttttcatccagattttagaaagatgtagtgatagaatttagaaaatgaactaaaagttttatcaccagctgaatttttacccactgctccttaaaatctatagcagtagttttcaggtgtgccgaggacagccaagagccaacaatctaggataagaatggttgaataatgctgctctgccgtatactgtttgaatattttgaccgtgtcgagtggcgatggcgacttgtgtgatgacgacgtcgttccattttcacctttgaggttttgatcgagcggcagtgagctgtgtaaaagaactgaattcatgacaaattggctcgttgctctcgtgtgtatgtgaactatgaagacccggaaatactgctcctgtgttgggtttcctgtccaagctctgcactgaaactccgacagactcacagacagtcacatcccgtgcgtgttgctcgttaacgatcggtgtcgcgtccgtactacactataccgtaccagtgtaccacacactagcgcgacaactcgtcgttgggtttcaccgttattgcttcgacaactcatgcttattatgcctctcctgccgtatcattcgcttcccgtgcaaaggcaatcatagagcccaaccatctccatctgaccgaagccggcagcttttctttttcctgcacgaggggctagtgcgtaccggagcatcggtcccgatcggatcaccgggcactaggcgcggcgtagattctggccgatctagtccagcagtccagcccaccggaacaaaggcttcaggtgtgtgcgtcaagcggaaagtgtattcaactaaacgttggaactcagctattgctctctctcgaagctccctctcctcaaggtggtcgctgtcgccgtcaccggcgctggctactctcgtcctgttgtcttggtccttgtcgtcggtgagctgaggcacctgggttcttcccctagccgtcgtgggtgtcatcggttttgcacaaaagaaggttacaccggcctacaatttcatctctgccaagcactatccaagccaagcagcctcttccccaaattccgacaagagttcataaagagatggttgatggaatccacaagtttgccgagaggccctcaacctcccattcaaggaggcccatttggatatgtatcttggctcccactgtgcttttattgttatctttgctggtgttttggatatagctgtttttcgttgtgcctattgttatgttgatttctttcaagaactcaagtggaaatcttctgtggagatgccaagtttttctcttttcggtccgacgcttcaaccttcatctttgggaggcccctccaaggtttgtgtgtgggatctacatcatgcagctcacctttctacaagcaccaccgaagctgagctccaagctaccgtcgttggcggttggcgtcgacagcagatcgacgagaaggacctgttgttttttctacttatgcgtaggtctttttctacaaaatgttgtacatatttgtaatttggtcattctagagggccctttctgcaaaactggttgtaccccagtaaaccgtgctatatccgccattccgccctgctactcgtgtaagtgtgtaacttgaccctagttctcttagataaatactccctccgaagacgttaactttttaaacatgttttatcgttcatcttatttaaattttttttaaaaaatatgtaaaattatatgtatatataaaattaaatttaacaatgaatcaaatgatatgaaaagaattaatagttaattatttttttaaaaaaaatgaatgatcaaatatattttaaaaagtcaacggtgtaagaatatttatgtatggagggagtacatgagtttaaaaaaagaaaaaactaatcgttggaacctaatttcgggaggaggagatttgaccaccccgctgtctcgcggaccacatcctccagcaaaccggcttcgctatttgccagaggaattctgcgtgcatgcagtgatgcagtgacggaaaagcgggagcacattggtactgcaatggtaaagtaagatgttatctataaaacatgtacatctcagcaatagactaaattaatagtaaaccacctcaatagtatgtctacatgggtatctataactctctaatccattgcctcgtttttctctatagactatctctaggttagtagataactttgctctctctctccatttaatctcttccaagtaggaaaatatgctgacatggatctcttgtagagagcatatagataaccattgtgggtgcccttagtgtctgtctttttctttacactatcgctaatggcgactttggatgctgacgaaagggcacccggagtactatatggtggctaagattccgtcgaaatgatgatacagcgctgataataataaagaagataagagcaaatataatagagggctataagaaggctgaatgctgatgtggatgagagaggagaggagagagatgagaagcggactgtaagtttacagccggcttaggcacaagaaccaagaaaatctgtgagacagacaggtagaccatatatttatagtgaagagttaaccattatatgaatgagctgatagataggctacaagtaagcagctggctgtattattatccttgctctaaaggaagtttactagccgattgattgttcattgtcttgcagaaagtcagaagctatatgggcctaatgtattattacgctttcagcccataacttcaggcccgtatagatctcaataggaaaccgacagaatatccgaggatggcgggccaccgactcgattgaacaaccccatctgcgaggtccagggatacggatgccggttggctcctcttccgcgactccggcgacggaatccctcccccgaaggagccgttcggttaatcctgagacagagattaaaggaaatttattggaattattctctcttaatccccttcaatcatctttaatccacttcaaaccgaacaaagcctcagggaagaattgaaacggatttattccacatctattgtggtgtggaattattcccgctcaatccttctcaataccgaacaagaccgaagcgagctatttctccgtttctttcctaaactctagctacggtggtgtttgaatctcctgaagataaagatgaagattaagtattttacgcaaaatgaggtgataataacatgtgactaattgggttttagttattacaaacttgaaaaatggattaatctgatattttaaaacaactttcatataaaagttttcgtacgaaacgcaccgtttagcagtttgaaaagcatgccatgagtatctaaggccccatttggccatctctagctcccactccaacttacgtggaaccaaaactgtgccaaacaatctggattctctatttttagagcagagttggcatagctacttcacaaaattgtactacgggggtggagctgggtttttctgctccacagctccactccaccccaaaagacccactactatttaattttttagtgtactagaaaaaatacccgtgcgttgcaacgggtaaactaaaattataccaaatataaaatattatattattatgttgagttttacattatatgggcctttaagaaaatatatttctagagaaataatgaaggttaaaaaaaagaaagaaaaggcctctttagagtatagacccgccggtctgctagtgcattcgcgcgagtggcccaacagcccagcagtgttgcggcccgggaagagaggccggcccgacacgggatcaacctgagccgttcattttcatcgatggctcggatgattctgaatccatcaaaaccgctaaccctaaccctcattcgctgacccctttccttccccactgcgacccacctccctccctctctctcagcgcgccgcctctccccctccctagcggcgtcgctccccctccacccaccagcggcgccgctccccctctctcttcctctgaccgtccttcccctcatcctctctctcgcctctcgtgcgatgggtccggcgacggcgaccgcgggtggatccggccgcggtggtggcggccgaggacggatctggcggcggcggctccgtccgacccctctcgcctccctcccacggtggatctgacggcactgacggtgtcggccccatccccggtgtggcgacgcggctaggagcggcggtgggctcgggagccggtagcggccgaaagcagcgatgcggacaacggcaacgacggtggcggcgaatgacgacgaggagagcgggtgtgggaggcggctagttttttttttaatttgggatgttgattttgtggggattcttgattttgatttgggattgcaactgagtgattttgtggttttgggcaaaggggttgggagcaatcggttgatctactcgtggattttttttatggtgtatttgagttcttgtggatctctcttctgactttatttggttggattagagtccgattcttttatcttttttagaaaaatcgcaaaaaaccgcacggggagggaatcagactgcgcatcgcattatactcggacgacttacaaaaatccctggcaaaaacatcttaaacttatataatataggtaaaaataaagataaagatagagtttttataatataatagagaagagatatagattaaaaccaaaacataaaattaaaactgacttaaatacggatgataaaccgcgaaaacatcttcaatttttataatcgaatcaaacacggatgacggaccgtagaaacatctttaatttttataatagtagagatagagatagagatagagattgagattttcaccacaatgccactgaactatcccttcataccacatctcctccagttctctctcctcctccgtcttcctcggtagcccggcggcggcgtcgttggcgtcggcagcggcggacgggtggcgcggcggcgagggccacgggcggcaggcgcgcgggcggaggcgcggggtggcggcggcggctgcgcgcgggcggtggcgcggggtcggcggcgcgcggcacgttacagaagaaacaaagcggacacgtatctcgccgtcgtctcccgctccgcacgcaagcagcgggcggctgctgctccgcgcctccgtcgtgtggggctcgcgagagcctggaccacggcggaggcctccaccggcgttgctcgccaccggatttggcgtgctctgcttaattgggccgatctcaagcccttggcggaacttgcacttctcgacccaaaaacccaaacaaggcataattgggccgattccctcctatattctcgtttcccgcggctcaaccgctcatcaagccctagatagtgctctctctctctctctctttgctcgattcgccggcgatggcggcgccgccggaggcgacgggggcgccgccccagactgaaggagaggaggttaaggatggcgtcgaggtctgcgtatttgacgagtcaccggaggtcttctccagagcggtgcacgccatctcggagctcacaaccggggagcacgagccgaacttccctgacgccgaagtcgagcggctcgcctcctcaataactttcctcaggtgagaaactccctccttgctctgtctaatccggtacctaatcaccgcggcaaaattggtaactttctgttgttggcctatttagctgggtggagtggacgaatttgtgtttaatagtagcgtttatcagcaaagcattaatttgttagtcattgatgcaatttcacggagctttcaatgggaaaatttatgtggcatgtaagctctctgtagtttattcattgccttatgtgccacacacggtggcaaattttattggaatttgttaatttagatcctaagacatcgctgccacacaaacagaaaaaaagcagttgtcacaggaatgctttggtgccgtttcattattcctgttgtggctattagaattcatttggcttttgccactgcaattggccatattcttacttccagtgtccttaggtaacaatattagctcaatgcacaattctgtttttctattgattagaacgatacaaggattttttttttcatgtcatgaacaaaatgcagttgcactgttacttgttttattactaattcactaagtttaagtcacttttgttctggtagatatatttccttaatctgtactcatttgttgtttgatgactctgatcgatgatcatttatgcacattgtgactttctagcttaccatttgatgttatggtttaaggcacagaggagtagcgaaacttgatccccttatctataagtcactaagtcagtgagccccacctttatttgtgcagactacttgttagctgttactttgtattcaggattggcagtttcagtaacagctttagttattagcaacctatagtagcatgctataactagttagtactctttgatttaatcaccaattaaagtagaagaaaaaatttatgtgcccagtgttcaccagaaagatttttttttttaaaaagcaccactcactgtgttttagcacccaccaatataaggatgttaaactcaactgagactgatcagctggtacagccatacaaaggctgctcagaaccttagctttctagtatcatccatctcactgtaagctgatttgcatcaattggaactgcatagtttcaacgtgctgcattgttggttctcctccatgcccattttaaattttactgactaaaatttctacattgtcacatatacttgctccctaagtgcaatgcattggtttttatccaaatgtgtcaagtgtcaactattagcagttcacattagataaattatctgcatttattataaccattagccttttgtccaaacagactatctgcaatgattgaatttgtccactgatagtgttagaccactttccttggcatagtatagtctatagttgggtcagattttaggttcgccgtgttcagctcgcttatgcacatgaggacgactcctttcagcaccaagagtaacagattgtggaaagttctaacagtcattctgagcatcaattaaatggaattcacaagctgctttttcatttgtctaatctgattgccttctttttttttaaaaaaaaaatcaatattatttagtacctaatctgctagttatttcatatctttgcagagaatggaggcacttctcttatgagccaaaaaatgttagtttcacttgtgacgccagatcagctccatccagagttgacacacacaagataaacttaccacagttctcgtctgcatctgtcccccaggttattactcagttgctgttggtgccttgcgctaagttcttgaggctatttttttgttgtgttcagctgaatgagatttcttatatcatcttttgttccttttggaccatattctcataattaagttcggatcacactgcagatcacacacctagacaatgggaaggctaaaacagacaggtattgtttatggagttctttctgtactactttagaatcttgtcaatctagttatcttgttgtctgttttttccccatatttgtcaataaaggtcatactgttagtggagataggctatgttaagtttctcagttgatattaggaataacccaagatgtctgcttatgtattattttagctcctttggcaattcactagttgataatttgctgtaacatgaccaataagcagactaattgtcaacatatattgtattcctgctattggttagtagttttcaggtttcagggaatacctcctttgatctctttgagtaggtcttctatgaaacacgagatgcgggacttgaatcttattttgaaagccctccaaacttgtttaaagatttcagtacagtctccaaaactactaagagtatgctagttattaaggtttcttaaattgactgcacacacttcaaaactactaaccacatcaacttgggagtagtgggtcattcttttggtccagaagaacaatcgtacattgggtttggcaaacgtgccaaaccttcttccttttctttttttggggttgggggttgtggggggttgctttttttttttgtgattgatgaaaatagatctgatctaatactatttttgtgcctttgcacttctcattttatttagtacctgcctcacagtgtgataaacactgttaatacttttttacctgccatgtatatattctttcacttctccttgcttttcatacccatttgactctatgaagccatcttgattaaattatgtttaataattttttagcttttgcagctcagatttcgttatatttgccggaggcaatgtttgggcgttggactggtgccctaggttgtgtgacaggcctcattctcccataaactgtgaggttataactatgataatactgaaagttttctcttgttgtggcttcaaaattgtttatgcatcagcatattttttgttccaatatccactacttgctgtgactatgagtatgatgagtgctctttagttcatatgtcaatgggaaaattaacatgtttcactgagtgacatactttatggtgacatgaatttaaagacatctcttgcagtactccccacgtttacttttattaggcatatttggttttctgtattttttttcccattttagatgctcacaggaatcaaagtaaaatttctcatcttttccaactcttgttaaagcagtgaatctggttcaacatttccagttctatgtgctgtgcattgcaggacgataaaatggcagtttacttcttttttacttaataaaaccttgcgctgagataaagcatgtataagaaaatgaccgaagggagttcttcccaaggacatctttgcatgcagactaattgcatgattgcattgaatgtgcggtgtctatgaaattagtattatgttctttttatggtttatatcttcaagtatttgctggtttttgaaaaaaagtatatgactaagagtacaagttattgagagctgataaccttatttgcacgtctcctatacattgcagtatcttgctgttgctgctcaccctcctggttcttcttaccataaaattggcatgccgttaatcgggagaggtataattcaagtttggtgtctcctagcaccatctgaagagggtcatcctcatcagtcattggttgcatgcaataaatataatccatccaatcaaccaaaacaaaggggtagaccaagaaagaccatcacaacttctgatgatcacttggaaccaagtgtcaaaagaccaaggggcagaccaagaaaatatccactgccaattgccaaagtggaagattcatcccaaaacgacagaagtcaagagtttgctcttatttatcctcttgtcagtccagcagttgtttcatgtgacattgcaatagcttatcccatgccaactgttaatcctgtggaatcaactccaagaaaaggtagagggcgacctaggaaaaaacctgttgaaataaaaggtttgtctggcattaaactaacagaagacttgtctacagctctatctccaatagctttaacctgcatggagcccaagaaaaaaagggggaggccccgaaagtatcctgctccaagcaacagcaagcatcttccaggcactgatactgaattaggaaatgattctgtctgtcagcctggttcaattgattttggtttgggtcccactgaaaatactgggtctggtgctaatataactcatgctgcagttgatgcagcctccccagttccattgtcaggtcagaggggtagagaacagccagaaaaggaagtaattcatattgagaattccatgcaatctggacagtctgacataggatccatgttgcctacgtatattttacctgaatcaggcaacaagagtaactcaactggtctgaggcggaggggacgacctaggaagaaaccatttccgagtacaaccagttgtgtatttgttcctggtactgagaccccaaagaaaggttctactctgaccaattcaaataatctcgtggtcttggccaagagtaattgtgacattttagcaaatgatattggtccatcaagctgtgctatagagaacagtgtccatttgagtgttggaacatctcatgctgcaacaccagcacagggcatatgtcttgcaaaatgcaaggaagaatcaagtgccaagaagggtagaggcagacctagaaagcagccaatttcaacggaatgcggttgttctaaagcatgcaggggtgaagaacaaaaaactcagacaattcccaagtcaagcgacaatgcgtccttggttgaaaattgcaagaaagaatcatgtcccggaaagggcagagtgcaagataaaaagaaatctgtttcaaatgaaagaagttcagtagtgcttagtgttgaagcacagaacatggacggatcttctgcatcaactgcatatacttcatgttgtactcctgcttgtaactttgaaaacgcagagacaaatcaggctgtatctgttccttccgaaaacagtgctcaggttattgatgaactaaaagatacagaagtggctcgattcaaagaatcaactaaagatgataatatgatttgttctgcagaaaagaccctttctcgtgtcccaaaagacatttctctaccaagggttgtcttatgtttagctcataatggaaaagttgcttgggacgtaaaatggaaacctccttcagcaaatcagtcagaacataaatcatgtttgggttttcttgcagtactcttggggaatggctcgcttgaagtgtgagtgtatgctcttgtagatccttatttatctcatttaaatatctatcaccccctcttatcatcttgtaattcatttttgtgcacagatgggaagttccatctccaagcatgattcagaaaatatattcctcttcttcaaaggagggtactgaccctcgatttttaaagctgaagcctgtgtttagctctgccaaagtaaagtgcgggaacagacaaaggtattggacctgtagacttttttttttgctagtagtagctcaaactaggtggaagatttggatatatttctaaattcctcagcatgaactttaattttgaagccattgcctctttataatggtaaacagcattcccttgacagttgattggtcaccctctcatgatatgatattggcgggatgtcacgatggaacggtaccttttccttacccagcaaaattattttcttaacataaatcctgtgacctttgagtctttcaagttgctgttctgaaagttctgtgattgacttttttttatattccaggttgctttatggaagttctctgcaaacctgtcatttcaaggtatttagatagttttgccaacgacgtcactcttatcagttatcatttacactttgcctgacaacatgtctgactgtagaactgctttattggtttaaaagcaagttactggagttcccaaatcttcgcatttcttattctgttctgtttgcaaacaaaactaaatcatgcgttctgttgataaacaggttcaaaaccttttatgtgtgtaactgctgaatctgctcccatcagaaccgtgtcgtgggcaccatctgtgaggtagccagttgtactgttacttctggtctattccaaaagataatttttgagttttgactcttgtcattctgtcagtaaggaaaacgtgaatacctttgtcactgctggagaggatggtctgaaattctgggatttaaggtaggtgttggccttgttgtgaactgaagcaatgtttaaagcatctttcaaactactctcctatcctgcatgaatttctaatattatgtatgggtcctcagaggtcttaacattgagggtagtctctcccccttcctctctgaattcgtggcacccaccaatttctgaaccattcatatttgtttctgtttgtttcctaatggtaaaaattccgagttaacaaacaaaagataggcacgatatgcagaatatgttattatcacatggaccaatgatgtcagtaggagtttctttatgaatccagtgcgatatacggtttttttctttaatttttcaatgggcgctaagaaacttgttctagaagctgcagtatgtttgtctaatagatatattgattgttatggttaaatcactacctgtcacagccgccttggatttgctgttgttttctactgtttttgttttgtaaatttgggaattttagtgcatctcataagatttctttgctgcagagatccatatcgtcatctttgggagttaactactgctccaagggccgtaataagtcttcaatggttgaaggatgcaaggtaatatttgttaagcactaaatgtacttgtttttcttcattacacaagatttttcttcactaacatggtgtttacgctgttttccttgtctttgaaacactgcactaattttaaatggagatgtatgttttcattaatgttggaacacatactagaaaccatatttgctattgacaattgttttagtcatgtaatttatgttcttagcccgtggttcataggacctgtacttctctgttattgtgtgctaaggtggatattgtctttgtttatataatttgttccattaaatcatcagaatttttttaagcaattctacttgcacttttttttttgcaaacactctatttgcacttgttacataattattaatataaatgtttgtatttgcccacgtaccttctaaatatgcaagcttccttcgctggacatggtcttgatgtataactggatcaaagtagacgtgattacatagaccacattgtttcattcatggtgatattgtgtgtatataggccagacatacccttttgtttactagaatggtaatgttaactgttatatttttatctttgtgttcagaggtgttgtcatatcattggaagatggcacattaaagttcgttagcttgtcaagaatcgcaaatgatgttccttttactggaaggccatttgttggaacgaaaactcagggtgtttctacctatcaattgtctgaatatttgatctggagtgtccatgcctcagaaattacaggtgcatttcacctcatgtccaaccatagtagatgtcaagtatcggaatattggttatagcctatatcaatatttagttccccacatgtgagcagagtaaaaatgtcaaatattcatgataattcatgaatttgtaattttgttttgctgatatccaggctatgcggcttattgtgtggctgatggaactgctgtttgctttgaggtaaactaaacagcacatatactattgatttatgcatgctattgtgattctctataacattgctaaagaaatattcaacttactgtagcttactccgagattctgggaaaaggaacctgggaggaaccgtgtaccatattttctttgtggttcattatcagaggagggaacaaccattaaaattggtatcgcattaccaaactctcctttgtcaaatgttcctctggggaccaaacgggctactaaaacttgcaaagatgtagctcaattgcatgttatagaagaagggaaacttcttaccaactcaggtaatctctgtcacctgcaacttgtatcattttgcttgtacctgacatgcctgcttaaccaccatacagaatacaatggtgctataaatccgagcatcagagatggtcaacaagatgaacctgatgaaggacaagaaaccggtgccatagttttagctgctccttcaatgcaagagaattttgacacaagcaccagcaggggtagtgaatcccctgaaaattttgaggtctttcctcctaaagctgtagcattgcatcggttgagatggaacatgaataaaggtagcgagaaatggttgtgctatggaggtgctgcaggcattatccggtgtcagaggatctaagaaacaagagcacacttgaggaatctccttgcatatcaggaaaatctgcatgtgtccatctacacaataaactgttgcatgctgtggtatgtttcatccgtttctttcctctactgttattctgatcaccgtgtccattttgggttgtatgtattgacttcttgcaatgtgcttgcaatataactgattatctttggaactcccgacagagctgtatagccttatggactgaagctttacctgagctgcgaggttctctgcgttttgggaccagcaattcattgcaggttggtttgaaaatagaaaatactgtcactccatgcgattcttcctcgacattagtctgaaataagtgcaataagtgcctttggcgatccagattcgctaaatctgttgtaattgtaattgtaattgtaattataattgatagctattcttattcatttccttaaacatattattgatgcagctgaaaaactgcacgatattaggtggaatttcatgcatcgctgtttaagttttggaagtcatacagccttgttgcttcatctctttttaaggattgttgagttgttaggctgtcgaagcttttttaaacaaatcaacagcaacgcgtcgaggcatttcttcgctgctgtgctcaagttctcgtagggagcacgaccctacgacataggagcatttctgtccttgctccttaccagataaagagatctgatgtatctttgttaacatgatatcataacagttgggtaaacacataggagcattttcattatcggagagagaatctggcatatttacatttcacttagctgtctttatcaaagtgatatttcgggtgaaactgcaggatgaagtactgtacagtagtaataaacgtggctccccttaaaaaaagaaaaaaagaaaaaaaaacgtggcctgttaacatccctaatgtcaatgttcagtgtataatacaactatacatgcataattcttagtcgctcaatgttcagtgtataatacaactatacatgcataattcttagtcgctcaagttatcctcatcgactacaaaatccgtttgcctcatgaataattctcagtcgctccagttatcgtcatcgactacaaaatccgtttgcctcttgccatcatcttcttgcagaggcttagaagtgctaacaatcaaatgcctaaaaaagcttatgcgataatatcctaatatgcccgactactcctaagaaatttgaatttgataggatataggaaaattctacagaaagatatatgataacaagaaatagaaaatataccatttcagtaaacgctggagttgatggagaccacacaagaatttgcatgtcattgctgccagtataaagctcctggattccaaaagactcagcagtggtattgatgcgggaacattcagggttaacagaggataggagtacagggaagacttacttgttcttgtgcactacagtagcagcaattaacaggttcatagtgcccccggaatgtttgaaatgtcataccagaccataaattgtacgcctacatgaatatggcaacacaaggtgaagtctaaaattcagcgtccaaactgagaagctaaaaaatgacaacacaccttaatgcttgccatgcatgggatgaatacaagtgatggatcctcagtgacagctaattgtagcggtttgctagtctgtaatcgcatagcttcaaaattgaccaaagtattgcagcctgaatcaatatcccaaagtcttaagcgagaatcagaacctgaagagagaggataacaatcattaatgcatactgcatacaggcataacaagaagatagccatagacaataattcctttcaagcaatagcaatcgaatgctcatagaaatagcaattaaattcaatcaacctgagctaagaaggtacatcccatctgtagttgttcttaatcctgtaacagcaccataatgtgccgttgcacaattttgactagaagacaaaccagggtgcaatctctgttggatatgtccatgtccagggatttgacttttgtgcaatttgtgtgactgtttcttactcttgcctgtcctctgctgtgcagagtaaatctttgaagaagatgaaggttgtaaagagttcaaaggatcctggtcaaaattaaaaatgaatacattgatcatttgcacaactagagtggaaggctgagtttgcgcgtcatttctaggacacaacaatcaacaagaaacaatgtatgcagaccttatattgtaagaattggagcactaaacataccatagcacctatatactgacactaatatgtgagacaaacctataaattaatagccgcagaaatcagcttttacttgaaggctgactgtattgatctagcattacagccataatattttacttgaagctgtaacatttttgaagcttttgcagaaaataatagtggaagtccagctttagcattgcaaccaaatattctgaaaacaaatgtaagtgatggataatggtgaccatatcttatctgaggtgccctcaagaaaaggaggccgccttcctagttgagaccgtgactgatcaagaacaagaaagcatccagctcgtcttatgtcccaaaatcgtattgctccatcacaaccaccgctcatcaaaatccactcacttgaagtagaccactccaaagacatgataccatctgacatgtcagataccaaggataaggtggtaaccatacaaacaaagcaagcatattttcatcactgcactagaagtaagaaactaaccacgatgaccggacaacgtgtgggtaaaggctccagaagcaatgtcacataaatggacctgaacatccgcacttccagtagcgatcagcatatgtgttgttgcaattggggacattgctgcgctatacacttttccaggcatcttaaaatccattacgacctaggaaaagaaagccaaggcaaaaatcagaacatcaggatcacaccgttgccaccaccaaaggaggcaagagaaaagaaaaataagcaatccacaaagcagatgaatgcatacttgagtcgaattagtatcccacactttgacatactgatcaaaagaagctgtcacgaacagcccagtgtccacaggataccatacggccatcgataccacgaacttgtggccattttcatgctgcttgtccacaagcagaatgctcctgtgcttggcaatgaacccggcttcgtattcggttgcattctgcacatcgaatatagcggctgatccatccgatgcgccagcgagtaggtaccgccgctctgtcaaatcaacctgaccatattgtgaaattacaaaacaccagcgggagcgactcacacattgcacatcaaatacgccaagattccatctacgggggtgtacaaatcaaattgatctaagcctctaaggtgagagaaggaaaaggggagtgagggggaagaagggggtggacctggagggagttgatggcgccgttgtgcggggtggtgaactccttgcggttggagagcgcgagcgaggcggtgcggcgcgcccgggcggcggtctcgaagcgccgtgcgcccagctccccgtgttccctccacctcaccgcctcacaccacatccactcggccgcgcacggcagctgcgtccctcttctcggcggcgacgacggcgactccggcgggcggtggacggtgcggcgcaccggtgagggaagagccgcgagagcaaacctgggggtggccaggcaggagctatgctggccgaagatggaggaggattcggcggttgcgcttggaagcttccattaaattgggcagacggctcggatccttccatgttcgactcatccgccaccacccctccgcctataggcaatacgtacctcctcctacttctccccttccttcttcccttcttctcttcctattacagtacaccactaattttttttaaaaaaacaaaagttagaaaaatttatgtatagaaatactatatataaaaaatttgaatcgggtatgtaaacttttgacttataaactttggatctataaattgtaggtgtataaactttagatgtatagaaatactatatatagaaaatatttgaattcaaattcaaaattgaatcagatataattcaaattcaaatttgaaacgggtatataaacttttgacttataaactttaggtgtataaactttaggtgtataaactttagatgtatagaaatactatatatataaaaaaagtttataaactttaggtctataaaatttgaattcaaatttaaattgaatttaaattcaaatttgaatcgggtatgtaaacttttgacttataaactttggatctataaactttaggtgtataaactttagatgtatagaaatactatatatagaaactatttgaattcaaattaaaatttgaattggatataattcaaattcaaatttgaaacgggtatataaacttttgacttataaactttaggtctataaactttaggtctataaactttagatgtataaaaatactatatataaaaaaaaatatttgaattcaaattcaaatttgaattggatacataaatttttgacttataaactttgggtctctaaactttagatgtgtaaacttaaggtgtataaactttagatgcataaatttactaaaatagaaaagtaatgcggtgaaaaaaatggaaaccaggtgaagggagagaggggggagggggcgcggggcgattgctacccgatgggatgggcgatcgatcgcccattagagtttccgctcatgggggcacctggtggatgtttgtctctgaatgtgttgtggtgtgaacattgagatactaggtgaaaccccgcgcattgctgcggaaatttagtatgataacaataaaaaaataacgtgcaagatagttagataacatcaaattaagtaaattaatatggtttatgataatttaaatttaaatagtatgtagaatgttgattcaaacgtaaaaagtaaggtggcatgactttatggaaaaagaaaagcagaaagatagtttggaccgtagattaatcatctaaaggctaaaaacaattgatgtgatatgacttaattagaggaaaaaaggagaaagataatttggaccatagattaatcatttaagcactaactaattaaggatgaactatataagtatataggatatcataaaacataataaagatatacattgaaacattatgtgaattatattggatgataatttaacatatttgtatttgaaaagctcttaaattataaaaactataaagatatagcatgtttgcatgatgtttaaatgtgatgattgttagtggatgatgatgtagcattttgttaattagtggatgatgatgtggcatctttgcatgttaagcttaaggagttagtgggggataactttatactaagataggatttacaatctctgctattataaaaattgaaaaaaaatttaccggtcggtattttggtacgtcacccgtatttaagtaggtttttaaattcattcgcttttggaaatatagatctgtgtttgagtcggattttaagttcgtttgcttttggaaatacaaaagaagtcgtataagaaatttctttaaaacaacttgcatgctaacttgagatgaaagccagactcctaactgtagctcatgattttctaaaaaaaatccaagtgaattcccatagtgaatttcatcctagctaaaccatataacaataataagattaaaatagcttttacccgttgcaatgcacgagcatttttagtataaaaaaatacacatgcgttgcaacgggtgaatactattttaaccttattattgttatacggtttagaaaggataaaattcacggtaggaatttgcttggatttttcttttagaaaatcacgagctacaattaggagtccgatttttatcttaagttagtatgcgggtattttctaaaagagatttcttgtacgacttcttttgtattttcaaaagcaaatgagcttaaattctaactcaaacacatatatgtatttctaaaagcgaaggaagttaaaaaatgactcaaacatggatgatataccaaaataccggttaaaacatctttaatttttataatagcagagatagagaagtgtttcgttataatatcattgtttgaatgggcttgatagaatatcataagttaaacaaagagtgttcgcttagttccttttattattgaaataaaactaactaaatttataccaccataatcttcgtatatatgacgctggctagttcaaactagccaatgtcattaaaagacctagagggagtaatatagttaaattttatttactttattgttaaaataaactttatcaaactttatcatggttaagaataaggtgttgttgatttcttttttaacaaaactgactaggcatttgcttgttttgttatcaaaattgcatttggctttcaaccatgccaatcgttttatattctatatagtttaacattgcataaatattgacttagcaaagttgagctacaaacagggtttacgattccgacgaaatccgatcggatttcgtcggaatttcgatgtttcgacgagactcgaaagtagaaaccgtctgagatattttgaggagtttcatccaaattcaaatttgaattgataaaaaataaaaaatcttataaatactattttctccgtttcacgatgtaagccactctagtatttcccacattcatattgatgttaatgaatctagacatatatatctgtcggtgaaatgggcccaggggtacgcacagtaaagggaaatatctttcccatctggtcgcgtggccacacggcctcgtttccccccgcccctcgggtagagaggtggccagggagcctcggggtgccacgccgcacccctcgggctttcggggcgtgctaccccggggccctcacctggccaccacgtggcggggagaggaggcggggcgaaagacgatgctccgcgcctttaatgcgcggtaccccaaccgtcccacgccgtattcaatgcggcgttgggggacgtgcggcgccgctcgattgacccatgtcaatcgagcatgaccggcctgtgaccggtcacaggcgacgggacggagggcagtgcccccacgttccaccctgtgtcaggcggagtgggggcaggtgtgccctgtcccgtcggcacgctgctaggggcgccccacgcgcgtgatgggccgccgaagccttcatacaattaatagagaatgatagggatgtcccccgtgtcaggcggaggacggcgttgggccccacctgaagccaggcgaccatgttgcttccggttgaagcaaaggatagcgatatgattaggaccatgtgggtaccccttttcgtggggggtaggtgcaaacggtgcatgtggtatccccttgaactataaaaggaggaccattaccaccgggaaaaagggaggactcgaggagaactcaagctcgaaggaagaacagctaggtccccgtcggagcttgaaatcccttgtaaaaactcaccataatcccacacacaggagtagggtattacgctcggtagcggcccgaacctgtataatcctcgatctcccatacagtcccgacaacgatcaagcagctagactgcgagcggaagtaaactcctgtcatcgcgccatttcccccagccgaactcacaaaagggggtctcacgaccacctactagagaggatcgctcctcgacaatatctatctagattcattaacatcaatatgaatgtgggaaatgctaaaatgacttacattgtgaaacggagggagtatgatattcatagaacctattgggatataaatgttcgaaaaatgatgtattatgtatatttactgaaacttacatcaagaaagaaaagaataaagaatttaaaaaagaaaacaaattactgatcgaaattttgatgatttcgatcggaatttcgccaaaaccgaccggttttcgagaacttgccggcaaactcaaggatttgtattcaaattttggtttatgaaatttgttcggaatttaccggttttccaccggatttcaaaaatttcgaattccaccggtgtccgaaacgaaagagcatgtcggaatcgtataccctggctacaaaccaaaccaaccttgtttgccgaattggatttcagcacagttggtgtcccgttttgattcttgaggcccatgatgtagcaaatactactgctaccagaggagaaaaccgtcaaaccggcatagctcctctcaaaaaaaaaaaaggaggggaaaaagaatcacgacatatagctggtagctccggtccaaactccaaacccgcccgtctcctcttcggccgtctttgctcgaccggagcggagcgcagcgcaggccaacggcgtggacgacgcgcgccccctctggatcgccgctcccccgcgcgccacagcttccatccggcgactgcaaggccgcccaagccaagaggttattattcgtcttccgctccatgattccctttttttttccctgaagatgattcgctggatgctttagtagtttctacctcgctgtttattggatccgttcaattcgtctcctccttgggacgaaattctcgcgtatgtggttattgggacgaaattcttccgagtattccctcaaaaaaaaaacttccgagtagcctagggtttggggaaccttttccacgatttttatcatcgtgtcgattagttctttaggtattagaccgtccattcaccgattcgaggtgcacatattttgtacttgcaaaatagggttaaatcatggttcgacaagactgttagcctgaagatgcaaaatacctgtttaagttgtgctatttgtgttcaacacagttcctttatagtaaggaatatatagcatatctgatgtaaggcttcaatgtggggctaaattctatgtaatagtgtgtattatgttcttataatctcttgagttcgatggaagagcttgaccgtgcaaatgtattgcattgtgaatcttacacctactctatgtcctcagggtttctttgcaagctttagccgctcgacgttcattgacagaacatgcctaaaataaagacaagccgtgtcaaatatcctggaggatgggagcttattgaaccaactatccgtgagttggatgccaaaatgagggaaggtatgacatatgctcccctttcagatgtttattgatacttctgctcttatatggatactaatatcatctactcatgtagctgaaaatgacacacatgatgggaagagaaagtgcgaagccctctggccaattttccgtatttcccatcaaagaagtcgctacatatatgatctttattacagaaggaaggagatatcaaaagagttgtatgagttttgcctggaccagggttatgcagaccgtaatctgattgcaaagtggaaaaaggttagtattcgacccatgatttgctctgtaagatgcccatcattccttatactctgtgctagtttagtaagatgccttatccaccttgtataatctttaagactttaattaacttgtgtacaaagataattcagatgaagccatagacccctggatacaccgctaagtttctcacattttttccccatgcttagaatgtaacttaactgcttgaagccttgaaccatactttttgtacttgtactatgaaaaataaaacactaaactaaccgcatcctaccatttcttgcagtaaatcaattatattgggttaagctatcacatactgatctagtttgacatgacacatcataaatcttgttttagaatctaatctatatgtatgaacctgcgattaatagctgtatgtcaaagttgagtagtgccttattggatttcttgcaatgaaccgtaggaaatagtgaaataatgcagcatgagtgacgtggggatttatggactagatattctcttatatgggtgcaccatgaaaaataagattttgggagcaaaaagaaaaggcagttgactaaaagatgtttatatattttccgctatgtatttttattggcatactagcagctgatgtaaccagaaatcaaatcatggatagacttctaacacccaatgatattttttttcctggacatctgataaaagttggcagatttgggagggatgcaatacttgtgttccatattactactttatatacttgtctgaacattgataacgaggggcctaaattgccctaagaatattgtgagacgtacgtgacgaattcaactgtcaaagttttcagtcactttttagatgcaaatccagaagatgcttttttgtcacaagagtttgtcaggcattcttatatcaaatgtatcattgcttctttttgtgtgttttcagccgggttatgagcgcctttgctgtcttcgatgcatacagacacgagaccacaactttgcaactacatgcgtctgccgggtccccaagcatctcagagaggagaaggttatagaatgtgttcactgtggatgcagaggctgtgccagcggtgattgagatatcgtcattatcttgtttgaatctgtcaaactaagcagacataatgtttcttgagcgaaatttcggctaaaaacgtttacgaaaacgttttgtaaacccgcctaccgggtatgacgttatttaagtacctgagattgtggttacggtctgcattaatctgccgcatggtcattgcttgatcatcggcctcaacaccctgcatatgtgtattctaaagttttttaatggaaacatctgttactcgatgctataattgccgctatggtctttgaagacgtattgttctatgcacgatgagctgactttgctttgaatgaccttatcgaaaccgttgcaagactcaaatgtttccgtgcggtagaagttcgtgatccaagcagaaagattccaagcaaggacagcctgagatctcggccatttttggagcagcaccagtagcagtaggcagtagcacaagagaagacgagtagttttgctggcttcgtcgcgttgctcgaacatggcaaagctgtaccacgttcactactcttgtcctcgacgaatttacccccataaacaagtgctactggagttcatgtacacagtacaccataaatccaaactctcatgattttgtaagatgccaaattgacaatatgccactggaccccggacagggcaggaggcagatcagtcgatacaggtaggtgaggcatcgccattctcccttgaaaatggacggcgcagcctagctaactacaccgttgcggtggtctcgtcagcccgtggccctcgtgctgcagcggggcgcttgtgtcgcgcgtaggtagcgtactccctgtcctgggctgtcggtgcgccgtgcgcccgcggccgcgagtacgacgcgcgctgcgtgtgcgccgtgcgcggctcacgggaaaccaagccgtttttaatacgcggcgccggtcaagccacaccgccggcatgtgacagtgcgcggagcggcatacgtacgcagcaacgtcactcgcggctcggctcggggagcgcgtgagcgtgcgcgcggtggcatgcatggcggactccacggccatgaccgtcgacttcctccgcgcgcggctgctctccgagcggtccgtctcccgcgccgccaaggagcgcgccgaccagctcgccaagagggtcagccagccaccgcgcgcaggggcagcctactctcgctgtcgttcgcgccattgattacgtgtgttgggtcacttggttgtaggttgcggagctggaggagcaggtccaggcggtgacggcgcagaggcggcaggcggagcgggcggcgacggaggtgctgggtattctggagtcacatggcttcggcggcaacctctccgacgtgctcgactcgggctccgaccgcgacggcgaggaggatgacgacccacgcgacgcgaggagcgacggcgacacggccggctcccgcggggaggagcagccgccggcgcagtgcgaagcggcggaggacgcgctgtccgggacggccgagcccggcggcgggctgtcgtggaaaggccgcagcgtgagcccgcgcaaggcgaggcagctcaagcagaagcaccggaggagctacttctacctcctctcctccgacccgtcgcccaagtaccggatggggcagtcctgccgcaagaacaagcgcaaggagctcaggtgagctccgtcccgccatagacgctggcacaccgcacacgccattgtttgtcgaattctaacatcccacggctctgctcatcagcaatggcaagtcgacggcgccggaagagcagcgcggcgacgtcgaggagatcgcctggagtcagaaggggcagcaagatggatcggattgcaccgacgacggccaggcggacatggacggcgaggttgctggtggtcagtatgtgatcaggtacgagaaggacggcgagatggaaagggtgctcgagaggcaggccgagctgatcggccagtatgaggcggaggaagaagctcagaggcagtgggagaagcagttcaacgagaatcggagctcagccaaggtaagcaaccaaacacagttacacagaaacactgctcagagttgtgataccaaattcttccacttccagagaaaatgtttcacatgaagcaacttctgcagtagtacatgtgtacaacaaaaatataatctcataactttgtaccatgaactacgccacagagagagtcaacttccccttgacttccacatgctaccaaatttagtgcacatgcagtacaaaaatgtgtaccaccaacttgataagtataaataatttgctctctcaaaatgcttttttttaataacaaaatgcactgcagagtgctacccacaggttagttagtatcatgagtgaaacctggttgttttggttcaaaatttgacattttactcatacttttgtctttggagctccaggttcatgttgaggcagagaataaggcgtgccagatagaaaatggttgggagcagagcaaggagcattctaggctcgcggatcaagcggttcattgcaacgaagaggcaaaaccaggcgttaaaaatcaccccagcgccagcaacaaccgctctgctggacttctgttgaatggttcccttcctgaatcaccccaagacacatcaggacaagaagcagcagccgaccaacgtgactcgcacgaggagcttcacggccactgtcatgcacagtctcaaggaaactctaatgtcgccggcacaatgacagggaagaatcaagaacaaggaaacgagaatccggatggatgttcaagctactgtgacatcaaagcgccatcagatgggagcccgtcaatgagtgatgccaccctgaacagcaaggtctctgattggagctcatcacgcttccatgaccatggcgacaaccaggtcgatgcagggccagatcaacagccaacgagcaacatggacatagagtgtgttcttcaggcacttcagcttgccaggatttccctgagtcagaagctgagcaagccagttccacccagccaggtgacgctggcgcttcctgcaccaggggaccatgaacattcagaagacgacggctactcccccgtcgacgacgagttcaattctgcaagagatgagctctgcagctcaagccaatctcctgatcaggagatactggctctccctgcaccagaggattaccatgacagggagaatttgcctgccaatgacgacgctaccatttcactgacagaggaacagaccagttcaagcccacaccggcaggagatcctggctctcccggctccggtagatgattaccacagagagatagtggatgacatcaagatacctatctgcattgccggcttgtttcggttgccaacagactcatttccaaaggacgagatggtctcaacttgcaacaaatatggaggttcagagctcaatctgagaccaactgcagctgctcctcagaacgccttcgtgagcaacactgctgatcgtgtcacggtagctccgtcagagataagagatgatcatggcttttcaacgaggccatgttacgatccacacagttctgggctgctgtctgtgcctacttctggtaggtgtagcactccaagttcagattttacaataaggggagcttctttcctctccggaattcccggacttgctgaagatttcaggaagggaaggccccttgcagatgcagacctgttcatgcagcgtggctgcgattacactatttctaataagtggatgctgtagcttgtaacatgcatgaatttgttctctttgctttttttactagcggaaggcagcactgataattgacaagtagtatttctcatggctgcatatccttgtgaagaaggcgttcgattactaggggagataatttgaccaagacatgggaagtgcgccactttttgacaattggtactccctccgtcccataatataagggattttgagtttttgcttgcactgtttgacccctcatctttt

SEQ ID NO: 23811 - DNA, 8613 bp, Oryza sativa
aaatcccttatattatgggacgaagggagtatgttgaagtgcatttgcaaacttgcagccttgcaggtcacaaagaagcaatagccttgcgccactggatggcctgcggctagcaatttatactggcatgccccagttcttgtcctttgtttatgtggcatgcccagcagtcatgatagcggagtgttgcttgacttcggaatcaagcttgctacacatttttatcccagtgaattcatcataatgttttgcatattgtgctgcatccggtgacaaccggcatcattgccgtacctcatgtagtacgtgctaactgctgtacacgcgacattcgagccgtgcacgcagctagccgtagacaagcaacagcattggaatttggaaggagcgtgctgagaagccacccgtgccgccgtgcccggcacggccgttccatgtgaaggtccttgtcagcctcgtcatcggtacaggccggtggcgaggtccattggctttgacccctcagaaaagagggtctagtgtccacgacaaggccctctagagtgcctgagtggtctcagaactgggctatatacgtggttacggggataaccaacaagtcagccagccatgataaccaacaagtcagcaaagatccaatgtgtacaggctgggttatgccaaagttgggaggtggcaactggaaaaatagccccgtaacattacagactctttgattccttgcccatgtacttcagacaggcagctttacatgcttaacagttgacatggatgccagcctttagcactgcgaggatgagataattcagcaggaaaacctggcacggtgaaactcgctatcactagtagctaagttgaaagtaaaatatccacacacaggaaatgttgaaagtaagataactagatcaattaagcacagctcaggtttggttcagatcatttaccgcctgtacaaatagatatccctaacaccaattaaatagtaccaggagaagagcaaaatctgtaagtgatgacaaaaggtagtccaaaaaaatgtgggaagcccctgatgcatctagcatctgcatcaggacaagacaactaacctagagagcaattcagtatgtacactcgatagtcgataccttggttgaaaaacattgggaaacagtcggtcatgattcgtgactaaccatttctttcgcctgagattttgcacagtaaccatttttcattcttggaagctgcagaatattttttgtgcagttggccaaggctacaaaccacaccaaaactgtgctataggccaacgcatttcacccacctgaatgcgtgtccaatcttgaaaggaagttcatagtctttcatgacagctgattctctccttgccgcctccgcctctgaccatacatacaaaccccgctcttggcgaccaccagggacagtattgtcaagtatgagggcaaccaaaaacgcaatgaccatgttgagtgacagtaacgtgttgagaatatagtttacctgagagcaaggaaataaaggaattgcaaatcaaatagttaacataaacatatagcaaaaatattgccatattttgagacttatatgaatgaatttgtcaggcttcacaaataaaatgagaacagttcttatatactgcaaatgtgcctacgcagtaaattagaaagcaatatatcattcatgtgaatgggattgaaaatatcatggcacggtatataagagtgaaataattgtgttctttgttaagaaggaaactatgctggaaccatatgtaagttatggaactcaacctaagcacttctactcgataaagtttattaccactaggaatttatagcttgactaatttcagttgaagcatagtatatacatgaaaaatgaaagttccagggttcatatcaaaacagaggagtaaaaaggactatatttaatgagaattttctaattccgactattttcccaggatttgtttattcctttctttatgtttctttctactgctttctccagttgtacaatatagttatgtaaatgttcaggatacttccataagacactccacaacaatattgttactgaaagaaaccagatatttgttattgtaccaggcaagcggcatgaagagttacagttggcaaactatctatattcataaataatgtgagcactataatatggactctgcatgtgtatcaccagtcttttgtttatgtatttccattgaaactctagtatgcaaacagcatagtgttagaaaagaacggatgaatacataccccactagatccagtgtgtataggtccatgagatgcaacaatgtatggctggaagtaggttggaactgatgagtttgaattaggctgtaatctgtactgttgaaagtacgatggaactgacagggacaaaaacaaagctagcccaactacaatactgttcctggagcttcccttggcgctataccgaagattggataagccaagggcacatagcatggcccacatgaaacaaagaagagcagcaactagaacatcaggaatagaagcaatgaaggcaccaacttttcctacaatggggacacaagaattgttatagcaagaacctgaatgctgtcacagttaaatgatgtctactcttccaacacaggggaaaaagtgcaaatagttgcttaccaacaaaagagagtagtataagtacaatagcaccaaatccaaccgcccttcgattgcccattttagtaaccgcaattgtgtgtacattctctgttattgttgcagatccaactcctgtaccccacaagccagctaagactgtggagacaccttcaacaccaatgcccctactaacaaccccagctgttggtggtcttgtggccacaaacaaagaagatgcatggtaggaaccaaccttaagtccaaaatgcataaatgaattgtcaggaaacaaaaataaattggatagtgaagagcaatgaatggttgattctagaatcctacttactgagtgatccaatttcaggcatttaacaatattgtcagagaagaaagcttatgttaagttgatgcttagcagggggagcaacaatatgctttgtagatcatttcccagtaagtactagattgtttatccaaatttatgaaaagtaaacaaaccaaaagaaagaaaaacaagcatcatctaagttcaaagcaattataaacttactgaatcgactgatgcaataacagatgcaacacacatcacaagacccattttccaactgaaaattggagtgccccattgcaacggatatggaaatctcaaccaaggtgaagatcgcaaggcatgtgaagtgtctacgcgacaagatttcatcctcagtacatgcttccggcaataggctgatacattgtttgaggcaggaatatttgcatcacaacctctgtagctataaactccagttgctgttagaacaaaagcgatagcccatgtgatccctagagcaagaggaacctaagaaggcagcaccaaaagttcagcaattagaattgcataatcacactaatgactagcatagatggaggtattagctcaaataactattagcccaaatcttaccgcataaattaaaaacacccggtagccaaataactttacttttcggaggtactgtcacagaaatagacagatcatcagcttaagacattatttgcacaaaatattacaatgcatttaacaagttggtttactgcatactcactagtgcaaacataacaacaatcaataattgtaataggcccatctctatacatgaccctactttagtgaacccataactgaaaaacgaaagtccaacagctgcgacggttggtgagatgacaactggatttatcaacctgaaacagaggtagttaatgacaaaatgctcagtgaagatggagatacatatgtattactatttgtcacaaaaatatacagttgatggtacagtcagaagaaatagaggcaggcttactaatgtttcattgatctggattcatcagtttataagacatgcaaaagtatgtttattgtccgagaaacaacggtttatgcaaagaaattaattcataacagggatgctcagaagcaggaaatatgtataataactagtaatatccaacaaagtttcctttattatttgaatacctctatggtggtcttctactaacatcaccagtagaagcgatatcaaccattgatttatgatatctactaccagtagaaaaaaaatattctacaagtagttgaggtggtagtataaatagatcaatccattagattagagagtatgaacagactggattgattctataaaataccaatagagaccatagtaaaacacctgtatcataatcggtgtttattaacatatcgtgaccattgttaacaaacaccacatagataagagaaagttgttcacagtcatcacgagatgtatctctgtagtacagtagaaattttggatcatttgttttcttaagaatgtgttagtactcagtatgcaccattccaaataaaaatctgatcgacttactaccaaacccaatcatgtggccatggtaaatagagaaatatactgccatgtcaacaagccacatgatagcagacaactaggagaaaaagatgaatgtatttgtatctaataaacagcaacagctgcacaccttagaaatagtgacattaggcctgtatatcctaacagcacttggaatgcacctcctattatgatagctccctgcaggtgcttcatgatgtgcttaaagttctgcaatgaaatacaacgtgttaggttcaacaacaaacgctctaaagcaatgatgaggcaatccctacatgacaacatgtggcattgcatcacgccaacacaaataaaatttatacatataaacatacattgtgattgagcccaaagaattcaggggagtagattattgcaagcgcaggggcaagatatacaaaggatggtccctgcacaagaggcagccttgtcccacagaatgtgtgcagcaatgtggtcatccctgagacaagcaacaccgtggacaccaccgctgccatatcatcctaagcatccaacagcgtatattaagtactaaacctacaaaaccaaacatgctgtgagaactactactaaattgaagccacactcacaggtgaaccgcccattgcaggaaccatcaaaagtgggatcaggatgattgagccgagcatggagatgtaatgctgaaatccatataccgctattggaactgcaacacatcgtaaaacctcgtaaatcagcgcgctcgcacatgacagtgtgggatattcaattcctcttttgagcacttacatactccggggctgtcacggagctcgtacttgggccgctccggcgcaccgtcgtcctcctcctccagcagctgaggaagcggcgctgcggccgcctgcccattcggccttccgccatccgaatccctcctccgcgtcctcgcaggaggcggcggcggcggcggttgcggctttgcctccgcattggccgcggcggcggcgggagggggcgggagggcggagttgggcctggccggtgggccggactccagatcggaaggtgcctcggcggggcgaggcagcgatacctgccccgagctggaggcggagacgatggcgacggactcgccggagacgcgggactggaagccagtgcgcttggcccaggagaggggctgcgcctgcggctgtggcggcggtgcggggggccatggcccggggcgcgcccggcgagccgcgccggaggaggatgacatggcgcaggcgggggaggagggggggaggtcaccgccggtgagcggtggtggtgattaggaggggagggggaagcggtgcggggtggcggaagcaagcagtgagtgagctggacgcgtactaatccatgcgtggggaaggggaggcggagattttgcagtgtggggcccgcggcgccagtggacgttatggcgttgtcacgattgtgcggcgtgtgttttgaaatttttggtgagataggatgacggctgaggggctgatgtttttcagttagctcgggtgctactgctgtatgctaagagaagtttaacagtatagccaattactaactctaaattatctatagtcatataatagctaatttatacaatatttggttactatatactagtaatacctgatactacatatcatacatacattatgtcttggagtccgtattgcagctagctcttctctctattcttttatctctttaaaatatgtttatagctagcttatagcctgctattgtatctattctaagagcaaggctaataatacaaccgatctgttggctataaggttctttgtagcattctctcagtctacccatataatagttagctctttacaattaatatagggtccacttgtctctctcacagagtttcttagatcttgtttccaagccgactgtaagtttacagcccacttcttctctcttctcttctccaccttaacttttagccagcttatagcctactattatacttgccctaagactggctaagagagcctgatgcttgcttggctacgcggtgaaatcagaataggtttctttttcgtgagggcctgttacgcctatattaagttatttttatgtttatttatcaaaatattagatttatatctataaccgcgtagataatccactacagtattttggtcaatattccattttaaaccagccctaaaccatttcagataaaatagattaaaatatgtaaaaaaaaaccaacgtttcgaatggacttaccctatgcaaattctcgggaacatagatagagatttagcattagagtttgttattataattatttcatcaaaacaatattggcttttaatgtgtttagactttccagtttcagcttctgtaaggtttgcttaatgctgaacttaggtaaaaataagatacggctgagagctgtcaaactaaagattggaatttataatttcattgaataaaaaaatgacttagtaagaaatttcaacatttcaaacgggcctcttgcagaaagcgaaagcccgccttttctgaactaaaggcccacatttttccttgtcacaactatgtcatgggcccagttggagatgataacaagggatatgggccaaatggcaggcccggataggccctttttttcagaactaaaggcccacatatatatttgtccacactactattctagttgaaaatgttgaatccaagcttttaagatgtggatgacctatgcaatctctatgccaagctatgtctggtcgatttcaggacacacaaagtcacgtggtaattgaaaggtagatctcgtgtattacaatatgaaccatcaagggttaatttatctttcgccctttcgcggtttcgccgtaatgtctcatagtgaacagggacagacctgattgagaacatggagatcatgtacctcttgtctcctgaacatgcttgcatactgcatttcacggcataccgacacacacggacacaccccatgtcattgatggactggactaggaaaaaaagaccgttcctcgctagcacagtagcagtatgcctactcctactctatatgaagaaattcgcattccatgtgaagaaaattgcagccagcacgcagaagtttaatgaagagagtcgccgaaactgagattaatttctcgcttccgtactccgacacatctatccacatgattatcctttgaaatgttcactgctggatgcagtagccaagtagtcaaggggatcaatgcagtgttttaccagtccccactaatggtggtggacgcactttctgctgcaaatccaaagccttccagaacttttcttatctctggatcaccaactttagacaaacagcaatatctctttcctcttttacaataaaaataacgcgagctttgcccatttatgcggaagaacagaaatggcgtcacattctttcgcctactccctcttggacttgtcaaggactcgaggtcgtttgattcatatttcagagtaagttactgtgaaagacgtcatagaaagacgatgctgcaaaatatgtgttgttgctataccattttatttctcttctgaccaaatagagtactcgattagtggcgagcagcgtgaagtttcaggcaccagagaggcgtgttcctgttaggattacattactcatgtactccatattagtactaattaattatctatagctagaagcccgtgatcgattagttggtgttagtttagaattagaaccgatggcgttcatgcatacacgacaagtgttcgatcgacctacgcaaaaaagtctttgctgccacaaagtacgtggatctagctagcctggagcctggaacggatcaaaaagtttactaatttatttagcagccatctagtttgctgaagtgtggaaaccataggagcatgcaagcttacgaagtcagcaactacagcgctatcaacttatcatatgaaacttgtgctgttttttcttctgctatatttaagggagaatagctaatatggttcctaaaatttcgctcctgggacattttagtctt

SEQ ID NO: 23812 - DNA, 20714 bp, Oryza sativa
tgtaagagcaaaaatatacctcaaaagggtgaaaaaaaggataagtattttttcccatggttatgtctaattcacccttatatttatttttctatgatatacataaaggtaaattggacaattcatcatagattttgcatcaatgatgacatggcatatttatataatgattttggtggacccaaggactattctagaccttatgacaaagtttaaggatttctttggaccatttaaaaggttaaggactaaactgatcctacagagaaactttagggactaaattagctattctccctatatttaatgaaaaggcacaatctattactgttttcccctttttttaaaaaaaaacttatcatatgaaacttcaaatatacaatgatatgcccagttgccacttgccaatgagtgactgcatcgcagtttctgcgattgcattcatgtattctggattaataatcctttccttggttggatcctgagttctaattaatcagcgagttggctcagatatgctgtcatcttcagctgcaataattaattcaggtgttgtttttctaaagagtttattatctgtctgctacccaaaaatacagttttatattatataagtagtaagcatcacaaaccccgatactcgtgatactcgcttcatctgaacaattctcaacttctcaactgctgttgcgccatagtaggtggtgacagattgacagcccgatcaaaccccgcccccctaaaaaaaaaaagaaaaagcaaccatactccctccatccttaaaaaaaaacttaaactatacaagtatgtaatgttttctagtagaacgaatctggataaagggttgtccagattcattgtaaagatgtcacgtctcctcctaagtttagtttttttttatggagagagtacttccgtgatagtatttatcgtttgggataaaaacgtgatctaaaacaactttaatcgttaggctttaataatatatataaaacatcaataaatatatgattttgttaaagtattttgtaagactaatctatattgtatgatctccattagaatttattatctatagttaaagattttaaagtttgatatgagttttgtccaaaataacaagtagagtattatcaaaccggatagagtagcttaattagctacatccaaaatttaaatttcgaaacctaaaagttgatttctatttttctatttgtatatttttaagtattggcatcaaactattaatgagacatatatataaagtttaaccatatattgttttgtgccgcttcgtttttttttttttacaacctatggccttctgattccgacgtattaattgcatccatatacatggccgtagctgtgcaccgtacatatatgttgttgtactctcttcgtcccataaaaaataaatattagaactgaatacaacacattctaatactaatattatagtactacgtgcatactccctccatcccacctagtacaataaatctggacgggatcacatcttcttctaggttgggttttttcttggacggagagagtacagtatctccccaatagagcctatttagttggcaaaaaaaatttgcccctgcatgctgcatcggatatacgaacacacatttgaaatattaaacatagtttaccaacaaaacaaattacagattccgccatgaaactgtgagacgaatttattaagcataattaatccatcattagcaaatgattactgtagcaccacattgtcaaatcatggtgcaattaggcttaaaagattcatctcgtaattttcttttttttaagaagggaacaactcaggacgcacactaacacacactgcactcacaccacgacacacatgcgtgcgcgtccctaacacacgctaggaatgagattggaggctcgtaattttctggcgaattatgtaattggtttttttttctacatttaatactctatatatgtgtccaaacattcgatgtgacagcgtaaaaaactttgtttgagaactaaggcctagtttagttccaggggtgaaaagttttggcgtgtcacatcggatacacagacacacactgaagtattaaacgtaatctaataacaaaataaattacagattccgcatgtaaaccgcgagatgaatttattgagccaaattaattcatcattagcaaatgtttactgcagcactacattgtcaaatcatggcgcaaataggcttaaaagattcgtctcgcaatttacacataatctgtgtaattagttttttctttgtctatatttaatactccatgcatgtgtccaaacattcgatgtgaaagtgaaaagtttttgcatggaaactaaggcctggtttagttccccaaaatttttttcccaaaaacatcacatcgaatctttggacacatgcttggagcattatatatagattaaaaaacaaattgcacagttgggaggaaatcacgaggcaaatattttgagcctaattagtccatgattagtcataagtgctacagtaacttacacgtgctaatgacagattaactaggctcaaacgattcgtatcgcggtttccaggcgagttatgaaattagttttttcattcgtgtccgaaaaccccttccaacatccggtcaaacatctgatgtgacacttaaaaattttcttttcacgaactaaacagaccctaaacagagcctaaggccgtgtttagttcctaaattttttttcccaaaaacgtcaatttgaatctttgtacacatgtgtcgacgcttgatgtcgcgattccggtatttgcatagtatggggatcgttggtactaggatatatgcgagacttaggtaaaagagacggatgtgaggatttttatacaggttcgggcccctgaattgtcaggtaataaccctacatcctattggccgaaaccggtgttgctctttattcatctggataacacaaatacaacatgtgggataacatatctggctgtcgtcgacttgacggctagataactaactcgtagtcgatgacagggtagtcttcttcctcgagcacgaactcgtcgagatcagagatagtgcttgacccctcttgccggcccccgcaggtaccagatagggtttgtctaagctaatttttgatgttgatatttggaggcgtgttggcttgtatgttgatcttgtgtcttgatctattgtttcgtgtcccctgtccttctagggggccttgtatttatacccataggtgtccccttgtccaaatagaactaagaaaaccaatatggatacaatccgagtagtacatgtcgtttacatgtagaattctattcatccttccttatacgaaactccttctatatccggaggttgtttccgtataagacatgatatttggtgggtcctgccgagatttagtcgactactattaggtatgcggtatccataaccctgacaacatgcatgtagtattaaatatagataaaataaaaaactaattacataatttgcgtgaaaatcgcgagacgaatcttttgagcctaattagtccatgattagccataagcgctacagtaacccatatatactaatgccagattaattaagcttaataaattcgtctcgcggtttccagatgagttatgaaattagtttttttattcgtgtcaaaaaccccttccgacatccggtcgaacgtccgatgtgatacctaaattttttttttcgcgaactaaacaaggcctaagcaggctctgtgtgtcatatttcatactattagattattttttatgggatggaggaagtactctgttgctcctctgaaaacgaacagtactgacccccgggaatgacgtcccgtcaggatcacgatcgatatgaaggcgcccgccctccgacgaccgacgtgcacggtcacagcactagtagagatgagaacgagacaccaatcggcggattagttaggtgcatcagtcggtaaggaaaacgagtactctgagctctacgagcacttctgtgctatatatggtggccaagttggcgagcatataagccactcgtacgtcaaggcctcatgggccacggactcgtgcaagcctttcggccgcgctacatgcgcgcaccatttaatccgtgtccatctcgcggtctcgccgctcgatccgtcgacttcgacaccttgcaaaccacacgataattcgaaggaatttttttaaccgttttgtatgttatcctttgattagttgagtttcggctaagtcgtaaacgaataaatgaactaaaaatgttattttttaaaaaaaaataacggtatttttagcagtttaaataaacttacgaaagaaaaaagatcaactctaaaattaaacttcggaactcaaatttggttgcgattgaaacaaaccaacaaacagacgatgagatgagaggctaggaacagttcgatctggcttattggatgagcatctttgcagagatagagatatggcaaaattcagcaactaatttttgttgatttattttcaaagggatatagttgtgtcgtattataaataaatctatttactttttctaagttaattatgtatattgtcttctaaatgtatgcagactattaatcaaaatactatgatcgttatacatggaaccgatagttcaaagtaaataatcgtgtagaaagtatatttggagtttgtaatcgaaacaaagaaaactggagtatattttaatgccatcttttactgtgagaatctgttgcaattcaaaacgttgaaattattttgaaaattataaactgaaagcaatatgaaatataaagtactgttcacagtgtaaacaaaaaataatgtaatcaaaatcaaaagtttaattaactgaatttattttttgtattttattttaaattttgtaacattaaatagggaaacaacgtcattttcatgattagaaaacgataattgacatcaaccgcctttcgatgataataagtgactcctagcagccacgaggatttttttttaacgatcccgcacaagacaacgtgaaatttcttatgatatggcatagaaaaattacaaagttacatgacgaaaaaattgtgaccaatgaaaaaaaaacaaaacacaaccaccacgtgctaacagctccctacacaactaaggagaagacactaggaacaaaccgaccgccgctaagtttgaccgatcgctgctagacctgcaagatcctactcagacaaatcatcgatgagttcctaatcatcctcatgtagagtggttgaggaagagggcgagagagaagaagatccgctcgtccctcacattaaccagatgacgtcaaccaaaaatttgccaagaaaaagctaagaaaagacggtaaagcgaggaaaaaaacttcccaaacaacaccaccaaagagatcatgacatcttagacgccaccaccgcccatccattcggactgggttttgacatgaagaatgatgttaatgagtggaaaggtgtcgatgatggcttaacaatgctctaagagaggataataatgtccgtaggcatcggcgttgatggctcagagaaacctcaggctaggttttcgcctacaacaccctcttcgcacttatcgtcaccaccgcaatgctccaccaattgaacagcctcttatagctcgcagctctgctgcacctatgctatatacagctaaccggcctaaactgccggtcttcaacatggctaggaaagacaaatattactccctccgtttcaggttataagatgttttgactttggtcaaagtcaaactgcttcaaatttaaacaagtttatagaaaaaatagtaatattttcgacccaaaataaatctattataaaaatatatttaattattaatttaataaaactaatttagtattataaatattactatatttgtctataaatttagtcaaatttgaagtagtttgattttgatcaaagtcaaaacatattataacctgaaacggagggagtagcatttatgctaatgcaaaatgagatttacaatggctttgtttataccataaaaaaatccaaggttttttagcactacaacttacacatacacaataggatctactagtacatgcattatgcatacctaaatatgtagtacttcctctgtcccacaatatagcaacctatgataaaactcatgtccatatttgtagttctagaataggtcttagaggttcctacactgtgggacggagccacggagtatgtacttatcccctccctgacatgttttctatttttcggtggccacgtgacattggcaaggagagggtagtggccagtgggcgaagccaaggctaccaaagaatgtagcaggcacaaattagtgtgtgtagcactagctcttctctgttgccgtaatgcagaggatccatgcctgtcaaaaaggttgtacacgaataaaattgtgaagttttgagtccgttgacaattttttatgtttacgatactggacggcctttggcttaaaatcctagtagtactagatggactttctcatacttgcattacaatgtacaataaaaattttcctcgtttgggttctcgacggattttctttttatttttggtttccaaagtatgacttttttcgtgatcttaacgtattagcgattctctgccgactgcccggcctggtcgcgggagcgagcgcgcgggagattctcccgccgtggcacgcgcgacgtgccgcgtgcgcacaggccgcactgtccctttcgcccgcgcgtcatacggtgtccacccggtccgcgagcgcgcttgcttcttcttctctatatatggagtacgcagttcagcttcagcagtagaagcgcaaaaggcaaaaccagagcccgctcacctgctgagaaacaccgcgcagaggcagagacaaacaacgtacggccgtgtagaactgtagatcgtatcgtccgagtcccccaagagtttcaggccatcaacccgtagtttggcgctcccttggttttacctgcaagacaaaagagctagcgaccgaatcgttcgacggcagaggcgtcatgggggcgccgagcagggaggatgaggaggcgaagaagatggaggccggcggcgacaccgtcggccagaagctcgacgccggggctctcttcgtccttcagtccaaaggtgcgttcgtgtctgacatgagctctcttgtttctcgcttactcgcttctgatcacccactattctttctttctttcgttatttctttcttgattcctctttggcgcatgtcaggcagcaagcatgtttggctagctgcacatataagcgtaacctgtttgtgttctgggagcatcggaggccgtatattctagactgttgatggattgtccccagctattaataagcaaaagagctggctaactaatcagtagcaactagccaactaacatgtacgagttaatagattgttctggctgctatatcaagatggtttgatgaagtgttgttgtgcaggatttggctatgccatcccgattgatatgatccgtatgtaaatgatttggctcatgttaataatcgtacccaaaaactgtacaaactaccaagataacgggaaaaaaatgatggtttacaaattgtttcggttaattttcctcagcgcatgtacccggcagccattgtgaggggtactgcgttactgttctacttgaatgactgggtgcgtctcctgaactctgattaaaagttcttggacagatgtagatgtttgaatggtccctgcccatctatccttttgcactactttttcacagttttaccctatgaagattggatgtagtaacaaaaactctcttctttctttgctcgcttttttccgttcccctacatccgttgcctgcacgcctacatctattctttttcaacattcagagaagagacaagagaaaatgtacttcagggatgatgggctccctggctatcaagcctattatcaatagcaatgcatgtaaagttgtaaacatgggcaattcatattattgttctgctaggctgctagctcagccgatcccccatatcacgatacagtactcgtattagtcaacctttcgggctccatgaaatggttacacgtctatttggtcttgttgaagcagacagaaaatatattaatatatggacctaagtgaactataaaagtataataacgatgtattgttatttttattccaaaaaaataaattaggcatgaatcgttcagtctttagcgtgatgtctgtatcgtataggagaactggtacaggtcaccatctcgttgattatcatgcgcactagcgcagatactcttgactcgaggaaattataaatggcatcgggaggttggttagctagaactctctccgtttcaaaataagcgcagttataagtttttttttaattttaatcgtctgtcttattaaaaaaatttaattagtatttttattgctattagcttataaaatatgaatagtactttgtgcgtgacttatattttttttatttttttttaaaaaaataaataagacggacaattaaaattgtacacggaaactcatcgtagtgattattttggaatggagtgaggaatatggtaggagtaatgtactaatcaaatcatatttggtctattttggaaaaaggaaaatcgaattaggtgtgagactgcaggcttaacaaaatcaaattgctcactgcccccaatgcctcatagttccctgttgatttgctgacccctgaaacatactagtatcaacaactttattttaggataattttaccatccttaaaaatgtatctagaagtaccaaaaattttaatgtaaaatttaggtatctcgatgtacttttttttaatgactgcaaaatttcttttatttttatctttcgattgtcaaagcaagtttagtgactgaggagtactacatgtgtaagacatacagctttggaaagtaggtatgggcattgtgcaggattgatcaatgtttgatggagggatggggtttcttccgatggcaacgtgttttttttttttgaaacgactgatagaaacgtgtttactcgccatattccaacttccaagcgtttagctaacctgtgaactttcttttgccaatccttcatctcctacaacttttgaccgagtggagctgcggaagcctctcccaatcagcttatcatcatccagcgactaatacaaacagaaaaaataccagtaggattaacagattagctaactactagcaggagtaatgttattctttttctatatctatgatatactactttgaatgatattagtgagggtgtctgagttttccccatcaccataagttaacatattagaccataagatcctcaaatgtgagtatttttgcacttgatatgacataatatgcctaattaactaactacgttagtaggtttgtaatttttatttttatatttatctcttatgatattcgccgcaatgcacagtacctttagctagtttaacagaaaaaaactgatcatgctgctgctgtataaatgcgcagggtcatggctgcactgcgggtaccacctgacgacgtccatcgtggcgccaccgctgctgagcctgccgttcgcgttcgcgtcgctggggtgggcggcggggctcatctgcctcgtcatcggcgccgccgtgaccttctactcgtacaacctcatctccctcgtcctcgagcaccacgcgcagcaaggacgccgccagctccgcttcagggacatggccaccgatattttaggtcagtaatcactcgtatacctatctatccgtaattacagttaaacaatgagattgatcgacagggattgttgcttcagccacaattaagactgtgtttagattcaaagtttgaatccaaacttcagtccttctccatcacatcaacctgtcatacacacacaacttttcagccacatcattttcaatttcaaccaaaatctaaactttacactgaactaaacacagcctaaacgctgctgtaaactacagccatttttagtactgctacagccgtaaccgctatagcaagaataggtactgaacacaccctattactatttactagttaggttcccattaaaatggaaataatgtagtaggttgatgctaatatactcattaaactcgagtacataagtgattaaaaggaaggcacgtagcaactccaagctaattggtagatggaggagaatctgcatataaaattgcattggctgacaactgtctcgcaaactcatactacgtgcaataccaaaagcattacaatacaatagtaagggcgttcacaatggacggacgtggcattcagccttcacccaaaaaaacgaatacagtacaactgtacaagtcagtagtgggtactagtatccatcacgaggcaggtaagattctctcgcccatgtcttcacttagccctggctcctaaaggcccgaattgagaatttggagaaaacaacctctgattataacacgggatttatttttctgtaatggaccatttctttcgaagcatttacatagtttgtgatattcttgcgttcaaacgagacatgaggatgagtcaatacatcaacacctatgtcgtcaccttgaatataggggcagaaacgccaagtgcagtgttctttcagaaaagaaaggaagggaggaaggaacaccaacttgtagacgtgacaggtttagcgactgatcattgatgtcctgttttattcacaagaaagtcagctgcccgcccccttttcttgtgcggaacaagtcagctgtattatttggccaaatcaagtcccatttcgcatttgcgagtttgcgacatgtacgtgtctgcagcattcatgagcaatgggtatggccatactatatcggaccggtaaactcttcaaccggagtgagtgcagcgtctgaagccgacatgttgcttgatttcagtaactgactaagcagcattcaataaaatcgtaacacggtacagtacaggttagaaaagtccagctgctagggctcgtattttgtcactgtcaagagtcgacgagggaaagaatccccactggttagataatactaattaaaactccagttagcgcttggcggatatatagagaaaaacttgattggtcgaaagggatagtattcccacattagtactacagatcatgcaattggtcgagtttgacgaatttgtcggcaagtatttgctgtggaatttaatattccagctttccacttgattgcctgtctaaatcgattgatactgcttgcgaaggaaaaaaaccagcaccgcgcgccgtttcttgtcaatatgtcaatcttaaatactccctccgtcccaatatgtaacaacctagaactggaccctccgtcccaatatgtaacaacctagaactggattggacatttcctagtactacgaatctggacaggacagtagtagaaaatgtcccatcggttctagattcttatatattgggacggagggagtagcactgtaccaggtgtagtagaatcagtcatatactagcatcctagctgatacgacattggacagataagcacaggtttaacgtacgtgttgggaaaaaggaatcgtccttagtgccatctggcagcagattcatacagtttaattacacacgcatctgacaaaaaatgtttcgaaagggatattcatcttcatcaccgcgacaaaatcactgtcactgagatgagattcatggttaatttttccacggtgatgcatgcagggcctggatggggacgcttctacatcgggccgatccagttcctggtctgcttcggggcagtcgtcgcgtgcactctcctagccggtcagagcatgaaggtatcttcatcagaacttagtccacgaactgatttcgtgtcggatcggatcggatcgcgttcatcaattgcacatggtatgaatccacatttcttactcgatcgcgttgcaggctatctacctgattgccaacccgggcggcacgatcaagctgtacgtgttcgtggcaatcttcggcgtcttcatgatgatcctggcgcagatgccgtcgttccactctctccgccacgttaacctcatctccctcgtgctgtgcctcgcctacagcttctgcgccgtcgccgcctgcatctaccttggtaggtttcccggcgacccggcccattatttagattagctattgggctttaatttggcctgtcgacgcgacggattaaaattggactgacgaattttgtgcaggaagctcaaagggagcgcccgagaaggactactcgatcgccggcgccaacacccgtgaccgcgtgttcggcgtgttcaacgccatcgccgtcatcgccacgacgtacggcaatggaatcatccccgagatacaggcgacggtggcggcgccggtgacggggaagatgttcaaggggctgtgcctgtgctacgccgtggtggtgacgacgttcttcagcgtggccatctcggggtactgggcgttcggcaaccagtcgcagggcacgctcctgagcaacttcatggtgggcggcagggccgtcatcccggagtggctgctgctcatcatcgagctcttcacgctgctgcagctgtcggcggtggccgtggtgtacctgcagccgaccaacgaggtcctggagggcctcctgtccgaccccaaggccgggcagtacgccgcgaggaacgtcgcgccgcgggtgctctcccgcaccgccgccgtcgcgctgggcaccaccatcgcggccatggtgcccttcttcggcgacatgaacgcgctcatcggcgcattcggcttcctcccgctcgacttcgctgtgccggcggtgttctacaacgtgacgttcaagccgtccaagaagggcgccgtgttctggctcaacaccaccatcgccgtcgtgttctccgcgctcgctgtcgtcgcgtcagtcgccgcggtccggcagatcattctggacgccaatagctataaactgttcgcgaacgtgtgatgttattatgctttaactcttgacaaaggaacatcaatgcaggaagaagattttttttccttttatttttcttttttttaaaagaagtcatcttcccacttatgtttatattatatttattaatcatttattagcaactaaaaataatttatagcatgtctttagtgatttaaaaaaaaatactgtaaaataaactacaacgagaaaataacaaaatcaacgccaaaattgagttttaaactttaatttttatcttatatgcataagcataaatcaatcgaggcagaaatatagcctgagtttcgctcagaaatgtgtgttctgtctatgaatacggagagactcaacaccggagacgctttcttatatcgaaggcgtataaacgagaggtaagttgggctcggtactgaaagcacgcgacctcacgcgccgctaacaaaagcccaaagcgacccaggccgtgagtcgttggacgggccaggctcgatgcggacggcccgcacgccggcgtcggcggcgcgcggcggccgggcgctgtacgagctgtacagggcggcgagccgcgcggcggcgccggcggcgcttctatggcggcggctacgaggactggagcacccgtcgcgttggcccgagcggctgggcaggccgtcggtggcgcggcctcgtccgggctcgccgctcgtgtggttccacgccgtatccctcggcgaggggatggccgcgctcccggtcgtacgccactgcgcccgcctccaccctggtctccccatcctcctcaccactactaccctctcatccttgtaagcttcccccattaccgcaaatacgagttgcctggctctctcatttccgtgtaatgtggccatattctatttcggttgttttatttcaatgcagcgaagtgatgaaagacttgctcccggatggtgtcatatatcaggtgagctcggaaattgctcttgtactttcagatccctgtcgtgacggccggtttagttttctgagaaatggcgtatgcacaacaaatttttactgatggactgttcttgaaaaaaaaggacattttaggttcgaactgtgtcaaggcagatagatattgtctgttcattatatgtatcccttaaactaaggtcatattatactcgttgaactatgatagtaaggtttcgtaatattaaacctttaaggtggtaatattcgatagtacagacacagatcaagcaaagttttgggaacagatggaacttgtttagatgaagggaatcacgaataggctaacagaaggatagtttaaatgtttgatatgccctatatacatctacggtagcttattgttgttttacataactgaaatacatatgtgtgtagtttgcaccccttgactgtcctgatgcaatagaaagtttcattggatactggaaaccaaatttgatacttcttatggaaagtgaactctggccaaacctcattttgtctgcagcagagaaaggggtaagttttttttttctcataatgactattttctactaagtggttaggcttccctttgttacccttgttttttccatgtgcaatggcagattagctatattttcggtccatagtacattctttcactatttaattatctgctgtgaatgaccttcctatttttcagattgcagtggttcttttaaatgcgcgcatgtcattgaagtctttcaaccgttggtccttgcctctagggttgcagttagtctctttgatgctctccaaactatcacttgttatcccattggtatggagtggtggggttctaaaccttattttgatgtaaaattattgccattgtattcatttctatctgttccagagtactattcaagctgttcgttttcaattacttcatgcaccaccacagatcatccattttgctggcgatttaaaatacggtatgcgccatgccaatttttctctggcttcctatgttcatgagagtatgtttgaaataaacatatgagtgatgcatttctcaaggattatcttgggagcttgaaagataaccaggttcacaaactcaataatttatagagattcatgtgatttacctagctgttggtgacattgctgctggggagaaagaggtagctgcaatagaagatcttcagcagcagttcagcaataggcccatctggatggcagcttctatccacaaaggggaagatgaaagtaagcacctcagacacccaccttttctttttattggatcagtattatctgctcttccaaggaactgtgtgcaggactaaaactgtatatatgtagctgttttgcctatggtgatgatcaccattgatatccctaaagtcattgctgacttctttatgctttcctgaataattgaatccttgccttactatgcttatgttctcaacataaaaacaatgttgacaagcttcctctctttttcagtcattctccgtgttcatgatgagttaaccagggcgtatcctactctacttttaattctcgtcccaaggcatcctgaggacagcaagaatgtttctcaagtatgtcaattgtcttccttacccttttatatctggtcctgtttagttgatgaagtagttggtgggttgtactgcttatcttttagttttttttaatacattatcatattgggtaatctataggtgtagcattgttgtaatgaaaaaaagggaactaacttagttcactgtatgaagcttgaaattaattgcttataactgtttgtatacgattacttgaaatttcttatggttctagagcatgtagcatatgattctcacttcaatgctgatagtataatatgtatgggccacatctttagttctttactcatcttcttttagaccctgaagaaacagaaagtgaattttgtgctgaggtcaacaagagaagtggtgtcttcaaacaccagtatatatgtggttgatacgttaggtttgtgctatctcttatgccttaagtttgcacattttttcagtatggagtatggactgtgtatattcttttgaatgttagttaatgaatgaaataccatggaaaataggtgaattaagaatgctctacagggttactccaatagctgttattgggggttcttttttgcccggcttagctggacataatatttctgaggctgctgcagttggttgcgctgttatgactggtacgcaagagtgcaagacacatctgactattttgaatgactttttctacaaaatcggaatgtctagagtttcattaattgtctttcaggtcctagtgttgggcacttctatcatatgctggtcgaaatgtggcaaataaatcctttagctgtcaagcaggtgataatctgtcttgtactttgttatttatctaactgacacaaaaaatgccgcatcatttgtgcactatgttcgattaagagtgggattactactatttcgtggccttcttaggggaggtattttgttaattattgacttggccttgtccctacttctggaaattagtttggacggtaacaggatgaattgccttctacttgctctttcaataaattatgcttgcaatgtgggtatgctgctttactgcatgggtgattctttttttttttacacctaaacatcgcaaggagctacagcccctttcattctatgaggattaatgcaaatgtttttcaggtcaaaggagaatatgaacttttggaagcactaaaacaactgcttggtgattctagagctctggaagcatgtcaaagagccgcaaaagatgcgttttcctttatgtcagatggagttgtcaatcgtgtatggaatttagtccacccgttcactattggttcccaaacagacacatgcgacagcttctcgagtagttagtatggaaggcttgcacatggaagtatggaaaatcagggtagtcacatttaaaacattgacatcttctagtaacttgcagggacaggttgacaatgtatgagtcctctttattaggaagataaggtctcacgaatttctctgtacagtctgatgcacataacaaacttgtactcctagcatgccggtgacagatgacacaaatatcaaattaaaggccattagctcctcttagcaatctaacatttctgacgaattctactggagcccctctcattttgtattttcttgtgatgtgggtcagctgttgtagacttgcagttcttcgtctcctatcagtatggctgataattgattgtttgactttgtttatttcttgtattggttgatcccctgtaatcaggtttgcaaaagtttgaaaagcatgtcctaacaacttcatgatttatcaggcgtgccatgcgtgacttttactttgactaaatacagtttcagcggggttttcttttgtccggtggcccgtggggagggcagaatattcgatcagctataggtattcacagtattctcccgtttctggtttctcagtaagcaaccacatgcgcagtttgcgtttcattatgcgtgcgaccatatgtgcaggtttgcacattggcatgagacagactgctcttcagccgttctgcatctgtctagcgatacacacacagtacgtgctttaactgcgagaaacctaattcgcgcgcgccggcagcgcgcactcccggctgttttctctttttttttccatacggcccactcggcgtgcgcccgcgaaatctaaccaccgctgttttctcttttttttttccacttttttttcttccctgatttttttcgctttcctttttttttctttttttcctgattactttttaatcttctagcagcaagtgtttttattttttaaaaagtttttaaatcttgacttaaaaatttttaaatcttaatttaaaaaatttcaaatctcgagttgaaagttttcaaattcgagttgaaagttttcaaatacgagttgaaagttttcaaattttgagctgaaagttttcaaatctcgagttgaaagtttttaaatttgagttaaaagttttcaaatctcgagttgaaagttttaaaaaattttcttgcaaattgaaaactttcaaagttcgagttgaaagttttcaaaatttgagtttaaagtttaaatcttaagtcaaaagttttcaaatgtaacttaaaatttttcaatctattaggaaaaagaatctcctaataaaataaaaaatctattgttaattaccatcattatccttaactaacagagttagttaggctaccgcgtcggcgtacgcacatactaggaacgcccctttaactgcccgtccgtattctcagaaatggagcaaaaagccaaggcaacgttcagagcaagaatgcaggatatacactattcagcgttttatatacgtcaatggttttcaattgagtaaattgcatcgccggtacacgaacttgtcagatgggtgcaatctagtgcacgaacttgtaaaatgctcattttggtgcatgaatttgtctaggtgcgtgcggagaaaaccgaaaagtacactacatggttaatcttattaatttaggggttgattaggatactatgtaaacatatatctaagaaggttgccattagacatatctattcaataaaaatcagaaagattaaaaaacttagcactaatataagggttagaaacatatgagattcgttatttccattctgaaggataaagttaagacgaaatttataaatattacgtgtcttatgcatactcactatacgtatgcacgtcacatcctaatgaacatcataaattaacattgctaagttattttggtcctcgttcgcacgaactagacaagttcgtgtactgaaataagcattttacaagtttacgtactaaattgcacccacctaataagtttgtgtaccaccaatacaatttactcttttcaatttttattaaactacagagctttccttcttgaaaagaggaaaaaggcctacgtgtcaatggtttcagttttattgacaccttcacaaaggaatataaaggggttgttgtacgacgaaatcccgttcgaacgggatgaaaccggttgggtatcaggtataataccttatagttatcagatctcaagtattatctaataccttagggatatcaggaccttatacctaactagtatcatcccatttgttgtagtagggggtgaacgccatccctatgttcggcaaaaacacacacaataaggaaatcgtatttgagccatgcaatctgctcgaatgaagttttgacctgtaacaacccttgatcgatcatttgcatttgcccaagaaatgtttattccaaggaaagtgcgtttgagtagtttcacttgctcaaatcagtattccctccatctcagaatataagaagttttagagttagacacagttattaagaaagtagatagaattaagagaaaatcccttatgtatctatgaaagtttacctaatccattctatatccctgaattttgctcaatcccttacatacctctgaattttagtttggatcccttccatgccttttccgctagttgaccgttagttaaccgttaaattcttttgaaaaaaagtccattttgccctttgctacgaagaaacataataaattaatgaagtatattgttggaatgtaaaaatttattggatgagactattatatttatgagtctgtgatgcaccatattatttgtgacaaatttacttttacatatgatataaaaatttaatacttatttattagttattaaaagttcttttatgtagcatgtgttttcatagtaatacaacagatttgtttattactatcagaacacatatgctaaaaaaataaataagtattaattttttatgtcatatctaaaagtatatttatcgcaaataatatggtgcataactatctcataaacataatagtctcatataataaatttctatgctccaacaatatactctattaatttatatacttctttataccaaatggcaaaatggactttttcataagaatttaacggtcaactagcggaaagggcatggaagggatccatactaaaatttaggggtatgtaagggattgagcaaaattcagggtatagaagggattaggtgaactttcaggggtacacaggggttttctttagaattaaatagggaaaggttgtgattggttaagaagtggaggtagttaggaaaagtgaacgatggagggttgtgaattgttgggaagagaatgttggtgaaaaaaaatgttatattttggaacaaatactgagtgttaaaggttgttatatttttggactgatggggtatattactaacaacacaacgtgtttggacaattctcttcacttagcaggtgagaagccagaagatgggaaaaatgtattcaagccctcacgagagagacattactctacccggatgattgaagtcaagggaaagtatcattgagcaaaagaacatgtctcaagaaggtaacaggggatcactccaactacaaaagaacatgtctcaagaaggtaactggggatcactccaactacaaaagaacatgtctcaagaaggtaacagggatcactccaactactctcactggatgttacttgaagaccactaaaatatagtaaaatgctcttaggattgtaaa

SEQ ID NO: 23813 - DNA, 4352 bp, Oryza sativa
ataagggtagatgataatatgtaggccctcagggcaaacttgtaatctcaagtgtatggttgagagtcatttaagccgacctagatcctgtaagcagggacaagttcaatagagaaaaatacttttcactcactttgcttttgagctcactctcaggataggcgggaaactatacttccccgtctatccccaaatttgtccgtaccctaaggtcacgataccgttcgaacgagatatcgtcccgtagtattcttgtaaatcaatttcttgcaatttgtttagaattccccaggaaatcacaacatcataaaaaaaagaaaaaaacaattctaaaaggttaataaatgcagagcttttcatccttttgtcggagtttgggggcaatgcgccaagccgccaacaccatgctgccctcccactctccagctgctacccatcagctacccacctcccctcgccgcagcacgcgccccgcgccgccaccaccatgcccatgcccgcgcgccggcgcagccccggcggccgagtctctcctccctggatgccttcgggcggagtcgctgccccggcacgtggcggtggtgatggacgggaacgcgcggtgggcgcgggcgcgggggctcccgtcggcggccgggcacgaggccgggcggcgcgcgctggaggagacggtgcgtctctcccgcgcctggggcatccgcgcgctcactgccttcgccttctccaacgagaactggagccgccccaaggtacacacgcctcgccgccgattccttcgaaatctctgccttcgccgagcttgacgcgtcctcgccatgttggaattcgcaggtggaggtggacttcttgatgaggctgttcgagcgggtgatccacgatagcgtcgccgagtttctgaggtaaacatccgtacttgcaaattaaataattagttaatgcctcacgcgttcacaacacttggctttgtggaactggaagttcgccaatagatgctcaaagcccacagtgctccgggcgtaccagcaactcaattaccagcttgtaataggaatttcttgcaagattcataggaaaaagattcaattttcacaggagccagtataatttcctgccaaagtctaatgtgtacatgtcatgtggtgatgtggacaacaaaatgaggattttttttttccacagggaaggaattcggctacgtgtaatcggtgacagctcaaggctaccggtttctctacagaagattgcgagagaagccgaggagaccacgaggaacaattcacagcttgatctgacactggcaatcagctacagcgggaggagggacatcgtgcaggcgtgccggaagcttgcccagaaggtgcagagcaaggcgctcgcggcggaggacatcgacgaggcgctgttcgccgacgagctcgagacgagctgcgcggccgacgagttcccgtaccccgaccttctcatcaggaccagcggcgagctgaggctgagcaacttcttgctgtggcagtcagcgtactcggagctcttcttcaccaacacgctgtggcctgatttcggggaggctgattacctcgaagcgctttgctccttccagagcagagacaggcgatttggtgtaagaaaattgtagcacaaacatacaaaagttgaagcatgaaaggtatgtgtctgaaaatgctcagtgatagttggcaggtaaatatcagtcaatgcttatgacttggttctctgcaggaatgttgatcaagaagcataggacatcacatttttcatgttagttcaatacttcaattatccatgttaaaggcaagtctgaacatacagtacaagaagagccaaaaatatgtagaaaagcaattcagcaagtgaaaacaccatgacaactaggcatactgagtagaaaaatgttgctatgaaattgcaagatgaggagcacaaacacgaatgtcatgtatatggcatttgattcacagaaccacaaacaaacaggtttatacaaggaacatatgaagagtataatgtattcgatttattagaaccacaaactagatagcagtgaatcattcattgtgtactcgacggagtagtactagtattaacggccaagtaacatgagattggccaacttatttggtttcagttcctttttctcacatattcctgcatcttcttttttcactacactttctgatcataatatttgattagtactggagaccatttattcaccggttatacaaactataaaaataaaaataatctaatgccaactacaagtgatttttcgttaattttgaacgaattttagcaaaatttcaatgaactccaataaactttgaataaaaccattcgagatgcgcattttgagccggctctagatgctcaaatttcgccgagattttgaaccctagagtgcatacaactctataattcttgtttattcattgtcctttgcatcttcttcacactttaagcatatcatgtccttgtattgctccattatgatcaatggcaggatcgatggcatgataaatgctggtaccattgttgcggtctctgtagtactagcacataaatcatgtaaaagaggtagagggtgtccagttcaggtgagtgaataagtactaatgtgttcacgggttgtgcttgtctagttgtctatgtaaccgtaatttttttttatagaagttggggtacgaagatataatcatcagtaccccatgcctgattacagctcatgagaaatcttatgaaatatgataagagtgaactatatatatatatatatgcatacatacttactcccactgaatgctactagtagtttgtacatatcagttgaagcagccaacggaaagttgtttaacatacatgcttggttgtttattactaatgctgataccaatttttttgtccaaaatttattcacagagtatttatccttgatcccaatccacccataaatccaatccaacctgattgttccacaagcatttcctattttcccacacggttctaagctggtccgcagtagtacaattcaacagaaaaggagattccccaatatgcagaaaacaaaaactagtctcccggtgcaaaccacgccggatgcaactcctgcgtaggactgtaggagtcaggcatggaccctagaaaaagtgagatccatatgtcagttttgcaatgatcaacttcaatacgatactatacccatcctaaaatataaaagattttgctaatatattagacggatgtagtaataaattgtactgctttcgtcctagagtaaatttatttattttttgctcttctcttttgtctcaaatcggagtttgtgaaagtatgagataaattcactaggagtaaataaaaggaagaataattaaattgagatttgataaaaatagtggtattttagtctttttttgattttgtattactccctccattcactttaaaatgtgatgatcaaattttaaaatctgattttttgaaatatgacaatcaaagtgaggccgtgtttagtttattttaaattttcaaaaattccaacacatcaaatgtttagacacatgtatggagcattaaatgtggacgggaaaaaaaaccaattacacagtttgtatgtaaattgcgagacgaatcttttgagcctaattacgccatgatttgacaatatgatgctacagtaaacatttgctaataacggattacttaggcttaataaattcgtctcgcagtttacatgtggaatctataatttgttttgttattagtctatatttaatacttcaaatgtttgtccatatacttaaaaaagttttggcagaggaactcaatacagccgcctaaatgaaaatgaaagggagtagcaagtactccgtaccccatattggggcatttaactatttgccacttttagatttgacaattaactatttgtcacttttagatttgacaattaactatttgtcacttttagatttgacaattaactatttgtcacacctatcttaatgacatgtggattcagtggcaaatagtcaattgccacatctaaaagtagcgtataattcaatatctccatattggatggatgaaaaagtagcctttgaaataagtgggacctgaatatcagtgatctcgttctgaccacaccgaccgtacatgccgtgccggggtgcctaacccagtgacgcaccgagccgggttcggcacgcgacgtggtccgaccgaccgcagccagaccggagaccggaccggacaaacggaaccctccaccctcacgcctcggcccccaggctgcctatataagcgcaccgaagccccctctttctcagtcttgactc

SEQ ID NO: 23814 - DNA, 5413 bp, Oryza sativa
  unsure (1)..(5413): unsure at all n locations
ggccggtgccaccgccggtggggtcaccatgcggatgttccacggcgacgtgttcctcggcgaggcggaggtgttcccgatgaagcagggggccgaggggagcctgccgttcccgagcaacgagatccgcatcagccacctctcgccgacgagcgagcggtgcccgccgctcgccatcctgcagaccatcgcgcccttctccgtgcgatgcaagctccaggccaagctgatgcctccccacccgagcctacaccgcctctacctcacttgcttcaacgagtacaaggtttgcccccacgcaatttctcaacaatcgctcatgtccatcgctttgtattagtatagctggtactcccattcgaaatcgaagcgaaataagttgtttacagcgactacttgggaaatggtattagcgccacttctaaattttggggcaatcaccagtaatcaaagcgttttacacattctattatggatcttcgatgggttgtgtgtttgatgtggtttgattcgttcggatgatgtttcccattgatgatatttccatcaggggcacgaaataataggatttataaaattttttgtctccttgggtttgtgtagagcgcagtggtagtagttggagatgaggagctacacctagtggcaatgccgagcaaggtggagaaggtgccatgcttttggtgctgttcagtacgctctgggatctatgcagcatctgttgggatgctgaacttgcggtgccttgctatcgtatttgatctcgatgaaacccttattgtcgctaacacaatgaagtcctttgaggaccggatcgagatgctttcccgtaggatggatattgaagacgaccccgtcaggatagcagggatgtctgcagaaatcaagcggtatattgaggacagggagctgctcaaggagttcattgacacagatacagttacagataatggcagaatcgttgggacccaaaaggaggaagttctgcctatctctggtgggcaggagcgtgttctccggcctgttatcaggctgccagaaaggaatgcgattctaactcgcataaatccagaggtacaattcagatagatcatgtataaatatatttcatttaaatgaaatgttgttatcgtttgcctgtgtgcatgtttttggcctggggttatctagaattacactttgaaatcagttggacctattcctgggttggaaaaatagaactgggctccaatttgctgcccacaaaaggcatgctgtatgtctatttggttattagcgatggtacaaaaataagttctataaatgacttgtaattgctgcagttttgatcctcggataagacatatttgttcaggctcattgtttctacctacaggtctgtatgatctgcatagttacataatttgctttgtacatgtgatgtttatgaataaaacagatgcagaaatgaacttgtagcctgatggtttgggaaatgatgaaataacaattaacacaaagtttgacaacctacacacaatgtgttattatcagctcatatgtttgctgccaattagaaaaaagagattctattttagtaattatttttgtaatgcttatctgagacgattaatcaagctgattaagtcattctggactgaaaatgggctcagtataattctcatatgtctagttattcaaaattttgagataactagagtttttaattattgtagaattctgtaattagttcccttttttgaggtgattaccttatcccctgtctgattttaatactctgctcaggttcgcgatactagtgtttttgtaaagctaaggcctgcttgggaggatttgagaagttacctgactgctaagggacgcaaacgatttgaggtctatgtatgtacaatggctgagagagattatgctcttgagatgtggaggcttcttgatccagaagccaacttgataagctctcataaccttgcagagcgtgtagtatgtgtaaagtcaggtaaattttcaagaaattggaggttcttttttttctgctatctttcattgctttcttgtctcaacatgttttgttatattgacatcgttactaaacacagagtagctactttaaaacactgaacacgaatattctgtgttatctatcttttcatgtacaatgaaattatgttgtgtttccaagttattgagaaggaatgggttcggtattgcagattagtgtcccagagagaaaacccatagtttttctagcatgtatcgttcattcccttagtattgtatttcattcttatccttacaacttcaaatatagtgcataagtagtactaaatattgtttaaatttgtataaaacttattcttagtttaaacaatataatatttgtgtagaatgcttaagtgaatgagaaattgcgctttgccattgcccattatatggataatacataacatagatcttcgctttactatctctattgtctcagctctggactatgttcctgccataatttcatggacataaccaccaatattattcattattctatttcatggcaggttcgaaaaagtgtctgcagaatgtttttaaagacaaaggatgccatccgaagatggccatggtaattgatgaccgactgcaggtttgggatgagaaggatcaacctcgagttcatgttgtcccagcatatactccatattatgccccacaagctgaggtatttatttgtattttattgcttacactttttttggtcaacaatatctcattctggaccctgtttgcatattttagatggcaaatgctgtgcctgtgctttgtgttgcaagaaatgttgcttgcaatgttcgtggtggtttcttcaggttggtaaaaaatataagataccgtatgtgcattctgatgatatcatgcttactgttgtaatgttattctttgcgttcatcaatgcattgcagagagttcgatgaaaatctattgagaaaagtgtttgaactaatgtatgaaaatgagttgctagatcttccatatgctcctgatgttggtgactacttagtctgtgaggtaacattattgaatcgttgttattttgtgtgtgtttattttctaaatggttatccaactgctaattttgttccaggacactaattttgcaccaaacaataaggatgttgcccctatacctgagggtatgagtggagctgaagtagggaagaggttgaatgggctggtgagtgctgatcttcgtttctgctttgctttgatttttagggacttgattttttttttcacctagatcaaatcagctaatgatgcctatttctatggtaagcgctgttatacagcataatataaatgctgtcatgtagcttgatttcaattatttataaccatctactttgtgttatttcattttagaagaaatgtaggtgtatcaaattgatccttctttggcttacaattggatttgtccttgtatcaaaattaagtccacagttctatcacttagctagcaaaatcatcactagtttctttatcagtttgtaatagactagtatataatgatcatgctagtgtgttccttatttcaggcatatcctagagaccagaaacaaataccatcatcaacccgtttgtcaggtacttacctcatgtccattatctttattggctttcttttggttcttcttcctgggctttcttgaacccttgcatttataaatcactttagtcattttttattattaccttgcggacattaaaagagggaatggttttctctgtaccattttttccctgtaaaggaaagagtactctactatgaaatgcagcagcatcaacattatgcttgaaaatcctaattgtacctcactattattaaagaagtacaattcatatattgttttggatctgtaatttgatgcttcgagtaacataaaccaatctttgtagatgacgacggagtggcactccgtggcattccaggtggtacaaatatccaatctaacgggggatcattggcaacaaccccctcattatttgtcacggtgttgcaagaaattggacggctgtgcgaatccagggtatttggatctttaagattatatttgttttctgccattgcccttatgagctgagagtaatctcctgttctttcttcattaggtggagttcaggtctactgtaagcagtggaaaaaacatgcaattttctgttgaggttggcattttgaatttttacatattatacttcgtttccatgtggtcttggcaacagcttgggctgaaattctaattgagaaaaatatatatttagaatgttgagacacatttcctttggcgtctcaactctcaacttcagcatcagtccagtgcttttgctctgaagctgtttgcttgcgggtgcattaccagatttgtatagcaatgctgtgatatctctacttaatcatgtgatcctcatgttacctatacatatgatgttccaggttctatttagtaatgaaaaaatcgggatcggcattggaaaaacaagagatgaagcccaagtactagctgctgaaaaagctctccagaatttggaaagtgagtataatcctttacatcttgattattgcaagcttgaaaagttacgtttgttttacaattccgtgtttacaggtgtcattctttttctaaagcattcactgatgagaaattccatgtgccttaaatcctgttatctggctgacttgcaggcaattacttgtcattcatggctcctgttgctggagttcttaataaagatgtgaacaagcctcctgggagtggaaatggctttctcgaagatattactctctcagaggatatttctatggaagagccatctggaagtacattaaaagaacaggatcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23815 - DNA, 636 bp, Oryza sativa
aaaccttatttacaggaaaagcaatatcaggcctagtcaatgttagatactgtaaagcaccaactacacttctataatgtgttgcatcatttggtcctaaaggatctccttcatttatagacaatttctcacttgtagacaggggtgtactaaccggtttgcagtcaaacatatttactcttctcaacaaatcattgacatatttatcttgagtaagaactataccaccagacactttagttacctcaataccaagaaagtaatgaagatctccaagatccttcagagcaaactccttttgtaaatcctgaagcaaggctggaacagcttcctgtctagaactggtgacaataatatcatcaacataaatgagtacaaatataatcaaatctcctttgttataaaagaacaaagaagtatcagccttggacccttggaatcccatatcatataacttcttgctaagcctagagtaccaagctctaggtgcctgctttaagccatataaagctttatcaagcttgcacacataccctggcaaagaactgtcctcataacctggtggttgtttcatatacacttcttcttcgagaactccatgaagaaaagcattctgaacatctaactgtctcatac

SEQ ID NO: 23816 - DNA, 694 bp, Oryza sativa
  unsure (1)..(694): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtccttaaccaatgtagattaaacaaaaaatctgttaagatagtgtgccctttttttttttctgttttctattgcgtggttttctttggatattagatatggtttaactgtgtttttttcattactaaagaagggtatactttcaggtttcagttcaggaagttgtgtacctgtgcaactaattcatgtatactcctcttggaaagcagtcgattaccagatcctccagcatccacatcgactgaagccatgtctccagattgcacattagtagcttttagtacagcaggagaatctagcttctgagccattgagacaggggtacgagcagtttgctgctgagaaatttgttgctggtttctgagtgttgtagtctgttgactttgctgcgaggaatgttgtggctgattttgttgttgctgctgctgctgctgta

SEQ ID NO: 23817 - DNA, 227 bp, Oryza sativa
gccgattggtttctactggattatattgttattttattacatcatcatcagccgattgccttcatatcattatttacattggacatatagccgattgcttaaacgctatcgctatcggctggtatcggcatcggctattatcactatcggctggaactactccatcggtttgttagccgatcggctgtttgatctactatttgcatatcttgtcagttgcaggatca

SEQ ID NO: 23818 - DNA, 8745 bp, Oryza sativa
  unsure (1)..(8745): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggtttttctcaacgcacaagctgagatccgcgccttgaaagagcgtggaattcagcgcacttcgccgagtcgtgatgtctattgtcctattcataagacaaaaaatcacgacctctgaagctgcaagattcttctcaacgccatgaagacgtcgcctcctaaggtccagcagtcacgaatctctcctagagatgtgaacaaggaatgaggaacgatggtcatctcagaccgattcgttggggtgatcgacattgatccccacgagccatcagtcctacactcgctcgaggaccagggttcatcgttgacaagtacaccacgcgatgtgtttgctatcgaagggaccagcgcgtttgcgcgcgccgacgcggaagcagagaatcaagtggttacaccggcccagcatattggggccatcaacgcaatactgagggaaaccccttatgatcccgttctgaacgatgatctcgcacggtggacagaacgactacgggaatcagtaaccaacctcaacaacgcatttgaggaggccgctgccgcggcacacccagaacaaccgccagctggcggtgcaaatggcgcaccactagaacagcaggcctcaccccgacaagccacccctccacaccacggcaccagcgatctccgtgaccatttaaatggccgccgagaagcacgacgcgcgcaagacaacgtaaatcgttcccgacatcgtctctcttcacgacgtcgagagaacgaagagcgaggaggacacccgagcgagaaccgagaccatgataaccgccacaaccaccatgaacgcgatgatcgcgaacagcggatgccgggcgatactggtcccggacgccgccatgacgatgacgatgatggagatcggcgccggaacaacaacggtgtacgacgagaggattcccgagaacccgggcgtcatcctcggaatcgtacaccgaagccgagtgacccatcgtcgtcgtcatcatcctcttcatcctcatcatcagagagacatccgcgaaggacatacgatcgccgacaacccgccgcccccagcgctaggtgtagagctttcaaccgttcgctacgtgatgtccgatggcctgagagattctgaccaggagcaatagagaaatacgatgggagcaccgacccagaagaattccttcaggtctactccacggtactctacgctgccggagcagacgacaacgcgttggcaaattatttgccgacggcattgaagggttctgcgcgttcatggctgatgcacctcccgccctactcgatttcttcgtgggcatatctgtggcagcagttcgtcgctaacttccaaggaacttacaagcgccacgcgatcgaagacgatctacacgcgttgacatagaatccgggcgaatctttgagggactatgttcggcgctttaatgagtgcagaaatacaatccctgaaatcaccgacgcctctgtgattcgcgctttcaaaaccgatgtcagagatcactatactacccaggagttggcaacaaggtggatcacaactactcgaagattgttcgagatcgtcgatcgatgcattcacgcagacgatgcactgagacgcaagaacgacaagccgaaaacggggggagagaagaaaccagccaaggacacacctgaatcaagcaagaagaaaagtagcaagagtgggaaaaggaaagctcaagcggaagtcctcgcgtcagaatacgagcgccctcccaagcacccagacacacaaggcaacgtcacgaagagaatatggtgccctatacacaagtcggtcagaaattctctgaaggattgcctagtcttccaaaagtcgttggaaaagcaactggcattagagaagggcaagcgagtacgtgtagtcgagaaggccgttgaggcaaccactcaggactcggactcggcacacccagattccgatctccatgtctcgcacatgttcgaaggttccacgatgtactcctcaaagcgagaatacaagaaagtggagcgtgaagattgttcgacatggcagggggctgcacccaagatgaagtggtccgaacagaagattgagttctcagatgaggaccatcctaaggctgctgtcatcccaggacgatatccgatcatggtcgagtctactattcggaatatcaaagtcgcgcgagttctcatagatggcggcagctccatcaacctcctcttcgccagcaccttggacgcgatgggaatcccatgaagcgagttgactcccaccgatcaaccaggtgcacaaagactacaagtgctctagcccagagttattcaagtacctcgcggaggtcaggaagctggaaaaaagatttgatggaatcgaggtccgacatgtataccgcaaggacaatatcgaaccagacgatctggcgcggcgtgcgtccagacgggagccactagaacctagcacctttctggacgtcctgacaaagccatcggtgaaagagtcaaacgacgaaaataacatagtcgccttcgacatcagcttgggggctacagaggtagaacgcgccgttgccgacatcgagaccacagacgactggcggatcccactcgttaaattcataagtagcgatgagttgcccgacgacgatgcagaagccaagaaaataacccgctaggccaaaatctactgtatgatcggcaatgatctatacaagaaggcgccaaacagggtacttctcaaatgcgtctcgtccgacgacggcaaacacctcctcgtcaacatgcacgaagggatctgtggatcacatgccgccggtcgtacattggtcagaaaagcctttcgacaaggatttttctggccaactaccctcaaagacgcttgtgacatggtacaatggtgtgaagcttgtcagtttcatagcaaacacacaaagctaccagcccaagcactgcaaaccatccctctcacttggccattcttgtgctgggggctcgacatactcggaccattcccacgaggacagggtggctacaaattcctgttcgtggcgatcgacaagttcaccaaatggatcgaagcaacactcacaggggaaatcaaggccgacaacgccatcaaattcattaaagggatattttgcagatatggattgcctcaccgcatcataacggacaacggcacccagttcatcagtgccgacttccaggattactgcattggactgggagtcaagatctgcttcgcttcggtctctcaccctcagagcaatggacaagtcgagagggcaaacggcatagtactacaaggaatcaagacccgtgtctacgacagactcatgtcacatgacaagaagtgggtcgaagaactcccttctgtactttgggacgtgcgcatcacaccgacaacgtccaacaaggagacacatttcttcctcgtgtacggctcagaggccatgctccccaccgagctacaatatcagagtacacgagtacagaagtactccgacgaggatcaggaggaacaacgaaatgatgatgtgaacctactcaaggaacatcaagaacgagttgccgtcagagcagctagctaccaacaggctcttcgtcaataccacaagaagcgcatccgagcacgtacgctttcgatcgacgactacatcctccgacgggttcaaagccaagcagggcgaaacaagctctcacccaaatgggaaggaccgtacacgatcacgcaagccctacggccaagcgtattcaagattgcagacggcgatggtcgcgagttggcaaattcttggaacattgatcaattacgtaaattttatgtataaatcaatagcatccattcttgtaagacatcttacagcttcaataaagctatttttcaggaaaagattacaatcaaagtgttccttcccgatgatcccttaacccgatgacacctagcgttgaaacctatcctcatgtccctttacgccatcttgacaaggcctccgaggaacctaagggaacttcggcttgggacgcccagagccgataaggtcttgtcggatcctgtagaaacaaaagaccatgtaagatctggtcgtgtaagagttctcgccgtgcgtattaaccaagccgtgtaatcggaaatcgggttttccaacttcacggctgggggataggatcagtgcttgttcaaccaaggcaggtcaaaggtccaaaagccatatcttccaagaagaattctccgatgacaaggctgggggttagggagagtgtatgactcaagtgactaatcgaagtcacaaagtgagaagacactcgtacacacagcatccagagtaagaaagcttagttagatagatttcctttctatttcacaagtacttcttacagtccgcaaaaaattccaaaatatattacactttttcctaagatatttgtcacagatatataaagactaccaggaaggccaatgccaatcaatcgactggaagactttctccgccagcggcgccatcgacttcgctaggttgtatatctctgcaggagtcctccgagaacgagaaaacccttcgcggatgaactcgaggtgcagctgcggatgacgatcttgtatacaggccagcacgtgccctccgacataccggctcgatcgacgtcactcctgctttaggcctcgtcgatacgcttgctgatgccttcgagctgagcgcaagccccattcagccacgagatgtatccggccgctgactcctcgggatccccgcgaggtactcggagttccctgcagactatggccatggttttgcaacaactcctgaggtacgagttgaaccacacctcgcgacctcggagtgcttccagggcccggtgcttcttgacttccagcatagtcctctcgagttcggcgacctcaaacttcatcctccagtactggatgcgacgatcacgatcggcaagcgcactcacaaggtctgctcggcatggaaacgactaagttaagctgttctcctctttcgagaacacagcaaattaagccaatccagaaagaagagcaaaggggatggaaacaaaaagaaccaacctaaggaagtcgtcgccatgcccgtttccacgggcagattctggtccacgtcgtcctgcggcacatatggctcgagcgcaagtgccggaacgattacaggcaactcaggctgcccgcgctgctggacatcctcgacatctacatctgtacaaacaacaacacaaagtacccggaatcaaaatgctaaagaaaactaaggtaatgactgcacacacaaaggcagttggaaccgacaaaagttttacaaagcataattgattaaggagtacagccgaactgaagtcctactcttcaaaaagtgggagaacagactctcctagatcactgacttcttccatcacgtccttacgcgcgttgttagccgccccctgatccaagatcctctggaaatcgagttcagggtgcgacaaccttacgcacgcgaggaagtggcacgccccggtgtagatcccgttggacgtctcctccccgatcctggccacatgcttggagcgaatcacctccatcgccgtcgccagtttcgcgagcgaagtcgtcagcaagaactcgtcgggattcgccaggatggtgctcatgacaccacactccccggcgagctggtgtaggcctgtgtaggtaacccgcagcgaaccacggatctccgacaggttgttctcgagctccgacatgcgctgctcgagcccctgcctttgtcgctcgttgccggccaccagcttcctcatcttcttgaggtcctcgcgaacctctgccaggtcacgcgccagcttgttggcgcgttcattcgccgacgacgccgccgccgccctcgcctccgcaatctcgcgacctatgccgcgagcgccggcctggaggatgcgccccatctcgacttggagctcctcccaggtgaggacgtcagcaggcgggcctcgagcaggcacaagatcgccggcagggccactgggcgtcgcctcacggctcctgggcatgactacgacatctgtcgaggccactgcaggagacgcactggagttccctccggacccatcttgcgccgctttcgcccgcgctgccttgcaaaaaattgccataatggccatcaagacaagctgccagaattcgatcaagtgaaggacctcaaatttgtccacttacttctcaccaagtgtcaccagcctctgccgtcgcggaggcgggggagacgcatccgatgcctaagtaaaacgagtacggtgtgaggacaacatcttccgactacgcaataaatgaccaaaggggctcaccgatggagtgggcgccttccgatgattgccgagcatggaggagaacttcctccccttctccacatcaatgccacctaatggggaggggaggggggcggttggaagatctagcacctatgggccattactatccaacaccaataagattgtatgtagtagtgtgtaccctgacccttctattccttgttgatagcaacacctcatggatgccctgtcaatatatctatgtttatattataatagaaaatagttgtcaattttttttaattgtgtcctcgtactatcaacttggagtgaatatgtcagttttgtatgatttgactctcctctacatacaccagaggacaaatatctaatgccttgtttggttcacataattcttgatagaattaaactcagcatatatatggtcttgcatgtgcttccatagtgtgcttctgtaccatctcgtaccacatataatcaaattaagaagcaatggatggaactctctcataacccgatggccagaagcccagcactactgctacctcacgaatcgcgcttagggttaggaagtatcaggaattataacatgtccatttctgatcattttgacaacgatctggactggatagtacgtagaggggcattgttttttcaaaccaaagagttttttcaacctttggtatgctgaacttcggacttttggaaagaaacagataaacacaaaagatttctgccatcgagatgtctagcttcaacgttgttcttcgatcgccaaatccaaagacggaatgtggacctacatattagcagaagcattggcagcttaagacaagccaaagaaatttcatttctattttatttctctatctgaatgccaactcttctctcttgtaattaattaattggcaattctcctgctaagttacagaaatcatttccacaaatatactggttcaaactgaacatcagtatgataaatatatttttttatgatgtcaacctcttctccatcataaataactgttcagcataagaaatatattcagacaagtatgtacttttaataattagggtttgatgggtattggaaaactatccaatcaactgcacggacaaacaaaaccaatcgttttctctacatgtcgattgtcgactattcgtgctctgatgaaaaacacaattagagcgatcactgccaacgattcgtatgatgttaaacactgccagtctaccaccattttaccctcaccattttatccttgctggatatatatagcaatacctcattctaattcatctgataataaatggtaacacaatatgtatcaaatcatccttttggatagtttggtttttgatcactgaaggtaacttgcatcacccgttttttcatgtacgcatggcatgcatactgcagataatgtatgttcgcaagtccaatgtcagcgtgcatatgcgattcctaaccaatgaagatgaaggtgaaactaaactgctgaagttatcaacagatagaaaacatgtctacaaatccaccctgtttctgagtccagaaagattatttaaaactgattaaaggatctgttattatagctgattggacatctagagagtgatttatgaaataacctagatgagatgaatgttcgttgctataaatgtcccagaaaatatatccctcaaactcgaccatacgagcgcaagcaacagccccaaatcagatacagtagattatttctgcttttgtgttggggttgggggtagcttaattaatttggcagcaaattgaagtttctgacagtagttgtcacatgcattatatatatgctagctaatttgcatgtgctttccatgccgtgcatgattctgtatatataatctcatatatataccatatatggaggagtatatatatatattcaggaagcaatcgatggatcaccccaataacccagatggccagaagccctgcactgttgtcacctcacacgtcgcacttagggttaggaagcatcggaaattttactgtgtcgtttttcaacaattaggctggaagtttgatgaaattttgaagtacaacaatttgtaccagattgtaggggaaaatagttttttctgtg

SEQ ID NO: 23819 - DNA, 16012 bp, Oryza sativa
tgaagaaaagataaatacaagagttttatgcttttggaatagcttcaacggggccgttcggtggccataggccgtgccatcaatagtgtgaaaaagaatctgatagtagctagctgcggcagctagaatcctgattatagtccatgagagtaaggataataacttagccagcagccggctaaaagtcactgccatgtcacttagccatgctctaaaaactcacctgtataatgggttggctataagttgactgatacattacctaattaaaacatctaagcaattaatatatgcatgtacaaaacatccgttgtggagcaagcgccggcgccagcaacgggctgggagcgggcgtttcgcctcggatataacgctccgagccggcgactcgcgactcacccatttccttctctttcttggtttctcgctcctccacgttggattcgatgacgtagctgtcgatttcgctggctgcctgtacattactatacttgctctgatagtagctgcaagcttaaagacaacccaaataaagaatctcaattcactttttgtttttttggtctacccacatgctaagccttctctcctgtaataattaattaatggcagctttccggctaagggtaacaccaatgtatataacaaaagtaatccatatagatgggacccacatatatagactataactaatgttatcttcacaatgtatatggatagcaactagtattaggaggagagagaaaatagagacaaataatatattttattctatatgggcagcccatatgcttatgggtggcttttgctattttcttgctatggactagttacacaatgtggttaggtggctgaatggaatattttattgcttattgactagttttaggcagcgttcgagagggtgagagagtgagtttgtttgtttcgttttccgcgcgcacgtttcccaaactactaaacggtacgttttttgcaaaaattttctataggaaagttgttttaaaaaatcatattaatctatttttaaaatttaaaatagttaatactcaattaatcatgcactaatagctcacctcgttttgcgtatcttcccaatctcctcaatccccttctcctcaaacacacccttagactacattgtggatgccctaagttacagaaatcacttccacaaatcttccttggtttccatttccattagtacgcttcccagctaaacggtgcatattttaaatataatttatatagaagttgttttataaaaagttcaaataaatctatttttaagttacaataattaatatttaattaattacgagctaattagttttaaacgaacaaaacctaagctttactagaatctcgttggagcccttagtaaatggttgtcactaagaaaactacccttttacaatataagacaagaactgttagctattaatttaccaaaataatattttattatcgttcttttcttaattttatccatccaatgcagtaaattttccttttaaaatgctaagagttgatgttgagctaatatatcgtgcgtatgaatgatgtttcttttttttctcccctttctatcttatgttaccaaaattgcttacacggcaacagaacagagataaccatgaatacagcaagggtaaaatattttcggatgtaacacaaagatgtcgacacatttatttatgttctcttatatgtattaatccatccttttttttttcaccccatgtagtaatttttttttaataaatactaagagttgacattgagccgatgtcatacgtatcaataataatgtttctctttttcctttttcttttacattaaaattgcttacgcggcaacaaagataaccatcaataaaactaaggtaaaatattttcaggtttgctagaaagatgtcgacacatatgttctcttagctattaattcccccaaatattctttcatcatatttttttcttttttttcatcccatgtagtattttttttaataaactaggaaggaagcccacgcagatgtgcgggcaattcacttattgtttataaaaagagtactaaaagatatctcgccatattcactatgagaatcattaccttataataaaaaaatatttattctgtaatatagaccataaactttgatatactatatgataatgcctattatattcaaacaaaaatcactttattatcaccatccttcacaaacatatgaacatactagttaatatgtgttttggttttttttttcttttactatacatctaattcacttatgcattttcatgggtaatatacgaaagaataatttatattgtcaaaatttattatgctaattattaacactattaagatgattccctaaatataaagagatataatgtggttccacgtgccattttcgatcgtacgcatgtatgtaacatgtatgtatgtacgtacgtacgaacgcacgcacgtacctacgtaagtaggtatgtttttcatggtgaatagtagtctctcggatctatatattttttcttggttttttacaaatattttccccttgtaggggataatgtgtgtagtgtattcacaggatgggtatgcatgtgtttatatgagcgcccaactgttttttacatcattataaaaaaatacaagtggtgccaagacgacattgcttcctcgacaacatcgctaggagttaacgctgaaaaaaaatctaccatacatgcgaaatggtatatacactctcttttttttctttttacatctctcgtgtatgtacgtatatagggagggattaattgtttttaggagcaaggcattacttcgatagatctaatataatggttgaatataatggatccaccggtttaagtgtaaattgatggcaaggtgttttacttttattcttagattttgtgttatttatcaaagcgttacgtggcttcttaggattgtaggaaccctattagtcatactcgcaatctatttgtagtcaactattatttgttgtggcttggtggcaacctctacttatcatttgttgatgattgcctatttagtattatttcttatcttaggtgcttgatgacacacgtgctcattgaattattagtttggtttttcatctaatttaagtgagaaagggaaaaagaaataaagatgtggggcttggtgtgcgtaagtatgcatgtacgtagtactatttttagtacgtatgtaactacttacctgcacgtacacattatagatgtggagctatttacagataaatttaattggtaagttttttagataaatctaatggttaaagctaattgaaccaccaaattattttttccccgtagacgtgatatatggttacttaaaaagcgctctataggaagtttgatcaattttgatcatctggattgacttaagataaaatgaagcatatcatcaaattctttttataatgtcttattcttgtttggtttccatataatgtccaaatgatgtatttcaattttatatagtaaaataaaatatagataatatgaaacttgaattattttattgaataataaataaaagaacacttaaaggaattttaaaaataataattgttaagctatgtattttttttataatatataacgttgtcagttttagggggggaaaaggaaaggatgtgaggggggaggaaagatacgtacgtttctacacgtggaggttgatacacgtacgtcacgtgaagggatggaaagtgggctttttatgtttttatattgttagataaatctaatggtaaaaaataatgcatgggtccaccgtgattaagtggaaattattgtttggattttttccttataatttattagagagccacgtggcgatttaggagtgtttataggaatcccacgtggcggcttgagagcgtttgtaggaagtttaatggacttatataagatagatactaagagttgacgctgagctgatatcatacgtaccaacgatgtttctcttttccctttctcttttgtgttactgaaattagttacatcgcaacagagataacaattaataaagctaagataaaattaatattggtttttatagtatctattacacagcgttttctccatatgttggccatggatttctcttgcaatcatgtagccgcagaggatatgcaagtccccaagatgaagatattttatatctcaactacatgctctcgtggaaaactcaaagggatcactaatgaagattaaataaataacatcgctacttggttgagtacattctagttgatcttcgatcccacgattgtctcccttcgacatttttagtgaaaatgatgcccggctttgattgggtctatgctgggcaactagattgaaaggaactaataagaaaccaaagttggcgtaaaaggcgccattagagcttacattttttagtgacagaacagaacatgccaaaacaccgaccactttcagagaactaattcagactcacatactccgggtgtgtttagttcctgaaaaaagttaaaaatttaaagaaagttgggagtttggaaaaaaagttagaagtttatgtatatataaaagtttttgatgtgatataatgtgatggaaagttaaaaatagaggaaaactaaacacggccggaaactagaaaatatagcgaaggaagcagttctttccagattcctcatctgcatttatcatatttcaagtcacgtacggcttcttaatcgttgcagttttacagggacatgtcgatgaaagcatcagtcccctctgtcagcttcagcagcggcaacgcccttcgctgttgcaggaacgacacaaaccttacaagcaagttaaaatatattataaagaacgagtaagtcagtaatttctcaaaacctatggacgagtatttcaggtaatgtttaaaagaatgttatcctgtgagcaaaacagtctgatcggagagaatatcgtaattggatgggcaatcgggcacactttttcctctatatttatatgttgtgtgctctttgaaatatcagcaaggtgatatgttggactgcgatctctcttatcacaaagtatgctacgaggcacagcagatactggaacttctatagactactgttcttgtacttgagtggtttgcacaggttacaagacgtttcgactttgattaaagttaaactactttaaatttgactaattttataaataaatatgataatatatcaaaaggaggtagtatgtcaaagttaaaatatcttattacctgaaacggaggtagtatgttattacaattttcagagatatatacatgtatcagacaactatactcgaccataaggatttggactgggaggatccaagagcagtcgccctacatacggcatcagttgttctcgtgaagttctagctaaagatgatcacatatgcattctaaccccagaaacagtaagagtaataacataggagggggtctgtcttcggatctcgtggatatgtgatcatcttgatgaggtcaggtacgttcctggagaaaccagaaaatgaaagtactagctgataagtcgtggacgctatttagcatgtctgtggctcggaccactactacagaaatcgactttggtaccggttagaaaccatccttaggtgccaaatttaaaacaagcgcccgttagacaacactgatgacatggtaacatggatgccggtacctatgagtggtacactttaaaaaaaaaaacagcatgctcactctaacaagaaatcaagtcgcacaactagtgacaaaagcccaacagaaaagaaaaaaaggcgagctttaccagaagggtcgaggccagggtggagttgtgcgccagtcggctagagagcaggttcagctttggccgcggcggtgccctgcaggaggacggtgtggcggtgaggcagcctgggtggcagagaggaggtcggggagaaaaaaaaagttgttttttattttatctggcagctggtgccaataaaggggagaggaggggcagctggttttatttaaattcatcgtttagtagttcaaaaagtatgcatgtggagaatgagtcagctgctgccgaacgcataattgtaacagttgcgagcaagtgaagaacgcaataaacagagtatgccaatccaatttgcttggttttttctcccatcaggcttgttgctcaccagttcataaaacttcctacaaatactctcaagctaccacatggacatcctataaatgctctcaagccgccatgtggcatgtggtattttaataaattaaaaaatatcaaaaatttctaaaaataacccaccattgattttcacttaaatcagtgggcttattatttatgccattagatctgttatagataacacaaaactaattaaatctatcaaaacaaacaaactatcctcccacccctccagccgtacgtgcgtatatagtatgtacttacgtcttactccttctcccaactctttttttaactaattttttcaatagaaaaataactaataatttaaaatccatatcacccatattttactatgtacaaaaactaaaatacattatttgatcatatcgcatcaaaacagaatccggtttttaatttatttaaacagtaattttatttgtaattaattaagtaaatcaacatctatattactattttgctctataaaaatttaaatacatcatttgaacatactggcaacaaccaaacaaccacgaaacattaaaatattagtgtcatcttaaatcattctacgcaataaagattcatcgaacttatcacatttaaaaattagaaaaaaattcttagaaatttgagcatcattatcattatatactaaaagtctaataaatttcctataaatgctcctaaaccgccatatggtattcctacaaatgctcctataccgccacgtggcactttcctataaaccggtggacccaacattttaaatcattagattattaattttcaccactaaatcttatcttccaaaaaaaaaatctgtacgttcccccactccaatcacaagttcacttaatacgttttaaaacgaaaaaaaatgtgcacatgtatgtacgtactccctctctccccctctaaccctccccttccatatttcctatttttttggctaacaccaaatacgtgtagtataaaaattaattagatagctaaataatctcttggtacatatatttctatataaaaattataatacgtcacttggatgtatatacccttaattttcaggggtgaactcagaaaaaaaatcgggacatcacttggatattatcagggacactacacatacaaattatttaattactgagtgatatgttaattaatatgacatgaattatctattattatatactaaagatccgttagatatcctacaaattctctcaagctaccacgtggcttcccataaacgttcctaaatcaccacatgacgctctaatatatctttatataaaaaattttgagaaaaaaaatcttacccaaaccggtggaccttattttaaaatgttagatctatatcttaaaaataaaacctaccgatcgatcaggctgtcaaaatccatatgtacaattcacatatccacttccctcctcacggatgagacgaacccactagctttcgcctcttttttcttccttacgacaattaagttaacaactgaataaaagaaaatcctaaaaagaatttaacaaaaatggtaggcacattactttataccattagacatctaacaacttctactaacttaattatatctctcaacatgtatatgaggtctatttacctatataaatatgtaaagctaaatcaatctacaaacgtacaaataaatctgtaaatccatctatgaatgaagctctttttaattactatgtctgtcctataatgaatcctacaattttataggaattaagaaagaatgtaaaaatatactaagattcccctctctaaataaggctcattaaatatgtggtatgtgcagagttagaagatggttagagtattattggataaaaaatgaataatggatggttcgatgggatgagtagtattaaaatgtataaaatttgaatcctttaatttatggatggaggtagtacaagcaaatagaagtatgtgattatgtctttaattagataaagaagccatattaccatattcttaataggaaatttcttaaattaatatatcctaaaatctataaatgcatctttagtatacaagaaaaagtattacttaaaagtttaaattaagatgctaatttttttcaaaaaagaaacatatatagtataaatgatagtttcatatgaaccatatccactgttgcgacatttttttctcataaatttaagatgacatgattcatgtaattttagtttacaatttgtaacaatccgttctctagaacaacacatcacagcctatttaaccggcactcacttacagatatcaccccacttacactttcgttgtcgcttcatgtaaaatagtcaacacgaaaatgatatggttagagggacaatgccttacaagttagttgcactcttgcttaactagcaagatagtactactgaagtgcacacaacacaaatcacatcctttaaataaaacataggccatatctaatcgaactaggatgtcacagacaccccctcaaaagacctgacgtacccatcggtccaacatatgtatagataaattaaatgcccagaaacatatcccctctttgcacgtctgtacgtccagtgatcgaaactaactttcaaaacaatcccaaacaaattattgatatacacatatttagaagagaaaaaatatttttttaaaaaaaatcatatacataaacattcgtaacaaaatttcaaacaccactaaataagatgcccgcgctgatgcgctaccttcctagttctttaaacatcagtgacgtagtcgtgcatagttgttgagatactaaaacaacctctcccccaactcgctttctttgccttcctgatctctctctctctctctcatttttaaagtttgtttttcttttgttcgtttagccacatgcaggctcgatcacgctctgcaatttagtcctaggaaccgtgccatgaagaatttcttttatgctcacccaaacggaagtacatcagtattctctccgtccagaaaaaatatatataagtatgtgaagcatattttaagtttatctataaatttaagcatttccgtccacaagtatgatgctttgtaatgttgtacaacgtccttgtaaggtactgtcctttcaatgatagagacagatattgtaaaagattggatcacgtattcgtaattttctttccaattgcaacacttgttaaccgcggaggtcttctctactgtgttctgtttaataagatatatatgggtggtctactttgagcttgccacaatgagggcagacattatttttcacacttaatttagtgttggacttttgaatatagattaatatatgttatcctagatgatgttaccaaattgttttacagtaattttttctctaactatttcacccacgtaccaataacgggtgcggctctactcagtgtaaaattactgtgtcggcagtgagaggcgttggccatactgaaggtgacacggaggaggtggatgctttcaatgacttgttcagttgctcattgtcaagctgcaattactgcggagcatgaagtgaccggaaaaatccagatgagaaattagagctgcatatgcaacaactgcttggccatcaatttctttgttattatcccccagttgcagtatgagtttgttatgtaactatgagttgttcttcgatagcgtaaggtgttttgggcgtttgttgtgttgcactcttgtggctcaaacttgagctcaaacagtgccatttagataacttttgtttcaagctattaatgaagctcgaattttaaggctttttttgtttccaatgtgtttggccctagaagattgatagaaaaaatcgctcgtttttcacgcgcacgttttccgatctactaaacggtgcgttttttaaaaaaattatatcagagttgcttaaaaatttatattgatcgagtgttaaatttttaaaaaattaatcatacgttaataatttatctcgttttgtatatcttcttaatcttcactaaacttcccctctcaaattgtcaggcacagggaaaaatattgacgcgcacaactttaatgaaaaggctaacaggcgatcgatcgcctggagcgatcaaaccccctcctccacgtggtttctttttttggcatcgcattactttcctattttaataaactaagaagatagaccacgtattcgcgcgggcatgtgtcgtacgctatgtttgaacatctacaatatatgatttctccataaattgttttcattagcattgcttttataattgtctaaccaaactattagttatctttataacatatcatatttaattaatccctacaagcaaatatttataatattcttcatcatctactaagtaggtagacatattttgtgttagaaaacatgtatagaaaattatgtgtaaaatcaaaagtaagatattttttaattgaatataggttgtcattgtttattgatggatgaattgggtgggatatgaggctccactaaatgcatgggtttatattattgtttaatttgagaaagaatccatatgcgaacgttccatgtagagagtgtgtgagactccatgcaacctagcgcaaataatattggatgaagaaatatggttgtgcaatatattattttggaagatgatgtattatgaatacacacttgtcttttaagatgagatagaactaatggttggaaataatgggcttatcggtttaaaaggcctaggaggatttatggggtaataggtggcgactttatgtaaaaaagaaaccatcatctaaaatcgattacatgatatataaaataaaattatcagtgtagcttaaaattatgctctttttaatatttgtttctctctttagttttgtagctgaaaatagggaggagactggagagaaacgaatagcgtagaactcaaatcagatattagaaagggttcacaatgcaatagtgttatgtgcatatgattggacagggaggggaagtggacggtacattgtttttttaaaaagaaaatctttgtaaacaatctaagtgcgaacctatgatttgttgttttctcattctaaggatctttaagacatgacatgtggtggcttaaagttttttttataaagagaaaagcaatctaatagttaaaaataatgggacatcaaattaagtgaaaaccgatggatagatatataatttattttctctttgaatttcaaatttttaaaatatcatacgtggtgacttgagagtgctatagagcacgtttaatcgatctttactatgtaaaacgattcaagaatatataatatatgttttcatgtttttcaatgtttcattgttatttggcaaggatactttgtttttattgaggtatatttaatgcgttcatcagtttgaaatatttatgtctttaaatctaattgttaaacttataactcgactgatttgaatgaaaattgatgaaattataagtctgccaatttaattaaaaattgatggttagatttgttttcttcataatatttttataattaaaattattatttataaaataggaagatgagagaaagaattattggagacggaaaaagtgtatgtatgtatacgtacgtgcatggggtggtgggaagggtgggccagtggggagaggagagttgtgctggtgggatagagccgagggatgtggatattggtttttttaagaaaaaaaaaagataaatctaatagttgaaaatatatggttcactgatttactataataccacgtggcagtttagtaatgtttatatgcgtagcatgtggtagtataggtgtgtttgtatgaagtttaatgaacatctaaatatatatatatttaaatggtaattaggatgacgtgccctagaaattatttttttccgtagaagtttaccacggttgaatcattaatttttttaaaggcaccatggatctaaatttagatgtgttcgcaaatttgctgattatttagggtgcttgttgtttagccagtaaaagataaaactagtagagcttaggaggatgaaaacacgtgcatgcacaccctcatttgtagacctaatgctcattgcattgataatcctagcaagaataggttagcctatttggataaccaaattaaagcaagcagcacgcacgttgaaaacctattcaatattttgatttctctgcatcgttgtggtttgttatataacttactaacaattatggtcacttaagtttttatatggggttgctagctataaaataggaaattcacgtacataccactgagggaggagtacatatatagagagaggagatttcttttattggaaacagataattaagatatatctaatggttagaaataataggttcaccggtttataagttataatggatggtcagatatttttttcttttttctcataatttttaagatttttctaatttattagagtgccacgcgatggttcaggagagtatatagggtgtcacatgatgacttaagtgtgttcgtaggaagtttaatgaacttgtgatagaatacaactcggaataacatatatttttacaactattggctgaaattattaatttggtttttatctcatgagagtgaaaaaaaaagaaaaaaaagaaaggaagggaaggggccacgtacgaagtatgcacgtacatgcacgtacacgtatgggatggatcgacgtagaacgtggtgctttctaaatataattctatttggtatttttttagttagatctaacggttaaaaaatataggttcaccagattaaatgaaaatggaatatttttattttttcttggacttttattagagcgccacttggcggcctagaaacatttatagaaatgccatgtggcggcttagtaacgtttgtaggaagtttaatggacttttagtatatataataatagatagattgatagatagatagatttatgcagctcaagtttacacatataaagtttagagacccaaagtttataagtcaacaagtttatatatccgattcaactttgaatttgaattcaaatattttttaatatagtatttctgtactaatgtttataaacctaaagtttatagacccaaagtttataagtcaaaagtttacatgcccgattcaaattttaatttgaattcaaatattaatttatagacccaatgtttataagttaaaagtttacatattcgttttaaatttgaatttgaattcaaatattttttacatatagtatttctatacataatttttttcaattttatttttattttttttaaaatttatggtgcagtaggaagagaagaagcggagaagaaaggggatgagcgtatagggggacaaggggtgatcgctccaagcgatccatctctccttagccacaccccaactttaacacgtctcagttgactataaaacagactccaatgtaatctccccattaccagacgaacagctagcgatctctctttctctgctgcaaactaattaacgggcatagaatggcatcggcgatgggcgccaccggcgacaagccgccgcacgccgtgtgcgtgccgtacccgtcgcagggtgacatcacgccgacgctgcacctcgccaagctgctccacgcccggggcttccacgtcaccttcgtcaacaccgagttcaaccaccgccgcctcctcgcctcccgtggcgccgccgcgctcgacggcgtgccgggcttcgtcttcgccgccatccccgacgggctaccggcgatgtctggcgaggacgaggacgccacgcaggacatccccgcgctgtgccagtccaccatgacgaactgcctcggccacctccttgcgctgctgtcgaggctcaatgagccggcgtcggggtcgccgccggtcacctgcctcgtcgccgacggcctcatgtcgttcgcgtacgacgccgccagggtgatcggcgtgccgtgcgccgcgctgtggacggccagcgcctgcggcttcgtggggtgtcgcctctaccgcgagctcatcgaccgtggcctggtgccgctccgggacgcggcgcagctcaccgacgggtacctcgacacggtggtcgacggcgccgccgcccgcggcatgtgcgacggcgtccagctgcgcgactaccccagcttcatccgcaccacggacctcggcgacgtgatgctcaacttcatcatgcgcgaggccgagcggctgtccctccccgacgccgtcatcctcaacaccttcgacgacctcgagcggccggcgctggacgccatgcgcgccgtcctcccgccgccggtctacgccgtcggcccgctccacctccacgtccgccgcgccgtccccaccggaagcccgctgcacggcgtgggttccaacctctggaaggagcaggacggcctcctcgagtggctcgacggccaccggcccagctccgtcgtgtacgtgagctacggcagcatcgcggtgatgacgacgcgagcagctgctggagttcgcgtgggggctcgccgacagcggctacgccttcgtgtgggtcgtccgcccagacctcgtcaaggggggagagggcgacgccgccgcgctgccgccggagttccacgccgccgtcgagggccgtggcgtcctcccggcgtggtgcccgcaggagaaggtcatcgagcacgacgccgtgggcgtgttcctgacgcactccgggtggaactcgacactggagagcctagccgccggcgtgccgatgctgagctggcccttcttcgcggagcagcagacgaactgccggtacaagaggacggagtggggcatcgggatggagatcggcggtaacgcgcggcgaggggaggtggcggcgatgatacgggaggccatggaggggaagaaggggcgtgagatacggcggcgtgcacaagagtggaaagagaaggctgtacgagtgacgctgccaggtgggcccggggacaccaaccttgaccgagtcatccacgacgtgttgctgtcgtgtaaggataaaattagcagggtgaatggtgagagtgtatgacttgttagatcgcagatcaatattataatattcaacctactaaccaagtagccatgtcatgtggtttatttagtcttaataagagcatctaattcgaatataaaattcttcttgcgttttgcattgagtacacatggatatattccgacgaaaaaaaatttagcttattattgaattttttttaaatgttgcacgatatttcactaggtatatcggaattgtttcactaagtagatcgaaaatgtttcactcgtttaaatcgggcgttgtttcaccttatataaaaacaatgtttcagcaaatagcaaaagaatgtttcagttcactgcaacatctgatttatacatagtgaaacattatgtgcacactaggtgaaacatttttcggtggaacaaaaaaataaaccaaattctcttaataggggattttcaaaatatgtgggtttttttgttgcaatagaatattttgttcactacaacattaaatttatacatagtgaaatattgtgaatacattatgtgaaacatttttgatggaacaaaaaataaaccaaatcctcttaatagagagtttccaaaatatgtgggttttttcttgcaaaagaatattttaattcactgcaacattagacctataaatagtgaaacattataagtatactaggtgaaacattttttatgggaaaataggaggggaagtgggcggaccaggtacgcacgtggggaggagtgcgcg

SEQ ID NO: 23820 - DNA, 15446 bp, Oryza sativa
tccccccgcgccggtcgaccggatacaagtattttcggactaactactctctcctattattttatcaacttcaccccatgtgagggttcatttgtcagcccacgtctcttcgtgtcctcacaagggaccacacgtcagtgcacattttctcactagagacacaacgcacctgtttcgattgttatgatgctaacaccagggccaatttgagtactagattggtctaggtatcaggtacccgatacctagtacaaggcctgatacatatggatatcagaccgatctagataccaagtacttgatacctaggtacccgataccagtactaagtctggtacctatgggtatcacaccgatctaggtacctggtacctacaggtatcagaccgatctagataccaagtacttgatacctaggtactcgataccagtactgtagacccccgattttggaaatcggaaatcttctgtgtttatccgtaccaatccctggatcagcagttggtacacacatacatagttggatcacaacatatcacgaatgaatttaggctaaaagagttaaatacttacattagggacaggtaggccaacaactatcagagaacaacagcggaagacaaaataatataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccacaacaacaatgcatatgatagagggtatttcaaagaatggcttcaggttcttttgcataaagctaattttacaattcttttcacaagcctaaaacctagcatagactgatcaaattttagtaccagtgttcactttaaacaacgacgattctgtccaccatccattgtgatcccaaggatagcttcccgccattgaatcgtcatggttttctgaggatgtccaccttccctcctctcgggaagtggctccatcagcataaaattcatcatgcaatatcccatcccccacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttttcatcctcatgcactctaggcgtacacggtttctagcagtgagaggagttctggcgcacccgggaagggaagactcacacatgcattaagttatagttatgttttagattctcacatggcagtcctaccaatgacgacaccactgtagacacccgcctcgcggttctaccaatggctgccccaccgtagagcccctgcctcacacatcaagaaaccactatgcatggatactgcctccgctcagctatctaatccgctaggtctatacccattcgagaagtacggttgtacgagggtcgtttcatgcttaacttcatggctcggtccttaattgaccagggacggcactagccttttccggacaccacccaagtcctccagccgccccagtcgaaaacagttgttttactttattttcctttcacaaatcatgtcatcaatatcatggcaatgtggcgctcatgtctccacatgccgcatctcaattaccttcccaaaggtaattgcccaagcatatagcatttgataaatatgagtatgcatgaatctaaaatagcatttctaagcaagtgtcatagttgactagggactcgtacgtatctatggttacaaagatttaaaggtgaacaataatcaaggcatggtataatcacaagtaggatgttcatcattgcatgcaattttattggtaaacaaaataatttcgcaattgggatcaacatgttcaaagaatagtgatgacttgccttgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaatcatgctaaggctaaagtttcttaatctttctattgtcatcgtggcctatttaggagttaacctacatagcatttatgggatacatatatatttggctaatcagtggtttagtctatcaagtggctatggaaggattatggctaagcatgcatctatctacataggacggttatttactagaggttctgttgttagatggatttaggatcaatcaaatagttatagtgaatcatttgtattattattttattgatggaagctttactttaattatgaacatattttacttgtcacaataaattataaaaggttaataattatccatgctttgtatgttagagttgttcaggttaatcatattatgggtacagattatcccatcacataattttacaatgaataatcctaatttacagttgaactataattataattatatgaggtcaagatttataactagtatttatctaatatacatgtttgtcatactctccctcttaatttaatttatgcaacacgcaaattaatactataccgtaccactataatgggatgtatagtatatgtgtaagcaacaatatcttattattggatcatatatttgagtagttgctttttactgtaagctatacaatacatgttaaagataattatgctactgtacaatatccatttttattcattggcacactatttaggttaactattatctaatcatttgatattaattaatttataattataaatatattttgttaaatagtgaattatatatcattggaaagcttatgaatttagatgaatttaggttcaagtttcacttaaatccgagtaaaagtcgaatgcgaaagtcgattactttttattaactttactatctgcgaactacggcaaacccaatttcgatttaaactattttgcgggtataaatattttgttgtcataagtttttaatttactcatcccgagcattatatccatataacaggttagaaatttctattacgagctaaatatcggacgaaatcttagaaatattatacaatttaatttagtctatgactaaacgattaaatataatacacggctaagattcctagtaattgaatccgaatttctaccatgaaccgatgacttatagagattaccaaaaataatctataataatctataagaattcatctaattgtttggttattaattatatctaaattactaccaattttaatctaatctgatcaagaaacatatatttataattaactcggaatttcgatcgaaataccattacgctcgaggaatttccaaaaataatctattattaaccccgaccatttttatttcctaaatcctcctaatttctcccccaatttcccttctattttctcctttccttctttttctctcttttctctccctctctttcttttcttttcttttctcttttcccttttcctttctttttctttctctccctttttcctttcttctctctttctctctctgtcggcctctcttttcctcttcctttctttctctctcttttcttttcttttctctcatcctactcccggctccttcctccctctctctctcggctcctttccacccgggcggcgacggcgacggaacgagggaagggacggcggcttaccggcgatggcgacggcggcacgacgtcggcgcacggcgcggcggcacgaaggcggcggtgcggcggcgcgagggcggcgcgacgacggcgcacggcgcggcggcacgaaggcggcggcgcggcgcggtggaggggacgaagaggggaaggaggagaggaagaggggaatgggtggggatggtgtggggtgaaagggggggtggccggggggttttatagggcgcgggggaggggtggccggccctaatggcgacgcgacggcgcggcgcgtggggctcgaggcggcgagcggcgtgacaggcggggcgacgcgacgcgcacggcggcacggggctcggcgcgatgggacgggcgcgcggcggctcggggcgcgaggccgacggcgacaggcgagcggcgtggcagcgacgggtcgcggggctcgagggtgcggcagcgcgacgacgatggcgcgcggcgcgcggtgacggcgatggcgacggctcgcggggcgcgcggggcgacaggcgacgcgacggcgacgcggcgcggtagcggcggcgcgcagctcgaagcggcgatgggacgcgacacggggctcggcgtggtgcgacgcgacggacgacggcgcagcagcgcacatggcttggcggcgcggggcgcgaggcgcgacgagacggcgcgcgacgcggcagtgaagccgacgcgacggcgatggcgacagcgcgcggcgaggcgatgatgtcgatgcgacggcgacacgacggcacgcgcggaggagtggggctcgagaggatgcgaccgacgacggcgtctgcgcgcggcgggatggagactgcgcggcaacggcgacatgacgcggcgacgcggcagggcgacggcggcgacaagacagcgcgcggcggcgcggggcgcaaggcagcggcgcatcatatgggaggcggagcggcgcgcggcgcgtggggcgcgaggcatcgtggcagatgaagggctagggctaggggaccacgtcgaacacctaggggctaatgaacagtgctagccggctatttaaccctatttaagcctatttcctatataaattttattctataaatcctaatttttacacaaatgaagtttactcaatatttgtgttattctaaccaatgtattcaccctagattaatattacccatatttatttatttatcgcacaaatgagtcctttttagattaatctagattattcgccctaaagtgaacttatatatttttgaagactttcgggtaatatcggaattaatataacgatgtgtccttattaattcaatggcatattggtcgagtttctttgtgtagcattatattttacacggatatttttaatctatttattctacaaatagcaaatttagactcggtacactattaatctaattgtttagttaaacaccaacgcattcttatttatgtataaagcttaatttgtttacatgaccattatttcatgtgaattggtttacctttatatagaccattagagtttagtaatatcccattaattactcctagtgaaactatgttatagatagagttccattataaatggtcatcatttcatgtgtatttagacgtcatagcacgcaacacatggttcacgtatttagtatttaatccctaatttaaattagtaattaaccttccgtttgtctggctttattttcttgtgcgtaattatttgtagggttaacaatattatattctcataaatcatatctattgcttaaatgtagttcttttctttaccttcttggtgatcatttacggtttggcaagcaataggaatcataacaaccagcatgatgcaaaagttttaaaaagtttgaaattttagtgatttttattgttggaaattttcaggatgttacaagtactaagtctggtacctatgggtatcagaccgatctaggtacctggtacctacaggtatcagaccgatctagataccaagtacttgatacctaggtacccgataccagtactaggtctggtacctatgggtgttagactgatctaggtacctggtacctgatacctgaggtatcaggcctgttacatatggtactaatccggataatctgggtaccagttacttgatacctaggtatcaagaacatgatacccagacattaaatactgtgagtaccatgtcttcacaccgatgagagccatgaggagaaaggaaataaggaaaaagcaagcgcgaaaatgagatggctacttccttagaggtggagggatgccattcattctcgttgccatccttgattcggagcgtcgctgccctgatcctcgacacccacacaagtgtgatggtcgcagacatcgtttgcgacacacctcaactcacctcccaccttgaactcgttgcatctcttcccggaccctagcatacgagagccccatggccaccaccggcgacgtgacattagcatagcgagcgctggacaattccaatcttgttaaagggcttgccatgggaatcatgtcccaaccccctgctaggaacgaaaagagaagttacagagggagggtggggcggtggatgacgatgaagcgaggatcggggagagagagagacacagaaagagaacggataagaatggaaggttatccacttatcccgtcttcacgggatgcctttttctgttttgcatttcctcagcggctacattatcggaagagaaatgcatggtgaatacgtttggttttgtttgccccatggagttgattggatagttttctaattgctgtcaacccctgattattaaaaacatatttgataattatatttattttttatctttataacgaggactaggtggtaaatcaattactcataatagagaagagatgtcagaaaaattatttatcttagtgatgttcaatttgaaccgatatattatttgtcgaagtggtttctttatttgcgtgaggatagacaaataaaataaaaactaaatggtcgtaatcccctggcacaatttatttggcttgtgtcttaagctgcgactataaaagatgcttatgctaatatgtaggtccacattccgtctttgcttttgttgaagaagagcgtatataaacagaagaaaacgtgtttgccaaatcttcgaatttcaccataccgaaggatgaaaaaacaatttctcccccatactatgtggtctggaaaaattatcttaggattcgaatcaaatggtccgaaacagacacaataatattccagatgcttctcacccctaagttcgactggtctgggttatgatcaaaatgatctaaggattcgaatcaaatggtccgaaacggacacaataatatttccaatgcttcccaaccctaagcgcgatgggtgaggtgacaatagtacagggcttctggccatgtctgtgaatgacatatacgatatgagagggtacagacgcacagcatatgaaagcacttgcaagagcatatgctacatgtgacaacgtgactattataaactagaaattgcagcctaatcagttaagctaccaccagcactactagaaaaatcgttcttcccaacgtggggatttttttcccaagcgggcattgccctcggagaaaaagggccgcctacgataatagcaaccaagatcatgctagccgtccacctaaaaaaaaacttattgcaggcagaccacataaggtgccacctacgaaaactatcttcgcaggcgaaccgtataatacgtctgcctgcgataattaggatctttgcaggtggacgtaatatatggtctgcctgcaaagattgtttcacgggcgaaaccttatatggtccgcctgcaaaaacattttcttatagtcttcttcctccctgagaactgttcatttcaaccgaagtttctctccgaaaacaacaaaatatagggggaaaggttttgaactcgaaatcttcgggagatttttctacattggttagatacatgcctttccactcttgctatgtatttttttatgattttaaacccctctttttgtggtggatctatgtatgcaaaatagtgaagaaaagcagcatgcaaaatatgcgtcgtgggcagtggcgtcctccgggcgtggtgcccgcaggataaggtcctcgagcacgacgctgtgggtgtgttcctgacgcactccgggtggaactcgacgctggagagccccgcctccggcgtgctgatgctgagctggctgttcttcgcggagcagcagacgaactgccggtacaagcagacagagtggggcgtcgcgatggagatcggcggcgaggcgtggcgaggagaggtggcggccatgacactggaggccatggaaggggagaaggggcgtgagatgcggcagcgtgcagaagagtggaagcagaaggctgtacaagtgacgctgctaggtgggccctgggacaccaaccttgaccgagtcatccacgaggtgctgctgtcatgtaaggataaaactctcagcgtgaatggtgagagtgcttaacattgtatgacttgttagatcgcagatcaatactcccttcatttcaaaatgtttaacggccttaactttttagcacgtatttaaccattcgtcttattaaaaaaattatgaaatatgtaaaactatatgtgtacatgaaaatatatttaataatgaatcaaatgatatgaaaagaataaataattacttaaatttttttgaataagacgaatggtcaaatacgtactaaaaaagtcaacggtgtcaaacattttgaaacggagggagtattataatattccaccaactaatcaagcagctatgttatgtgctttatgtagtcttgcgttttgcatctcctctgcagctacattatggaaagagatgcatggcgcaaacgattggttttatttgcgccacgtagttgattggatagttttccaatagctgtcaatccctaatctatttatattttatatattatatactaaatatctattatatttcctataaacgctcttaagctgccacgagaaatttatgtaaacgttcataagccatcacatggcactttaataaattagaaaaatcctaaatattctgaaaaaatctcaaccgttgatttctattaacatgtggacccactaattaatttgtttgatctattatgtttagaaataaaccagctaatccactcgctctcccttggagcctcaccagcagtcctcctataatctcccaaaaaaatatttttgggtttcctaaactgaaaataggaagtgaaaaaactcctccctccaacagataatcaagatttaatccccaaaactaaaagtgggctcttctcttaccaacagatatttccgttttttcacttccccaacgccgccggcagatccctccactgcgtgctccctgcccctacgccgctggccgatctctcggcgcgcgccctgctgctcgtcgccgatctcctataccatccctgccacacagcagcagcacacacagctgctaccacacagcacaatcaacacacatgtctgcattttcgtgatcaattttcagcagcagaagcacaatcagcactcacagcagcaagccagcaacaacaattttatcagcagcagtttatgcatcagtaggagcaacattccagcaagaatagcagcagcatttccagcaagaacagagcattttccagcagcagcagttacattccagcaacagcagcaaaattcctcctgcagcagctaattttcatatattccagaatcagcagctaattttcagctgaaactgcttatattttcagcagtccaagcagcagtttcagcagaaggagcagctagcacagcaacagaagctatctcagcagcattaattagcagcaatttcagtgcagtttagcagcagcagcactgcagtttcagcagcacaaaaaaaaaatagcagcaacagcagcatcattccatcgttccagcatcagcatcagcacaaattcttgcattatatgagcttcagaagcagcagcacaaattcctggagcagcaacataatttccagatgccacagaatttccagaagcaacagcaccaatcttcagcagtagcaatatcattccagcaacagcagcagcaacagattctagctaacagcaccattaaagcgggaaggtgatttcatcccttgaggggatatcccctcgtttcgtgcatgtcacctaaatattcatcaaaatattttaaaaaaaattagcaacatagattaatatgaaatatatcactccacaaacatgtaagtttaaattcaacttctacatgttgtaacaaaaataacaaatatagctgcgaatatacgataactattttcagtttaatttgctctttttgttgcaacttgtacaagtttaattttcccgttggcgacgcccggtgccgaggacgaggacgccacgcaggacatccccgcgctgtgccagtctaccatgacgaactgcctcggccacctcctcgcgctgctggcgaggctcaaagagtggaaggagaaggccgtacgagtaacgatgccaagtgggcccggggacaccaaccttgatcggatcatccacgaggtgttgctgtcatgcaagggtgaaaacgggtctggttcggttggttctcatccttcccattcctaacccatattttataatcgggatcggatcagacatgaatattatcgggtacaaatacagacccgaataatctcgggaataaatacggaacgaatacgcaccaatacggatacgaactctatcgattgcgaatatttattcggacatcaaatcaaagcaacgaccatatatatcatatagataatagccgttcaaccattccatatatgtataatatgaatatatttgagcacgtacaatagaagactattagccagctataaatatattttaatgagataaaatatgagagagaagagcaacggtcaagcacggactctaagacacaacgtgtgtatgatatgtgggagtatatattaatagtatagtaagcaactattatataaattagctattagatcggctatagatgaattggagctagtagtgggctcttagagactcaatgctgtagactgttgttcaccatagctgcatatcagtagtaaaactactactgtacatcaccataagtaacagtgctattacagcagtatcaaagtagtacgacggtggtcggcggcggtacgacggccgtcgcgcatccacgcggcgatgtgcgagacagtggccggcggacgcgggtgcgcggcagcgtagccactagcggctagcatatgtgcggcgccatcggcatcgtaccgtcacggccggtgctgggcggcgctcgtgagtggcgagtggttgtgcacgcgcgcggcgtgccggcgtgcggcaccctcgatgagacggtgactgcttgccccctccctggctgcctttggttgttgacatgatggagtggtggtggcagcaatctgggtaatgtacgggtagtttaccgggtaatacccgtataatttaccggacactctatatccgtcggataccatccttccaaacccgatctcatatctgccagaaaatatccgtatttgtatccaatatccgtgtaaggactcgggtatccgaatttatcccagattaatacggtcgggcaggcgggcgagaaatatccgtcatgtttttacaccttctgtcatgtaaggataatactctcagggtcgtaaatgatagtaacggttaacattctatgactcattggatggcagaacaatattagaatattaaaacaacttaccaagtagccatcttacgtgctttatttagtctttataatagcatctagttaatatataaaattcttcatgttggcgtgttttgcatctcctctgcagctacattatgagaagagaaacgcgtggcgaaaacgattggctttgtttgcgccgtggagttgattcgatagtaagttatatttattttctatcttcaccgtgtactaggtggtaagttaattaattataagagagaagagatgtcagaaaaaaatatgtgtgttaattatatttattattttctttctttaccgtgttctaagtggttagttaattaattataagagagaagagatgtcagaaaaaatatttatataagtgatgttcaatttgaaccgatatattatttgtcgatgtgatttctgtattagcatgaggatagacaaataaaataaaataaaaatggccgtaagcccctgacacaaattttttttttggcttgtcttaagattccaagtattacaatatggattatagaagatgcttctgctaatatgtaggtcaacattctgtctttggttctttggaagaagagcgtacgttgaagctacttcaggagcagaaaactttttgcatttatctcttgttttccaaattagctccgaagttcaccgcaccgaaggtagaaaaaataatttctcccccatactatgtggttcgggttgtgatcaaaattagcttagaattcgagtccaatcttcagaaatggacaaaataaaattcccaatgctttccaaccctaaacgcgacggctgtggtgagaatagtgccgagcttctggccattgctctgtgaatgatatggtatgagtgggtttagacacatagcgtgcataagaaagcaaatgcaagagcatatactgcatgtgacaacgtgactattgtcagaaacttgaaatagtatcctaattaattaattaaggctgcgttcgttgtgatgagttctgggaggttgggtgagaaaaggacatcgtattccacgtgcacgcttcccaaactactaaacggtgtattttttacaaaaattttctataaaaaaattgctttaaaaaatcatattaatctatttttaaaatttaaaatagttaatactcaattaatcatgcgctaatggttcacctcgttttgcgtatcttctcaatccccctcttctcaaactaaccctaagctaccaccaggacaagctgaaatagctactgtatatgatttggggctggtgcatgcccacggtcgagtaacaaattaaggtacattcatcttatctaggttttttactttcataattaaattattctggagatgtccatcatttgaacctctctaaacttttctaccttcagctaaaatagcatacatcatttcaccacttacagataacctagactcgacaacggagtggatttgctgatatgtcttctattcattgataaaagtgtcttagccttataatatgaaacgaatgaaacgaaaagagtaacatttttacgaagctaacaaaattgcgtgtatgaccaggttaagcactatccaacaatgatgcatttcctgttaggacctccaattaattatttaattatatggttaagcacattagtgtaggcatttaagcttccaaacactagctttgcaggaccaggtacatgcctttattcatgggtagatggtttttacatgctagcaccttagagtcacatactacataaagagaaatgcaacggacgtttggatggcttgactgttccaatataagagagataatttgcaccatacattaatcatctaagaactaaaaacaattgatgtgatataacttaatgagaaaaaagaaaaaaattgaactaaatgaagatgaactataaacgtatatatgatattataaaaattgatagagagatacattgaaatattatgtgaatggtgggatgatttaacatgcttacattttaaatctctaaaatttaataaattattaaattatatataatatagcatgcttgcatgatgcttaaatgtaataattgttagatgataatgatggaacaccattgctgttaagctttaggaattagtgggctataactttatagcaagagagaattaattatgataaacaaatttctttagcaatccgcagttgtctgtgtcaaatcctatgttactaaggcttaacatgcaaacatgccaaatcatcatgtactaacaagatgtcccatcatcatgtattaacaagatgcaccatcatcatccactaacaaccattaaatttaaacatcatgtaaacatgctatattatctataattttataatttattaaattttagagcttttaaaatgcaagcatgttaaatcatcatcccacataattcacaaaatatttcaatatatatcttcattatttttataatatgctatgtacctagttcatcctcacttagtagtcttagctagttaatgctatttctcacttctctcgttaagacatatcacatcaatattttagtgcttaaatgattaatctatggtccaaattatctctctccttttcttctctaattaatccatatcacctcaattatttttaacctttagatgattaatctacggtccaaactatctcgatacttttcttctttcataaagtcatatcaccttacttttacatttgaatcatcattctatatactatttaaatttaaattatcataaaccacgttaactttacataatcttatgttgtctagctgtattacatattatttttacttattgttatcatgctaaactcccgcagcaatgtgcggggtttcacctagtgctaaatgataaatgtaaccttttattgtctttgactctagatagatcgtacgcccttttgagtagtataccgtgaatatataactttagttttcatcaaatcatatatatctccctatcctcaattatatatcattcatcagggacatcatgttttttctagccttaagctcttaaaagaaatgaaaatccgttatatttgtggaaagagggagtatacaacactaaatagcatgacaatgaatatgtgtgagtgtgactacattggtgcatataccgatagttgtagtcggttgcagtacccaataccaacatctgacacatgtctagcatatcaaagccttataccagtatatataccaccagtccaacacatcgatctgcaggggtgagttccagcgttctgtctagctaggttgaacaaattaaaatattcagactatacttcaacagttacagtaccaatattttttcttccaattcaatagaaaacggtagctctgctgtcccagaaaacttgaatatgccacccttgccaccatttggtcagacttgtctgagttattgaatagaaaatggtagctctgctgtacataatatgtgtgtgtctgtgtgtgtatatatatatatatatatatataaggttttattatttatcataggtttgataggcatcaggaacatctgctcgctacgcaggaagcagaaatgtaagatagcagaggattattgcgagctctagagatgcatagtacagatttggggtgaacttagtagcactcttcaaaatctgccacctagaatgagatagggcatatcgacggccccatctagatcagtatcatctctataggcaggagtggg

SEQ ID NO: 23821 - DNA, 13368 bp, Oryza sativa
ctgccacctagaatgagatagggcatatcgacggccccatctagatcagtatcatctctatgaggcaggagtgggagcccgagatccctatgtaagaatatgaagaaaggtgatgatctgctaaaagagacatgagcatgatgaaactagttattctagccagctgaggctatcagcttctaatcatgaccataaactaacatcaaggcatgtattaaacttgattggaatcgtaattcttacttttgccttatttttatttccatttttttattttgtaggtatgtgttaaaattttaaagctttttttatattcacttgagtattaatttgccaccttcaactatatattctcatttttttttctgaaatttgtgacgcaaaggacctgtaattaacggttatatatgaatactcttccttatatattttcatttgacatgcaaaaattcccatttcaaataccacaatgttatatatgtgggagaacccccaaccatctctggctttgaattatcccaacgcgtactgaggcatctatatactaatgttactggactcggtctgaaaagtgtatttacttcattttgttgatcatatatacaacagcctgtgtaaaatagttgagggcgatacactcaaacaacagaggcaaccttgtcatgcacagaacatatgacaaattactatgatagcagcaatggttttttaatacattactataattttgtagactgatgattaccaatttatagacgtctttagtgaaccacctgtgacctaggcctgtaaaaattaatcaacaattttcttatgcgtttagaaggaaccgcatgtgacaatcacattttcacagacatctctcttaaggaaatacttgtcaaaatgaattccagtgttaatttgtttctgataatcacaagtcatgcgaaatatgtatgcaagcggtatataggattgggaccctaatattgttactccatgcgtggtcttcttggcatcttatctatgaaatacttcattactttggcacgcatgctattcttttgacttcatctctacatacatatttggtgctctaaatgacatcaaataaaaacgtcattaactacaaatttcatatttagcgctctaaatcagtgcctcctctcttgctttttgtactttgcattgatgctgtcatattgagtaacttggtgatctatttgtacatgcttatatcttgttgatcaccttctagctctagtatataagtagtgtgcaaagtactctatctataggttttattttttctatgcagggtcggattgtcctatcattgttagagtgtcaaacacttagtgttgtcggactgtccagcaccgaggtggacagtacgagcctatatttccactaggcgagttcatgtttttctctgtgttgatcggattgtccagtagctgccgggttgtccgcttctgtgtgttgttggactgtctgcagtggtaccggattgtccggttgttctaatttccattgcatgtttatgtaattgcaggaaacgcctgttcatcatcctatgggccatatccatggtcctcagtgcactttcatttcatttaagagcttttcaagaactccaatagatctttcacgacctgcgaaatcgtttttatagaagtgttgcgtgggagatttggctccccaaatggattccgaggtgttgcttcccagtgtaaagtaatgtggtacaagggtttgattttgttaccttaccgtttaatcccaattagcactaaataacttatatttttatttttaaatagttattgacccgtgtattgcaacagtatttttatagacgggaaggatttatttttttctttttttttaattctgtagtttcgtggatgcgaaagatttgggcgaagtaggttatttggtttactctatacagtcgtagattttttttttgggaaattgtttttttagttggacggtttttataagttgggagaggttttcacgtatggaaaatgagagggggagtggccagacaaaagaccccatttatgtagtagagagctataactgaacttgagatatgtcgaaactactcccgagtatagcaaactgctataaatacaaatctttgtagtagaattacccctacattttggtttctctgagtcgatcagcatatggagataaaatatgacctcaactatcgttgattacgctatatgtaatttcaagaatttcgggaatttgaggcactaggaactgcaatgagtttagtttcaaaatgttgttataggtttagccaaaccgcaacacctcggggctgaaattaagacaggaggatagccatgccatttcgggtctttgggatgagagagtggtgaattttggttgtacgatgcgcttagctgacataagttttatgtcgaaattcactttcatcaaaggttttaagtgtcatgcttgtgttcaaacgaaacaatgtcgcaaggctcacaacacatttgaggcaagaaatttggcaacgctagaacttattcatttcgatatgtgcaaaatgaatggggaaagaaatacttcgtgatacttatagataattgcactagattctgttcaggattgggagacattgggaatcttagagataccgaatagtttattccgctatgggacacaagcgattttgctggtttagctggtggagactataacatgggcgattagggtagcgttagttgttacgattgtttacaatgtagtctgaggccctgtttagatcctccaaaatggcaaaagttttgtcattctgaagcactttttgccattttggatctaaacactagtagcaaaatttggcaatttggcatttgacatttgctagtccatagtagcaaattgtgccaaaaagtgctttgggaccactccctctctctttctctctctcactttagtgctagaatggcaaaagtttaggatgcatctaaacaccaactagtactttttcaataccaaaacttttgccaccaaaacttttgccatttgccatttgccatttcaaatggatctaaacaggccctgagttagcaagctaactcttaccctgaaaaaaaaaagcaagccaactcttagctaatctgttcgtctgtgcatgctgtgactgtgaatcacaacttatgatgtttgcttctttacgattcttgtatgtaggatagttttctgtagaacgagctgtgttctactctccaagggcctgtgagttagtccgttcattatgattcattataacaatgtatcaactgttgcatcctggatagtttggttttttgataactgaaagacttgcatcacccgtttttcttgtacgcatggcatgtgtggagcattgaaggtttgtttacaagtccaaatttattgcacagaattctattcgtagacattttggtgtataaaagtttctagacttctagtgaaaagcgagaaaacaagttttggaaaggctaatgattatgcctggtctgtattttggaggaatatatgctaaatattagttatggaaatgatttattttataggattgctcgtatgatgaatgtgacacatctccttataacaatgaacaaatttgtatttcaactaacaaacattccggcatacggagcatatgattgtgaacattgtgggcatcagttttcgttgccattcataccaaagatcatcagctcccacataagggttttcccttcaagactttactaacggcaagtccttgcatatgtgtagccacaatggttttattttatcttgtgtcgtagcttaaagttgcaacagtgaaatctgtacagtgtagttttcatatgcggctcgcaacgtgtaaccttcagcttataaggataactgaaaattcgagttttaaaacataatttttagagttgatttcaggttttcttcacttagccttcagcttataaggataagtgataattcgagttttgaaacataattttggagttgatttcaggttttcatcgttgtagtttgttttcccatatttttttaaaaaaattactaaaggacacacatataaaagttttacatgcaaattattttctattaaattattttttgtcattaataagatgttttacttataataattagttataaataaaaagatgagatatacataactataaaaaaaaggcagccctgctttacttacagtataattatatacctcatgcatacatgatcactataaaaaggcagtcctgtttcagtttttgctgcagcacgcaaaaagaaaatgtgaagctcccaagacaagaggccatatcatgcactgtagtcaccttagatttctcaccgccattcaggagtgggaagctttaggaatactagtacgcttgttgtgcagtatttgtcctagctccacatacaccaagaaaaaaacaatgtttgtaaaatctagggtttgcaagggtgcagtgcggacaggaacgaaactgctcactcctgctatcttgcgtgttaacccggtccaggcccctgtgtgaagaacggggctgaaccagtctccagctcttgcgcttcttggactccgtcacccgagcaagttctccgaggccaactatggtaagggattccagcttcatcggcatagctagtggggcaatgcaacatgcagcgtcgtggctattggggctgacaaggatacgccgacaaggaggagcagtacatgcagcatcgatgagcaccggctgtcatatcgtgtgtgcgtcgacatattgctgtggggctgcggactaggattagtttatatattgatgtgtaattgcctccaccgagtgatacttgtaattggagtatattttaagtggttaccatatctcctaaccacgtgggtctataaccatgtccccacctccgacaccctatggggtgaactccccgacacttgatcggggaaattgcaaatccttgtaaaacccttcacataatcttggatataattgatgaatttcctgcttttttccctgaccgaaagccagccaagctcattgagaaattctacgccatctcatgtcaccttaaggtcgacacgcgcaacaaattctctaccatctcgttgacaaataatcaacctgtgtgaggtgccttcacacagtttcgttgccttcgtaaaaatctcaatcttactttcatgatgtcttgacattcatttttacacgtgatgaactcgaacatacactctgaaatcatgtacagtcgtttattttggcttgtgctgcaggtgatagcatagttaattaggttgcaatttgatgtttcttacagtagttttcacctgcagtacatgctcttgcatgtgcttctataccagctcagaccatataattaacttagggagcaatggatggccggatcacgctcatagtctatatgtccagaagcccttcattatatattctcacctcagcaagtcatgttttgggtgggaagcatcggaaattgtattgtgtctatttgacactatcgaacaccagaataatgtaccacttaattttactttgtgcctgaacatataccacttaatttactccgtgcctgtcatacactaagtccaataagcaatgcacaacatctatttacctttgcatataaactaatgtacttatgttgttgtactgtgccgtaccagctatcttgttgcagaaaagatcaacttgtgcagacacgtgacgtgctatatacagcataagtgtagaatagtgaacttgttttgacatggacagtagaaagcaaagctctgtataaatactagcacaaaaacctctgtttgttcgaagtctaggccatatatgtggagagaaacagtggaagactccaactacgtactattgggtcagctctcaaatttaattcatctccaatacaagccttcacttgatgacgagttctaggaatgggaggcaccaggaacagctgcgagtttagtttcgcaaactctatctaggtggagcgcgatcgcggtagatcataagagcaacagtgtccacatgattgccagttaagccgctttggcctcttggaaaggatggagttccattcatggtttacatacttgcctagagcaaatgctgctccaggctttactactaattaagctgtttatggtgctgggaatcctaccatgtggcagcacatagtaaaacattgtgtatcgtccaaaccggatgttttttccatttcaaaggcaatcaatccttcgcgagtaaaaatctcgatcttctcgatagggattatacaaaattaatctacgtacaagcagtttttcatgtaatttacatattaaacttgttctaatctaggaattagtgaagcggttctctaaaaaaatatattatatattaaaagtccattaatcatcctacaaaagctctcaagcagccacttagcttcctaaaaacgctctcaagccgctacgtggcactctaataaattagagaaaatcctacaaattctgagaaaaagcaaaacatctagctcttgatttttacttaaattagtgatcctgatatttcaggctattagattaaatctattaaaatcattccttctaatatggatggagaggaaggtacaatgactattcgtaaacagaaaaaaaaaccaaaaagatccttcctatgctatgcatatggatggagagcaatgttcgtatgtactacctaaaaaacaaaaaaaaattacatgttacctttgtacgaacgtaacgtacgtaactcctaaaggataaagccaaaaaaaccatattatatataaaattactctaaactttctagaaacgctattaaaccgccacgtaactcctacaaacactactaagccgtcacgtggccctctaataaattagagaaatctaaaaaattctgagaaaaaaaaggaaaacatcatatcattgattttcacttaatatggtggacccatcattttatctcctattatctcaccggctcacttttatatccaaattttctagctagcaactcagtacataaacaataagcaatgctatattaactatctattatatagtaaaaatcaaataactccctacaaacactctcaacctgtcgtatgcgtggtgtgctacaaacactcctagatgctatatagcgctcaaataaattaaaaatcctaaaaattatgataaaaaaacaaaccattcgttttccttcaaataggtgaacccaataattataagtactacaataaatattttttaaaatattgtttctatctatattgattcacatgcataactaattgcacatatatgagaagtaattaaagagagggcttgcaggatggtaaaaaaaccaatgaaagtttgttgagatttcttcacgaaagagagatataaagaacactcaattcaaaattgaaaataagttactttaattttaatttgttttgttagaactatttttgaaacatactaatgcgcatgcccccgcaaatgtgcgggctatcttcctagttcattgtaaaagtgtatgcggttttttagaagtctgtatgtggaaaagtttctttgccttccttcttttagaatggcgaaaattttaaaattcgtagaaaactttctttaatattttgagcataattatgaagatatttttttatatggtccgactatataaaataaatatcataacggaaatcaacttgaacaatgctgtaccaaaactacagtggttacttccaaagtactactccctccatttttaaccaacgtcgtatacttaaataaaagagagtatagatctcccagcaaccatctgtaatttagttttacgtaatcttaatttcaacgaccacgcttgcactccctaaccactcctcgtttaatatttaaaattacggtcatatatcctcactatatatctcaataaaagacaaacaatattatttggtatttgtggacaggaggaggaaattacaagctggcatgactactacacactattgtttacatataccatcccatggaggatcataacaaatgtcgttgctatagcataaaatagcaatcagagctgctgttttgtccattcatgctaggagacacaactgatagatgaacttctatatatagttttttaggccggtgtgtcctgcactgcatatatccatagccttacggttttggcttgggaggactcaggagttgtagtgatacgatttcttgctctcctgtagcactcgttagttcgagatgggcatgtttacaggttaacagcaagcactgatcaaagagtagtaataccttattagggtgatcatctagagatgatcccgtagggtagattcaaataaccatgtccctgtatcgaagtggacacagctcgaaatgggcgaagctagctgtggtgagctgatatgtgctagtatcaagatgatttcttagcgctacgagcttcacaatggtcaccgtgtcctgaaaagaagggatctggagttttgacgaattaaaggctataaacacatcaagaaagaaatattaatgcattatcaatagcagaaactgcgaatagtttttcaatctctagggagcccaatcttttttggggttattctccaaaattgctagttaaatcaatttcatgaaaattaaggccattggcccacaagttctcctcttgaattgggcctcataaataggctctaagcctcaaacaaggtagctgtatcccggtctgcagcaaaccaaatttggtctgttggtgtatattctaacaccctgaataaagtgccacttaatttacttcgtacctcaccatatatcacttaattcacttcatgccagacctacactatgcccaataagcagtaatacgcaacttatatctatgtttgcatataaattgatgtacgcaactcttatttatgtttgcatataaattaatatatactgatgttgctgtaccgtaccgtactatatgtatcccaaattgttgcagaagatatcaacttatacagacatgtcaaagctatatacgtacatggatgcctatataaatacttgctcaacctctgtttgttccaactctgagtcggttatcttggatagaaacagtggaaggctccaacttctattggttcagctctcaactttcatctcctaccagccatcagttgatgatgagttttgggaatcggaggtgccaggaactggttcaagtttagttttgcaaattctatcgacgttatggccgatcacggtagaccataactgcaacactgtccacatgattgccgagccggcttggcctctttgatttttttgaaagggctgcctgcgcctcctggggtacccaagcagggaaagaaattcagatggaggatccttgggaaaagttatagagttctattccttgtactttctttgcctaaaccaaatgatgctacagcctacatttctgcaaaaggctacaacggatttttgcaagcgggcaatgcaagcgcttgccccccgagtttatctataaaaatgtaaaaatcaacattttcccatacgagtagcaaaaccccatgcagatggtaattttcacataaggtcagttatgccatccgtttgcaagaacgaaaatcacaacaaaaataaaaattcaaataggcaaaaccctagctcaaatccgcccttgccgccaccatcgtctatgcagtccgctaccactatcatctttgttgagaccccgccactcccacgggcagagctaacatcaaagtaagggtggtgcactaaccattgaaaatctataaaaatttcgatgcaaagctgcatattctagtgtttttaagtgagacattgtaagtttagggggttcctgtgcaccacccaaactcaacgtggctccgccactggccgcacccaaggccaacaacggcgaatccgcctttcccggggctgtggccactagatccaccactgctaagcttgccgccatcgtcgtcaacgccactgccacacttgacgctaacgcatgtgaatccgcccctcctagggccagggccacccatcattgtcatagccagatctacaagagaggccagtggcggtggatccaccgctcctgaggccgccgccaccagatctgcgagggagaaggctggctgtgctggtttgcatggaagaaggccgttgccatcgggtctgcgagggagaaggccagcatcgccggatctgcgaggtggctggcagctcctgaggaggtgatgctgttaccagcgtcaacgcgagcctcctctgctagcctcctcgagcgccgctagactaaccgtcgccgcagtgcaccaacctcctcatgcacctctaccggcctacaagtgagagagaagtaaaggggatgaggagcgcatgagagagtaagagagaggaaagtgaataaatgagactggaagagagagggagagggagtaaatgggaaagaggatgaggatgtgaagcggaggagttgaggggataaggagaggagggtaagcttattaagagatccgcgtgcgaaaattgatttgcgttagtggatctgtactaaacaccatccaaatatattttttacaaatggatgttctttacgctcatccgtgatcgaattgggggtgtctgtaaaatttgttttattatagtggtttatggtgcagagaatactattattaacattgtatatagtgttttttatagcttgtacagcgtagtacattgtgtttttctgacatctaaaccaattttccatttcaaaatcagtcaaccattggtgatgagcaaaaaaggagacggtcgtctagactcatgtgcgtattctgtttaccaaaagttcagtgttttacaaccttaagtctacaaacagacatgcaatctgcagctgaaatttttacattttagttagttttaaacatttatttacaaatatattataagaatgaacctttttttttctcagagccaagttattggcacaaaggttcaatgtctcagagccaacgatactaacgttgacagcccttgcccatgtttatagcttaggcactggtgtaacggggtcattattaaagagactggcgtagataacataattgtaaattaatttcttaaaaaggtcaaacgtaaatgctttctatcaaataggcccttgacaccagcatgtgttgaggacctatttgtatgaaaagatatttacatttcaaccctttttagaattacttttacaaattggtccttggttgtcgactcctccacatattggctgctacagtgtcgagggtattggcaccgagacattggacgtaggcgccatgaaccttagcatccagaaaagggtatattccagtaataagcttttatatgggtctatctaccgaataagtttttgaaaagggctaaaatataaaaaaccagcaatctgcaggcatgtgcaaatttgtataatagtagcatacagagcatcatgcatatatatactagttcttaaacactagcatgtgccttcatctacatgttatatatatacatggcacagcagttggaagaacttcatctacatgttgttgaggcatactgaattattagtgaattatatacaccgtttatctatgcaacactataaaactaatcgctttggattgggaggtgtcaggatttctggtgctacatctgttagcactaatcttgttgtctttattttggaatacctagtaaacaatcttcacaggagcgttggctcgtcgtccgcggtagcgagcagcgcttcttctttcttcggtttgcgacattcgttagcataatgaccatgtatgccatagttgtagcactttaccttcttcctatcaaccttgcgctcgctactgttggagtcgctgccgtcttctcctttcttctccttgatatagagattctcccattgtgcacgtgtgagcaacaaatactcaacctccggttcgcggcgccgacccttcaaggattcctcgaacgccctcaagcgcccgattgcctccgccacggacatcttcgacacatcaccccattgctcgatggtgccaacaatgtgaagaaacttgtcgggaactgcactaaacaatttctccacaacaacactatcttttgttggcccaaaaccaactggtagaaagcctcgctacaccccaaaagctagctcaagaggtgaagggcttcccccacttttacttttaagttggttcaactccccctagattagcaatgttggactattcccaacaacatcgcgggttgttgctggaagaaaactagtttgagatgcgcacgtctacaggccaaccactgcactgctaggagtgatcctgtgtacaagtgatcctgctagaagagaattaaagcaaatcccttggtaaactactgtacgtacttcgtatcgttcgtagtaaacctttggtagatgcttcaaaagggtcagagagaagttcatgaaccgtgaatgaagggaatcccgtttgtgagcatttatatatatacatggcctcgatttcttttagtatgtatttcaatgaaattaagaatcgtttgttattataacagtgcaaaagtttggccttcagaaaatgccacttgttaatatctcaacttggttatatattatacagttctttaattagtaaggcatcggaggctttggaatgtactttttatttctattctcaacaacatgtatgatttgatgtctgttcagtactcttttggctatattatattgataatataataacttgtttataacgtttgctaccaatgcggccaacacttagaaaccaccatattaacttttagaggaacattagcttatcatgaaaacaagtattgtttattgttttcttgatatgagatgtgtctatctctgatgggctaaatatctcataagtttttaagaatcaatttctacttgcattgttaatattagaaacttagcctctttcagattgtacatgctctctaagctagcaaagccaatacgactatatctttgagttttctatactaattatcatgatcgattgtctagaggtggctaatatgatgagggatcacaattataacaagtcggtgtatgggtcaattatccaggtgatcataaacaagtgcagtgctttccaggaagttaaagttgttcgggtctatcggtctacgaacaaggtggcacatagcttaggtaaagactacctcacaagcaaagagtgctcaaccaggctttcagttacaccttactccctccgttttttaatagatgacgccgttgactttttcccatatatttgaccattcgtcttattccaaaa

SEQ ID NO: 23822 - DNA, 41400 bp, Oryza sativa
  unsure (1)..(41400): unsure at all n locations
agtcaacggcgtcatctattaaaaaacggaggtagtatttgttagtcaagaattgtaacccattaagtgctgattagttcattagacattaagcctgttctaaaaaaatgcttggttaaaatacagttctttaatcagtaaggatttggaggcttttttgtttctattcttgacagcatctatatttcgatctctgttgaatactattttgtgtagattatattgatcatataataacttgtttacattgtatactgccaatgcgtatgcggccaacgctactagagaaaccaccatcactaacgggtgaaaacaactattattatattgttcacaacgaagaacactacgaaatggaggggggagaccaagaagaggaacattagcttatcgtaagaacaagtagtgttcattgttttttctttaatatgagatgtgtctgatttctaaagggctaaatatgtcataaacgtttaggaataaatttcttctttcgttgttaataatggaaacttagcctctttcataccatacatactgtctaagcaaagccccaataccactctatcttaatttgaagaactatattatattatacaagtttaattctttctatgaattggcaaatgccaagtaaaggttgagcataaatactactacctttgtcccaatatataacaacttttgactataaatttggacacacagttatctagatttatagctaaaaatacttatattttaggatggagggagtagctagcccctatgctgcaaggcactagatataaaaggttcccactgtttactacatcgatcctatctacacatgtaccagaaaagtaataactttatggttttgggaggagaggtcttgatcaagagctctaaccctagctgcgtattagctgctttgtaccagtctcatatttatattccgttctagatgtttgtaccagttatctccggttaggtggtcgatacatacggaagattgcctatgcatccgcttgagttttcgttccgtacgcaacttctatgaacttgacacttgcaccattgttgatacgcccctcttaagttctcatcatttctttctcttgcacccagaaaaggttaattacctgtttaattattaataattcaaaattggacaatatgataatgatagaaatggttgttctagaatgtacatgtttcagactatatacagatactccctatgtagaagtcgttttggacagcgacacggtctccaaaacataattttaacttcttgttactataaaaatatttattgaaaagtgatatatgtataattttataaaagtatttttcaagacatctattcctataatctttacattttcaaactcaacaacttgggagttattcatgatttatattttcaatgtttgacttaaatattattataaacgacatggaggtagtacatgtgttgtgtctgttccgtgcaagcacagactcgcaagcattgtttgtgtagaaagcaagcaataaatccaattaattgtaacaagaaatgttctggtcaacaattaataccagccatgttcatgttatttgttttcttacttctgttttcgtcaaaggtgttttgctgtttgctttgcccttcattgttttttttttttggaaatgtatcgtttcaaaagaatatctgaattttgtgaattataatacgtatttttgaaaatctttgttgttgttctggtattttcgaaaattgaaaaaaatgtaacattgatttttttttaggattcttatgaacttcaatgaattcattgagtctggcacttaattacaaattagttgagaattttgcaatatgtcttctgctgacggatgcagccaagcagtggcagcaacgtggatcgacgtcttatatatccacgaaagggcaaagagtaatgtaagtcaagtactactagagttctttctcctctctggtaaagccttgagacagaacccatgcatttggcagcattcctggccaaattatatcctccttgacattcaggccattattttataaggccaaaccccactataaatactagctagtatacctcttcatttctggtcgtctcaagcagtgtttggagagacagggaaagagttgaacttgcaatggttcacatttcaaatttaatctcctgaaagcctttagtttgggttttggaggcaccaggaactgcgttggcttcaactctccgaattccttctaagttttttgcaatcagcacagtgcagacttgtcattcagtacgagaataattgacgaggtgatttggctgcgcttggaactgaggagagtttagctctttgtttcctactcgcctagtttaaactatgctagactcaatatttgtactcggcagctgccactttcgtggggttatccaatagggccataacataacaaatttaataatatcaccagctgatatctgtaaaaaaggtagtcccacatgtcagcaagagatagctctaaatctctaatagctgatgcgtatgatagctagctgtccaactatgtgtacatccaaaaaaaagagtaaatctttaatctggtaagtttgcttctgtcccacctagtcaggctatatccgtgggggcgttacaaccatgtggggacagcagcagcagctaaacttcatttcagcagattagcagctaaacttcaacttactcgctttccattaacacatatttcaaattgttaaatggtgtttttttcgaaatcattttatatagaagatgtttaaaaaaatatataaaccaatttatcgagtttataatgattaattcttaatcaatcatatgctaattagttttctagtttacatgcgtggagaatgtctctttgaagtctgcggctaagactctctttcctctccagccatccttagaccctatttagatgtgactaaaactttttagtccctatcacatcggatgtttggacactaattataaatattaaacgtagactattaataaaacccattctataactctggactaattcgcgagacgaatctattgagcctaattaatccatgattagcctatgtgatgctacaggaaactacactaattaaggattaattaggcttaaaaaatttgtcacgcgaattacatcgtatttatgtaattagttttacaagtaggttatgtttaatactccaaattcatccgatatgacacggactaaagtttagtctctggatccaaacaccaccttagaactgatgtggcaatatcatcagcggctagcctatcctgctttacctgctcttaggatgactcgacctctatctgatgtgcaagcattgtaacttttatatggctgcttggaagttatttaaagaatacaactactcatgcaaataaacaacttttcattggaaagtagtgtttcaattctgtacaaaatgaaaaagcccacaagtaagccagagaactgcctagctatcagattttatttatcttttttgtctttcaccatggattgctcttctatcagacaagtgtgtcatttttatcgaataacccattcgctcatattaaattatcgacgtatacattgctattgttttttttctaaaaaaatgaattatttggtattattagaagaaactagaaaggtaacccgtgcacatgaacgtgcacctaatttaatatgtgtgaaattttattatgaatgtccatgtatgggtgacctagtattaaaatattatatctaaattataattgaacttatttaatgtgcttttaaaattagttatgattttgttctaaactaaaattactcgaaaccgtataattttcaatttatgagaaaatattatgtcgaaataatatatgcagttcctatgagaaaatttagggtatttcaaatccccacggggatatcttagcccgaacattttcccaaaaagtcaaaaaattgttacactctattttgaaatttagaatgagatttctcattctattagtcctgcanaaatatttgaatatttctatttagaatgggttttgaacccaacaattatttaaaaattttacataaattttttaatccttttcatgtccatttttttaaaaaattggaaaactccactctatcaagcatatttgaaatgatttgatctaaatatcttcaattgagtaagaatattaaaatagaggtcatataataactacacatttctagattattctacgctaaatcttaggaatttaccatgtagcatagcaagttttaccaaaaagaataagtgaacatggtccttaattcttatatgaaattgacttaatatattggtaatgaaacctcatggttgtttcactgctaagatttctttctgcagcccacatgtttggtacaatcagtatgatcttcaaccgagcacgtttatagtttaaaaatgttgtctatgaaaaattaacactagaggggtacacattatgacataaaaatagatatcatttaaagatttttctcgaatttcttagtgaattcatagatcatatatataattttatctcctaaaagatcatttattgataaaagtaccgaaatcaaattgcataggtaaatagcccccatatacatgttgagataaattaattaagttcatagaaagttgttaggtgtctaatgggatataagtaatgggtctaccggtattattaaaaattaagatacgatattttgatttataatgacgaattttattttttatatttaatggaggcctcaagatggatgtggatccagaatgtaatttttatgatagcatttatatatagtcaatatggatattaaagtattgatttcatttaaaaaatataatagttcaaacagaacataagttgaatatagattttaagaagtgctagtaagagaagaaagagaagaaaagggacagtgggagagctagctagacaaaggagggcgggatctttttcttaaaaaatgattgatataatgacctaaaataatgtgttggatgtttttaagtcgaaaccgacggtcagatgttttgttctttttcataattttatacgatttttttaacttaagagagacatgtagtggcttagaaatatttataggatgtttaatgtactttaagtctttaacattgtagagccggggcgggaggaaaggaggtttggtagcttttttttaaaaagtctaataacaatctaaatggtatgtccatcaatttaagtcgaaaccaatggttaaatgtattgttcttaaatttttatgattttctctaatttagaagtgtcacatagtggtttagaagtatttataaggatagttaatgggttttaacgccatatgggagcgtagaggaagtttgggattttttttccgtaagaaaaagaaatatctaataacctaaaataatgtaaaaagatggtcaaatgttttagtatttttatattttctctaactttagagtgcgatatgtttagaaatatttatatgatgtttaatgtacttattaggagacgctagctagtaggttgatgggcgttttagacccgtatttttttaatccttattattattatggatattaaaaaaaggaaaaagggaaacggatggatcatacgtacgttgctctaaaaatggatagtcgtacattgtggaggcgtacgtggatggagggagattttgttttctcgtgaagataaatctaactatcaaatttaatgggttcaccaatttaaataaaaattgatggttagattttttctattttattagagtgacatatggtgacttgagagcatttgtaggataccacatggcgacctaggagtgtttatagaaggtttaatgaacttttagtatataataatagatagatagataataggtagatagatagatatctcatgagttacgtgtttagaatttgcatatttttttatccatgacattaactaatcaacattagtaggaaataggaatagctagcctcttttacgttgtatatgatcggagcttaacatagcctctttttaagaactatataatatcaattttttgattgattgtattttattttttatatattttttcattcaaatagaactcgtaaaatgtttgaatttttctatttacagtgggttttaaatctagcaacatttgctcaatttccaattgtaaaagccgcctcaaggttatttcactgttaagattcctaggtgcaacccacatgcttattggtatgatgttcaactggccacacatttatttttaacctattgtctatattgctagatgaatacctattatgattagtgacttcatagatcatatgtgtaattgggatgctatgatcatctttcttatgaatatttatttatctcctaataagatcgttttaaaagtatcaagatcaatttgtataggtacatagccttcataggcatgttaagagaaattaattaagttagtagaaagtcgttagaagcctgacaggatataagtaatagatggaggtccatttgtgtctttttttacatatagataattttaatttcagttgataaggagataaaaaatagagagaaaagaatggcgtacgctgtacgcgagcagggaggaagggagatttcggatgttctttttctaaatgattaatctaacaaactaaaattatgtgtcagatgttcaagtcgaagctgatggtcgaatattttgttttcttgtcagaatttttacgattttctcttatttaagagaacgacgtaatatcttaagagcgtattttctccgatttaagagaacgacataatatcttagaagcatttataagatgcgcactttttactgtgttacaatgttggggtggggctatttttttaatattactcatagttctgttcattttacttttattagatataatttaactattatcaagttatatacgatgacaaaaatatatatcattaatttttatagttttaaaattgcttaaatgacacgcaaaagtcagaaaatgtagccccaattaatgtgacatttctctctttacaggtgaattaaagaggacatgagttttaaaatgtaaaatatctaaagacataagcaaatcaaatattagcattataatttagatgctgcatttgcttaattgtttggcatacaatttttgcttttctaaaagaatgaaaataggagaaaaaataggtgataaaaggggtgaaagaattagggggggattgagcagacgcaagtacgtatgtacatgcaattgccaacaacaggccgaggtgggcctacagataaggatatgtttttttctaataaatctaatggttacaaataatggtccataaaatttaataaaaatcaacagttatatgttgtgtcattttaagaatttctctaatttattagagtgccacgtggtggcttaggagcatttataggatgccacgtggaggcttaggagcgtttgtaggaagtttagtgttgattaattttttattataaatccttatgtggaagacttttaaggaaaaagtctgaattacacccttaaacaataagaatggtacgaattgtcctggttatatataatctgatctctcaccatctttcgcaaacacataagctaatatattttttgttttgttttttcttttattatacatctgatttagatatgtatgttcatgggtaatataggatggaataatctatattgtcaaaattatttgtcctaattattaacattatatagatgagaatgacataattaaaaagatataatgtggttctatgcggcattttcgatgatatgtgtatatgttttttctagcaaatactaagcacatattttttcctttttttggagacaaatattttttctcttagggcaggtgtgtgtatgtgtatttatatgatgggtgagcacacgtttatatatgcgctcgtgattgctttttttaaggaaacgtgattgccttatacatcattagtaaaaaaatacttttaaaaaatttagcgagatggcgtgaagcggtgctgcggccgcgtgaattctttgacaaactcgccaagggtggttgctacacatatgcacaatttgaggaaaatctcagagccacaaagaaagaaagaaaaaactactcgatggagctgatcttgtacacattcttcttttttttttcctttatgacatctcttgcgtagatatagatataaaataatggttgaaaataataaatccatgggttatgtataaataagttgctagattttgttttttatatataggatgacccttatatatatacagcatgtactcctgggtgtatagaaccatttttctatatattttttgttagataagcacgggatatgcaatatttgatacttaattaatcttacgctgatggcatgctttgtttcgcgtgtcctagataagctatccaatgagatagaccgaatgaagcttaagagataaaagggcatccacatggtgtaaaaatatatatatggttgttaattttccaaaaaaaatatatgaatacagaaacatggaatatatgaaaatacattcttgataaatttaataatgtcatttggatatatcagtattacacgatagggagtgagtaaatttttaaaatgctactcaaaatttaaattgttttttaattataagtccaatttaattgtgatatacaatcatatagtctataatgttaattattaatatttttttatggatgtttcaatgagatgcgctatttagaataaaacttaaaataacatatatttttacaacttaaaacatatggttaacattaactttttagtttttcatctaatctaagtatataagaaggaaaaaagaaaaggacatagaggggatatgtacgtacatcggacataaggacgtacaggtccaggggacacggccgagtaacgtgggatttttttagatagattgatttgtttttttcttaaaataaagatctagtggttaaaaataatgggtccaccagattaaatgaaaaccgatggttggatgttaaagcgccacgtgccgatctaggagcgtttgtaggagcgccacgtggcggcttgagagcgtttgtagaaagtttaatggacttttagtatataatagaagatggaagttttattgaactcgaaaatctgagaacactcccgatctctgcataacaaagtgcacacataaaaaaaaaaagacactcctctgtttcctctgtttttccttgtttccaactgtaattaggagcaaattgcttcatatagtttgtgtccttgaaactcaatttcaaattaacaccatgaatagctgatattcagtttgagttcaatacctatctacaacgtacgaataacagttgaggtgaaaagttgaaagaaaaattctacctaggatagactgaagcaaagaaaaaaaaaggcaaacaaacaaacaacctgctggatgtatgggatggacatgttttaatgcaaccatattcaaaatcgaaccacaatgttgtgtacaaccatgcctattaaatgtgatcaaatgtgtggcttccacggttcttgcacttgaggtgtttgtttcatcagtacatcctactgtgaagtatacatgtatcaaagttgtctaaccttatagttttggattgggatgtctcaggagatctagccctacatagcagataatgcatactagggtaatatttgtagtcctagatgggcacatttgcataggtactggcaaaagatggtgattatctgtcaattactccgtagctttcaagtacagagtcagcatatgttcttgtgtgaagtgtagaaggagctgatgtcctaattgatgtatacagaacacatgtgaatctacgtatctgaagaggatgctatcagcgtcgaacatttgtgtcattcttcatagatcacactttcaatgtcaagtcgaatatgtttcctgttagcatatttctgttgtgaagtgcatgtgcattttatctcttaattagtagcggactttgttatatcctctgcgattctttcgtttttgcatcgtatactctaagacgtgttcagtccacgtaggttggcattgttggaggtaggatcgatcatgcccgtgtgtgtagaatctgcgtgtttatttctgctatataatgagaagagaaaacccaaaagctgcagaagttagggcagcaccaaacttgttgtttgtgttcctgcgctctgagtttccatgaaatcgtgtgcgtgtgtatttaggattagacaccaacgtttcctgcaatcttgaattgcctttgctccattgcccatatgcggcgatgagttttctgcttgcaatattttcaataccttgtttgtctgcacttccattatttcctagcaacccaatatttcagaaaaaaaaagacgtttgaaatttcaaaatggattgaaatatttttgaattttcttgtcgttgccgtgatatttgctgaaattgaaaacgcatcgtggaacttttactggatcgagtggaaatttaaagggtgaatgctaatatggtccctgagttcacttcnggctcagtttacttcttgagatttcaaatcgttcaaataagtcctccaaattaatactttgggtcaatatacccttatataccgtataaaaagaaaacaaatgtttcacacatgtatgatcgttttagaattgtcacttacgattgctgcagccaagcactgatcgcataaattcctttgtcggccacccttcacaacaatgttgagcctgggttggtctttttttttgtattttcttttctatatggtatataagggtagaatgatcattttattcataccgctgcatgcgagacgactttggcatgtttacgtggtattttttgtgggtccaaagactatattagcccaaatgattaatttggaggacttgtttggacgatttaaaacctcaaggactaaactaagcccgcaacgaaacttcagggaccatattagctattcacccgaaacaatacatcatctgatgattttctcttaagaaatgcatcaaactgtgtaagagagaaaactgaagtgatgccagttacaaccgttcagtaccattggacacgatgcaactgtcactggtagctcgagaaatggcctttaccatgttgctatgttggcaccaaattgtattaccacaccttgattatgttatatgtgaccagtggcggcactcggagacacgccgtaacaagacaagatctcactgaacgatgacctaggagggacccatcactccatcagggtgaacgttcatcggttaattctagattcgacaggttaagtagaacatcctcaaatgcagaaatggcctttaccatgttgccgtgttggcaccaaattgtattaccacaccttgattatgttatatgtgactagtggcggcactcggagacacgccataacaaggcaagatctcactgaacgatgaactaggagggacccatcactctatcagggtgaacgttcatcggttaattctagattcgacaggtcaagtaggacatcctcaaataccttagagaccagagagatcgagcattgaagggtgaataaacatgggatacatcggaacaaataggaggaagatgtagaatattgaggaagtcgaggcatctcacgtatgccaacctaaaaaggcaaagagattttgtttagagaagggtattttttacctagcttctacatccaaccggatatatgcggccatttaaattaggaacttagccccgcaaataagccaatctaaaattcaatcatacggagatttgaactcagaaccttgggtactacttaggtcaatacaatcactaagctacgtaccttttcataagtcaaatggcgtattgcatcttgttatatatgacctgtgtacggttcatacgattgctatgacatgttgcatattacttcctccgtttcataatataagtcattctagcatttcccacattcatattgatgtatgtctaaattcattaacatcaatatgaatgtaagaaatgttaaaatgaattagcttgtgaaacggagggagtacctcatatttatgggtcattccctgcatctacatattcatgggctcctttatgagctattacagatgacccatcttatatgtctttatgtggcagtggtggaatctgtactatcatgaacctgggctcatgggctcatagatgtctacctattgctggaaaaagccagtaaatggggcaaacatattattttgggaagacagttgtatttgttggggggaggagggggggggggggaacctttgtcacaaaaatgtccacacttatatagaatcacagacacacacagcagataacactggccaggtaaaacgaaaaggatgaggaaggatgggggagcataactttcaggagaattttgtcaggtaacaagttgttggactggaataacataaaaaaaatattatgacaatataaaggatgaaataatttggggcttgaccaaaaatggagtttttagtatcaaatctttctacacagctatgaaaatgcaggaggcaagttcaatgataggggagatacataaaaaaatctggcacatcaaagtacctctaacaatcaggatttttttgtggttactgataaggaacagcgtgctaactaaaaattacctgaagaaaagagggtggagaaaaggaaatgaaacttgtcagttttgtgacaaaaaagaggcaatacaacatttgttctttgattggcccatgacaagatttacttggaatgtggtgtcctgtgcttttgatctgaaacctatgaagaatgtacaacacaccttgggtgcttggactcagaattgtgataaagttacaaaacaactattgctagtggcggtggcagcagttctgtggtccacttggaaagcaagaaacaaggtgtgctttgaacagattctaccacaggatcctactgacatcttatatagggctcgctcatggatgaatgactaggctgttttgcagaaaccggtggaaaaacaagaacgactacggtggggaatccagccgctaaagcaagtcacaagtgagatgttcaagtcacaatatggatggcgagcaagtatcagaagactcccctggcaactgaaaatggaatggcgccttttcttcctggaagtagccgatggatgttttttatttttattttttgttaactgccactctttagatgtgttttgcggcaagatgtcttttgttatactatgaacttggagtgcaagaacgtactccctgtgttctttatcttgtaatccctgtcatttctcttaatggaaatggagggattttgccctttgctaaaaaaataattatttattatcatcaattttcatctgctcgttgtcacaaatgtacgacttgagaagtctcagccacagaatgaatccaacaggtccatcataaaaacaaaagaaatcctgccagccataatatatatatatatactatgtgagtacatgggtatacatctatatgttgtgtatgtaccaactcttggctacaaaagggaaccaagtggtgatcggttcaaccagccaataccatctgatacacggccttgccaatcgttgtatccagcttgtacaaaagaaagttcagatcaaaccaatatcctttggtttgaatagaaaaggatcgaatagaaaaggatcgcattgctgtgtaagaaatactgttgaatgggtcacatccagtttcccatttgtcagaactacatgcaaaccgattgtttgtttatttttaggtttggtaggcaacagggaacaaatatgcaagtaagcagggcattactgcgagctttggagatccaaagaacagatttgagatgagttcaggagcattgtgcaaagcgtctcgccacctacatctacgtacgtagctcataccgcgaggcgcagcaggtaagcatgagtcatttgactatgaagaaaggtgatacgaaactatctagttgttcatgcaagtcagcttgggcaagctgctaatcataaacatacatcaaggctggtatatgtactactaagcacgtggatacgaacggttgcctgaactttcttatgtgttcatgatgataaagtattggcattatctgttgctagggtgactacctttgataaaatgacaccttaaatgatacgggtggcagcagtggggaatttcggacaaccagaggtttctgaacccgtggaactcttgttttgaggacggttgaaataagtaaagtgattcactaattaatccccaatggtttggaaaatcaagttctccagcaagcaaagaatcgtataaatgtataaaaggggggaaatatatgtggtaaacaccgtcgagtaagtaaaaatttgtgaaaatcatatttaaaaggtttatatataaattaatgaaaaaatacactagagtttggtatagccacaggggcggagctatagtaatagggccggtgtcaggtgacaccgacgactttcgacaaaacgtatagcaaaactgcttatccataagttataacaccatgatctaaccataattagtatactatgacaccgatagacacgttatgacaccaacgaatcaattttctagatccgccactgtatagccatgaaatatatttccatccaatcttaagcctaaaatcaaattcaattttagaaggaactaaagtgacagcctgtacttttcacctaaaatctacgcttttttcagaatttgtaattttttaattcatgttttcatgggttttcatttcattgaaggttataaatgtcatgttcagattgtagccaaaataaccttatcaaagtttggacgagattgacaagattttttatgtttttaccagagttttggtaaaaaaaactaaatagatgtatgtatttagcaattttactaaaaaaaatagtatagtttgaaatgaaatcaatctaacaatcctaaaagcccttcctcacatgattaggcagtcaccagctagctaccgctgcttgcagtaggtcgtcttgcgttgctactgtactgattacatcatttgactaggtcgttgcacgcgtcagccggtagtccggacagaatttcagtagcatcattggtgcatatgccaaccgtcgagaatgtcagggatgatcagccaacgtggcaaatatgctaatttgtgttagtaaactaataaaaagtacatggacaactaaccggacttcatactactagcaagtagtgtatatatcagtcttttgctaatacaatattctcggtcaacatgctgcatatcgacatcgtacagtctttacatacataatatccatggcaccagtttggcactctagaagaggccatattaaagcatatgcatccatgtacagctagaaaacaacatagattcacatggcaccattccaattccttgctaatagatacactgacaaagtggctttatccaaagcaaaaatccgttcaaaaccatggattatcctgatacaaccattaattcatgccttaatatataaggttttgtacatgtttcatttgagtaggacaacaatttggaaatgtttataccggaaaagaaccattcaaatgtgaattatttcacatgctactcatgctgagggtggtatatatatgtattggcagtgtgcactgaaatactcatccatgcatgcaaagaaagcctgaaactcccaagaaatatggaaggagaagaagagagtgaaagctggccgccgcagctcgcaccgccgtcgtcgccggcgagcgccgtgctctccgacgaggacctcctcggcgagatcctcctccgcctcgagtcccacgaccacctcgtcgccgtcgcgatcgtctgcaagcactggctccgcgtcgcctccggcgagctcttcctccgccgcttccgtgtcatccacccgccgcgcctcctcggcttctgcgtcgacgacggcggcggcggcgacgctgggcggcggccgcagttcaaggcactcccgcagcatccgggcgtcgccgctgccgccgcgcaccggacgcggcaccggttcttcggcgcgttcggccacctcgccggctaccaccgtccgtccatcgccgactgccgcgacggccgtgtcctcgtcgagtcccccgacagagcgccgcggcggctcggcatcaacacgccgtaccgctacaccgtgctccggccgccccacccgcgtgaatccgtgcaactcctccctccgctgccgccgccgccaggccgcggcgccgggaagcacgtcgtcgaacgcgtgttcctgcccgaggacggcggcggcggcggcggcgaccatggtatcacgctggtgtacgtgttgctggtcgagcggagagtgaccgcgcgagtgcacgttcttgactccggcggagcgtggggagcgccaaccaccgcggagacggagctcccggcgccgtcgtgcgacgacgccgtggacaccgttctgccgccgatcaacggcgatgtctacgtcgtgacgacctccggctacacgctaggtttgcgtctgggcaccacgcgcttcaccgtcgtcgagctcccggacgcggcgaggtcctccgccaacttcaggatggcatggtcacacgccgccgccgccgccgacgacgacgacgtcgctcgcggccggctctgcctcgtccacggcgacgggacgcggctcagcgtctggcaccggaaaacgacgaccacggaggacgacggcggcgcggccggagttgggtggcggctggccgacacgttctgcgtgcgcgaggcgtgcgagcggatcgagtggcttcccgacggctggtggaccggccgtgtcgcggtgatcgccgtcggcgacaacgccgagttcgcgctgctggacttggagaacgtcggcgtcgtgatctacgtgcacctgcagtggaggacggtgaagaaggtctacgagaggaaactcgccgacgccgacgatggcggcggcggcggcggtgaccgccagccgccggtgagggtgttcccgctgacgacagtctggccgccaacgttcccggagttggacaaaccacgacagaattgctgcgtcagaagcccggacggtctcgtcggaggcgtggtgatgacgtgccacgccggctggtcggcgacgtcgccgtcgtgctcccgccgggatggggacgacgacgacgacgacgacgaggacgtcggagcagtgctcccgggctgttcgtgggccggatggttcgatgacatggctgcaatggtggcccagctcgctgaatgggccgcgcagcccagaagcccaagaagatggcgttggtcttgtctctgatacgacccacacatgacacaccagatactgtggcagctagccgagcgcgaactagacactgcgaccctgtagatcaggtgcaagctggatgccactgggtgtactccacttgtgaaaatcaatttctaagagaaggtgaacttaattacgacaactgtctcattttattggacaatcaacttaagaatctatctataattattggacaatcaacttaagaatctatctataaaaaccgtttattatagtcaggtgtttgacgcatttgtatctgaaaattgattttaaaaaactggcacccgtaaaaaccgagctgagccgaccggtagtctcaaacggataaggcctagaggaggactcggactctccggtttcctcattctttcacgctcccccctccctctctctctcctgcgtgcgcttctctctctctattgtcctagtggtggctccgcggcggcggtgccctcccctgcccgtcgacggtggtgaattttttgtgttagtgttgatatttttgagttcttggatgcctactaattctatgaattaaatgttccatggaatcgggatgaaggggaacagcttgagctgtttttttcccttgattcttgggacctcaaaggttctcttatctatgctgccttctaggtgccggttaggaaatccggcacctacgcagggttccaaccagcaccaatctatgtttatgtaatcgtgtctttttgctgcacgaatttgtttaattcatatgagcttggacgataatggcaaggttaattttacacagtttgtgttgatcagtatgagacatgtgtagtgagtacacataggacatgctatatttacaaacatggtctctactttgcttcatcatagcttggtttttaatttctttctgtacaatcagtattgcttcatttatatcttttgaagaaaaaaaaaatctaaaaaatgccattaacaaacgccaaattctaataaatatcatcgataaatgtgagttccataaaatgctatcgtgcgaacgacttatcacataaatgccattaccgttagggttctatccaacccaccccatcaaatgcacagttcatcttgtatcacttaatgaaaggctactaacggaaccctaatagcaatggcacttctgagataaaattacttatacgatggtattgcatagaactcgatgcttgttaatggcatttcttcgatttttttttctcatgttttcattgaacacatgtatgtctaaatagcatctttatgatatatatatatacttatgtaatatcctagttggcacctaaatcaataagattaagcatgtagtcaaatttgtgcttcaaaacaagtgttttaaattcgtgcactatattgcacccatctaacaagtttgtgtatcaccagtgcaatttacccttgaatcaactttacttttattggattgtttacccaagtagactttattggattaattgtgtgcccatggatatatgattatggtgggaggtttggggcttcccctactaagttccggtaaaaaaattgatattaagaggacattcctcatatatacacggtgaattcaacagactttctagggccaaatacaccacggatcatcaagataactctagggccaaaatatgctaccaaattgaggctatcattccacagaacgaaacaaaaattggaaaaaaatagcacaatttcttgagtaatgtaaccactgaaaagtactagcttgctgcaacaatggggggagtgcagtaaggttttgttctccgatgcttcctgccgatttcccttcaaaatcagacccaaatagcatttatgaatcaagatatattcgtgaatgagcacaaatgaaagaaattgaaattagaatgcaattgtttgactaaaagaacattacgagctaagttcaattaacagttacctggatctgtcatatatacaaccatgtgtttgttctgcatcaaaattaccagacaacatgcatgctgcggcgcatacattggaggtgtaggggatgcgaccatttgctgttcgccagctgccggagcttgcacttgggacacaagctaagaaaagaaagagagtggggaagaactaatgaaacgagaaacatggatctggacaatggacacatgattatgtggagaaaaaggtgttgtggcaccgacggtagctccatcgtctacagctcggcggccactccggaagctatcgctggatttgcagcacttggacatgttaatacgcacatttagctcttaaagtatgaaatagaaaactatagttaaatttaaaaagaacccaccctaggccgatctgaccacagctatcgggctgatctgatcggcggcatgtggtcagtcagactagcagagtccgattccaagttcgatttattggttcttggggcttcttgctaagacatgagattttagatttctaattggatatgaaatatatacgggaaagcaagtccaccactcctataaatataagggagcaaagaccgattgaaacaacaaccaatcaatcatcaaaatcaatttaatatcccaaccctctatatcctatatctctctccttttgtttacctatgccaagtctattctcctcaaaccatccaattgtttgtcgtctttcatctctatggtgttagacgacgtcctagccggcatgccgagtctaggacaaaccggtgtgtgttcactttgaagggatccctcccaagtgtttgttcagcagtatctacccgctccctatagcagtgcgcctctaggcgccacgccgcaggttgcacataacatgtgtagcaacacgattctacgtcaattaaatactcgttggtagctggtgtatggagctcgagcttggctaatgcttggtagttacgagagggcaagcactggccacccatggaagaagaaggggaggacgtagacaaaatgggtccaaaaactactgagcagtgaatttatatttgcaaggcaaggaattcttggcagggagagaaaaaaaaaaaaggaaagctaatctggccacgctgatgctgatgtggcactcctttgtatcctcctcgtcagaagttccctaggaacatggacaaactcctgtaccaagttctggtaaaaactataattggattaattgcgtagccatggatatttgatgatgatgggggctgtgggtcctcccgaaccaagttctgttataaaaatgatatgataaggacattcttcatacatggtgctaatgacattcaagaaaaatcaaatagaagtggaaatgtttcttagaattaatattatttcaattaataataatttgcattctatgtgaaatacaacataaacttttatgttggtggtattgcagtatatgcacaagatgacaacactcaaccgaatgtcttgaaatggagatgggtggtttagttactgcctggaagctattatagtaaagagggaagcacaacaccatggccaaggatgatggttcaaatctatgggatttcagaaaaaaaaaaagcaaaggcatattgactatccatggtacatccggaaaataaaaaactttgcctggtatatgagatctatttttttcaaaaaaaaaaaaacagagcagacaaaggagaatgttaatcggaaggaatcaatataatgtagcccaagctgcatggaattcaaggattaagtgtcttgggggattctttcattcttaggtattattattagaattatataaattgtgtaacatgacaccaaatgaacatgtgcaatgacaaaaatgacccaaaaccctatcactgcaaaccacctcgaaaaaagcctaaacccccaaatgggcaaaaggtggggcaaacccattctcatcctctccacactaccaccgtttccttcctcaagctcccgcctcctccctataggtcttcaaggttgagctctctccttctctcccatggagggacacttgccatgttcgctgagaaaatattttgtcccaacaaactgtatgttctttcataataaacacaaaatgtatcagcaatatgtagcacttgtaccacataaatgctttaattaggtccgttatgggtggttgcattccaaatatagcgcacatgtgattggtcacttaaaaccagcacgatgcaaagaaagataggaaaaacgtgtctgcctcattaggtcaacaaatattgtgggaaaagattcatcttttggcatgagaacctatgggacaattaaataagtttcttgcttcaaatatttcatatggtacagcatgctgaattgacaaaaaaaataattttccttgcatttaagatttttcttgtgttgaacatagatcttttttaatttatccactcatatattgtttttctagtagctcattttctagataggaatttcattgtttattagcattaagctggtaatcagatgcaacaaatacatgaaccaagactagtttgtagggatctagaaaagggaaaagggataatatgattaaaaaaggaaatcggatgatgggatacaaaatagaaagcaatgatatattggaatgtaaataaaggagcgacaccctccaaaattgatagttgaccatggtttctctggcaaaatatcatctaagaaaaagtccacctttgccatgttggccaagtaggcaaatgataatgagtctcgcattacttgggtgggactgaaaattcctaattggcctatgagaatgctgcaacactgttgaaaggctaagccatgtcaccattggatccagcagtgccgcttacactgctaccttcgaactgattgtaccccattgagccagtgccccttgcaacatccatcagccatccctccctctggattggtacctccgtgctcgacaatgagacagatgcaggtatgaggccttgctcacggagcttcttgaggcggtcgttgacaatcttgaggcgtgaatttgccatccttccgaggctgataatctgctcgatggtgagaccatcgaggcttgggtggcggccattgatggcttcaatgaggagtagcttggtctcgctttcatcagcttcgcgtcccagcttgtgcaacttctccttgagcttgtcgatctgcttgttgaggatgccctctaggtctatcatcttcttgtatctgcccagctgcggcatggccttgaagtgctcgagaactctggtcgcctcccacaccgacggccaaaccttcgttgcttgcacctcaacctcaccgtacaccatgaggaacagtgttgcgaactcactaaccttcttcatcaagcccttcagatgcttcctaaatgtcacccgccgcttcacatcaatgacgatccgcagaagcttcatcttcttgcgagccatggcctttgcagttcaccactttctagcaagaatgcacctgtaaattgatgagagatggttagattgatgtgaaatcaaagaaaggggaatatggtggatttatagtgggagatcatattgcaacaatcgccatgatgtggaaagaaattattttgcaaatccaaaaatatcaaatgaatcaatgtaagttaatgctttcctgaaaaaaatgatcggttaatgtgtagctggcgagcatatcttcaacctttaatcgtgtccgtctttagaaacttccttgcaggcatgagctagcaatagccaatagatattactcgctagatgataatgagttcacaccaaagatacgttcatccccagttcatcatatatgtttgagttaatcctctttcatatgcgcaataggaattcaatttacaactacagaaatgattttcgctacattcaaagagttccaaggattgatcctgtcacgatagctgccatcggatgggccatatctgccacagaatggatgatttcccccatcactcataaacttgtgaacaagggagccgccttcatgctcgctcgctgtcccagcttgcatctgttaaaaagcatacatagttatcttgttaagaaagagaacactagataactcgcaaaccgtatttttatcaactctactattattggattatttatccatttattgcagttgagtggagagaacagtgaagctagctatgtaatttgaggctcctattaaagccccattggtctaaaatctcaacatatttgttgcaagtcatcaattatattattaaaatttagtaaagccacaatgctcagcaaaaagaactagcaaaacagtactatattccaagggaaaaaagaatttacatctttgatcatgtagaatttagattgtatcaatttagactattctaccacctccacaacatcaattggagaaaaacaagaaagattaacaccgctatgttcgatgggtccagattttctcactatactgcagtaaattggtctgcctcaaccgtgtaagaaatatactagtataactctattttacagcgaagatagcgtgaagacctcggctagttcgtaaaattttatcttatatctgttcatggttttcaggaaacacaaaagcacatatgaagttggcttgcaatttgcacaagaattacatttggcagtttccatgccgtaatcatttccttcagttcttggacagaagttgactttttatctaaccagatcaactttgcttgcatttgtaggatgttgttccaagtgtaattatgtccaaaaatagcttgaagaaaccgttggagaaaatagaaactaccaacgctgaagcgcataagattgttgacctgccaaacttgataagcaagaaaaaaaatgacaaccatagaccaaatgttttgccatatatacatccattccgttgcagatccaccacgctaggtaatcggatgaaatatggaatgtcggtagagaaaaaatgtgctcaatgacgatgacaacccaagtcctggtgttattatgaactggcatccatggtatccgtggatctagtaagataactctcgcacaacatttttgtgtcggatgcagaaaaagtccgctatttcgaacttgttatgtgggttcttgtttccaagaattttcatatagatacaagtttcacttagatgattgagcaagctacagggcaatcaattatttgaccagccaaatttgataagcaataacaaaaatgacaaccatagaccagatgtttttgccatatatgcgcccaataatgccactgcagatccaccacgctaggtaatcagacgagatgtggaacaccgacagagaaaaaaatgtgttcaatgataatgacaacccaagtcctggtgttcataaaatattattctgcaattggcatccatggtatccgtgggtaggaaaagataactctcgcacaacatgtttgtgtcaaatgaagaaaaagtccgctatttggaacttgttatgtggattcatgttttctagaactttcatatagataccattttcacttagatgattgagcaagctacagggcaatcatgtcgtcagttaccctcggtttaagagtctaactgctctaaaaaggagtctgaaggaagccttggatgaaaaacgtttcctcttgtacaaaactataatcgtggaggacccctttctccattgaaggttgataagactggcagcaagatcctagcaactagtccaaccagagatgcaatattattagctttgggtgttgtgacatccaagtcatcaagtgtattactcacttgatggtgcagagataggtgaacaagatcaaggagtattagagatgattggggctgaaactgccaaaaagttgaagagatcacctctagcaggcataacagtaggaggacagctatatatatgacaagacttttgagatatgtggatgcagccaattggggacctgcctttctgatgagttatttattcacctcacttgacctaggtcaccttgccaggtaacatggagtgcctcatgacgcttaaagatttgatgatcccctattagaggaactagtcgcacgggatattattattgtaatttttagtacataaaaatgttgaattataccagcttagactaattgagagtagagtctaaatcaatcataacttgctaaattctactttcaaaattaaattaatacactaaattaaaaatcgatgatagttacatcattgtagtattaactttgaattctacaattattaatttttggaaaatgaaaattaaagagtccatgctattttcgtcttgcatgttttatttaacacaaactggcaatacaatttacgatcatcgtaatacgcttttaacagccataccattttgagttataataagagcgtcaagataatgtccaattatataatataggcatgaaataagttgtgtatcaacatacacaaagcatctccaaccattaatattataccgcacggttcattaaaaaaatacactactttgcaatttatcttattgtttttgctaacgcagtagccacaagtataataccatgagcgaaagcaataaacccatataatacaccctatcaatttttctctcaatcacaattgcaatggaagtatatagattccataagaaatctgtatatgtcagaattatgattctttgatgaaagcgataaaaaaacacaattatcttgacctcaccgagccaagtgcatcatatatgtacctccttgtgcatggagacattatgtgataaacctacgattagtccttcaaaggatgcatgtacgaccatataaattaggaacaaatctaagaaccggtacctacaacttcctaattatatataggtgccggtttttttaagtagactggtacatataggtgtgttcacaagtactccactgacgactggatcaactataggtgccaacttttttaataaccggcatataaagtattggtgctagtttttgctagtaaccagtacccataatttatattagatgcaggtttcttttctgaacatttatatttaggccggtaccaatttggggtgagtacaatatggacagcgtggcaattcgttgtaaatttatacatcaagaaactgtagaaatttgtcataactgcaagtcgattaggcccggagatcgaggtagtacaacaattgtggtatgtttgatgtgatatggccatcatagtttgaataagacaatttcttcacctctaactaatttgatatttcataacaaaaagcacatcgttcaaatgtatggctaacattatcataatgttgaaccaagaagcgattgatattactattttaaatcaataagattaagcatgtagacaaatttgtgcttcaaaactagcattttaaattcgtgcactatactacacccatccgacaagtttgtgtatcaccaacacaatttacactttagtcaactttatttttattggattgtttacccaagtagactttattggattaattgtgtacctatggatatatgatggtgggtgctgtggggcttcccctactaagttctggtaaagaaattgatatgaagaggacattcctcatacatgttgaattgaacatcttctctagggccaaatacactaggattatcaagataactctagggaacaggttcccctagattaacccctacggaagacaccctaggggtcaattctaccggaaagacaaacttccttggagtttttcatgaataccttggggaagatatttgttccctagagttcgaaattctacagatagttgtacatgtggcatgttcatcctacgtgtaaagtacattcccctaggttttcagctacaaaatgaaatcttttattattttaattttttatacatgttgtattatcctcatttacctcaatgttcaaggaaaaaaatgattaattaacaacaatgttacttttattatgaacagaaaaaacttaacttgaactgaatcttcaatttgcatgcttttgtagtacagcaacaaagctggaaattaaactgggctaacatttcttcttacaaacacgctcacactttcaaaatatgctacctaattgaggctatcattccacagaactgtaacatacccgaactctagaccttaaaaattttctgtcaaaatagttggaagctaacttttctatttttgagagccaaaaatttccattttaaaacctaggtgaagttgatataactcttgcatgataaaattttagaacaaattaaaacctttgcatctctaacctaggacaaaaatataagtttatgtgtaagcatgcatattctcatagccatgtttgacttgagtccttcatatgcatttggattgcatttggattttcgatttgcatttcataataggtctcataaatattaactaagatctagataaacaactgaaccattagggcctagtgctagctagaggaagttaaaataggaaccatacatcttaaaatatatcaacaaggccaatgtcaagccccacaaaactatttggtcatccatctgaagactagtcatgaacctggaagtgaacaaataaattaactcatataggatatattccaccttagttacctttataagcattctcttaattaaatactagagtaaacttatgcataaatagttaaggagcttattacatgtgtaaggtaaactaaaattctaacatatcaacatcacctcaggttaagaagagtctaaatataaaagtttaaaaacatttacatacatttaggaaaggaaaataattcttgctaattatttaaaataatctgtgcaagataaaatcattgaaaaattcatgtaggctctaattaacatatacaacacacagtaatttcggtataatttaataactaaatttgatacctcaaataaataagttaaaccagacaaataatagactaattataactcctaattggctaaaaccataccttgttgaaaagtgcatttaactgcatggaagtgtataggggaaataatttattaaaatactaggttaattatcatgactaaatataatttttctagaatttatcttctctgtttaggtctcctaaaaatccaaactagtttccaaagaacccatattcctctaatttctgtgagtaatctatccataatttttgaggcaaccaaagaaaatggaatctaggtatcttcatctaccttcagaaaaatccacactaaattatcctaccccaaattaaataattgaattactaaagtgggagagagaaataatcctgaaaatcattcaaatcttttgttcacccacgtttctgcccaaccctctcaccctagcttagtttgccacgacctggacccacttggcagccactttggctcatcctcaccctgtgcaaattttccagccgaccatagacagccgagagagagagagagagattggcgccggctgtgtacgacgggtggcctcgacgtggcagcgccgaaccgaggcttcacctccacccagctgtgtcgccactcttcacccaccatcccagtgccgatccaaccgagggaggaagctccagctctccctctctacctctctttcgtcgccggccgccaagaagagggacattgccaaccgtcgtcgagccctctccatctctaactcatactcgttccattctcatatcgccatgccgaacaactttggttttgatcccattccatttcatcttctacagcagcgggaacgccgccatgtcatggtcgctctagagcgcgctctgtgcaccgccgcagcgacatcatcgccgttcccgcttatctggaccaagccggaccaagctgtcgcgccagcgtcttcgcctcgacctcctctccatttcccctcaagaatctcgaaggatggtgctacgagtgtggagatcgtccaccgtcttcttcacctccggtcgccgtcgccattgtcgattccgcctcctccggtgagccattgtccgattcttcgcgtatacaccatccctggggcctcactaacctcatggacacacatacatgatagttcttggagctgattgagcctcgccgttcacccggaggttcttgccgccgccgagccgttacatgagccgccgtcatcaacctagctaccccagccatgtctagcatctcggtgagcacccttcagcctatagaacatacatgcatgcacccaattaaccaatacatgattgtagaagcacatgcatcaccacccgaaaacatcctcctttcggactcccgccggcgttactccgatgtccactgaccaagaaaagtagaggaatggaatcgcaatatcatgatcttcattttgtcttttggtcgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgagcctaggtctgcgggttgattcttagaaaccgcagggatctttttgtatattgatctctcactgacagtggaccccttggaaacaaaaatctgaaattataaaagaaaagtacctaaaacctgtaaaatccatataaaattaaatatagctcattttaagatgattcaaatttctgtgaactcaccaaattgtgaactttgatgttatggaataaaaacttgcactcacagtacaaatttagcctctaaaatttatccaagttaaatcacacataaagcatgcacaaatttataaaatgcatacaaaattcatttcaactcattttagagcaaacttagtttctacagatccaccaacatgttctctaaaaataaagtaaaataaaacatataaacactttacatcaaatgcctctaaaactattatctttaaaataactagttttgcataagatgaactttagaagtttatataaaattcatcttagatcctttttgagtaaacccaagttctgtagaatcaccaaaacatatacttccaagttataaaataaagttatatacttactgtatgataaaagcctctaaattcttatgtaagtaataaccatcatagagcaaccttaaattgtaaaatttgtagaaattcatctttagtctaaatgaagtgaaccaaatatctatagaaccagcaaacagtgggcttcaacatagtaaaataaaatatggaaccttctgtacaggttatagctatcgattgagcaatatgtatatatataaatgtatatagaaatacactctagctataatgaaacacaaataaaacctgttagaccagtgaatgcataatgcatagttccatccccatccaccaaaacttaaggcacttagctcatataataatttttaggttgatataataaattgctagcatggactagagctcccctagtttataaaatatgaaccatggtaataaagaccataagcctatgaactaaggttagattagttaactaaaatactcattttatacatcactagctagatgaggcaagttctggacctaaacctctaaagctatgaacctatagaacactatacacctataacacgttataacttgtaaaatacataaagaattcatattaactctaaaaattatgaaaccaaatgtgttggtcttagaaaacacatatcttcaccccagcaaacataaacttaacaagaatcaccttacaacagcatttcacaatagtacctaagtaaatcctacactataccgacgaaacttctaaaattcataattctcaaatgaaatgagataaaatataaattctttcacctaaattcattttagaccagtacctattcactgtgcacaaatcatccattttagagcattttggatttttcgcatatttcggtgtttaattgcataacgtgtactttgtttagatgattgcttaaacggtgaagaagtgatttaggtgctgacattttcctgattcaaggcaagtcccacctccctctctttgatcactttgaacctatgttttggaggttattgaaaatgtttgaacctatgttttggaggttattgaaaatgtttgcaaatcctgcatgtcgattgtacattaacaaattaaaattgtgttaaacttgttagacaaactcctattatttacattatcaccttaaccccacatatatccatatccatcattcctatccttaggaacaatatgactataccacgttatatatgaattttggagtcactaggttattataatgcttagccatgcttagaatggtcttccttgtcattatgggttcattacaaatatgaaaaattgattttgaaataatctggacagaactttaatacttgtgattttcataaataaaatgatggaaaacatggattttaggtttgggcctcaactggtgcacatatggtgattagttgtgtaccgatagggggagagtgcacccaaaccgacctaaggacttcactcaatgtcagttcatttcgtatacagtacaaccacatgtgctagtatgggatagctcaagcttagtaaattatttatggtttagccttacattctggtagaccggtgcgtatgaattcggataactcagaggaacttcctatttaccccgacgtggtagtttaggtcactaagtctgtccaatacaacggtattgtgccacgtgggtgggttcccgttgtgtccgccaccacggcgttaagtttaaggcgtgagcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattcgttgtgctcgcggtcatgagcggcgtgtggatatctattgagtatagacttgtgtttattctcctaaatgctgaaatttacctttaaatcaatttaaagagatttgagaatgatctccttgctccttgctgccatggaaggcaatgaggtgcatatttatacatgattaatgcctattttgatgcccaatatgacaagtactagcttgttgaaatttatttgaaagtaaacctgatttggaaatgttttatgcaaataaaacttgctttatgctaaaaagaaccatattatgtcttccttgattatatgccttgcaagtagggtgttaggcttgtcttggtgcttgccctaataatgtactgactcttgctattgaattaatcttttgcttgcaggttttagacttagtctttgagtgatgcgggtaatcgactgcttcttctagtacttgaacttaatggggtaaacccctagtcggtgtgcttgtggattgggtagacaagcttccgctgttctatatatttatttggccggtcggccaatgtaactaaagtagatgtagtttataatcgctttcatcttatttgtgtttgctatgtataatcatgcttgagatgaaagtgtgaatctagtgcacatcctgtgaactagattcacatgagtatgagttaagaatatttgagatgttatagatctttagccatttttgttaagtctcctgaatgtgtaacacatctggtcactgccttcgagtggtttgacgggcgtatctcaggctgaagttgactggcaggttaaaggctcagcaatgtctccaatattcctctctcgaggcgtcggatattttattatgcttgtttgatgacttgaattattcatttcatctctcaattataatggaaggtccggagagcctatgacaagaacgaaacaaaattgaaaaaacaaatagcccaatttcttgaggactaaaaccactgaatagtactagcttgctgcaaaaatggaggaagtgcgcagtgagttgttctcggatgcttcctgccgatttcccttcaaaatcagacccaaatagcaattatgagtcaagataaattcgtgaatgagcacaaatgaaagaatttgaaattagcatgaaattgtttggctaaagaacagtacgagctaagttcaaatatgtacaaccatgtgttgttcggcatcaaaattaccaggcaacctgctggctgtggcgtgtacattggaggtgtaggggatgcgaccatttgctgttcgctagctgccggagcttgcccttgggacacaagctaagaaaagaaagagagtggaccggatgaactaaagaaccaagtaacatggatctggacaaatgattgagtggagaaaggggcgttgcggcaccgactgcagctatagctggatttgcagcacttggacgtgttaatactcaaatttggctctagaatataaaattgaaaacttttgctaaatttaaaaagaacctagacttgtcatacgaggccggtcggaccgatagcaggggccggtctgaccggcagcatgtgatcggttagactggtagagtccgactacaagtttgatttatcagttcttgggttttcttgctaaggcttgatatttgagagttctaattggtttctacagctaattgaacgtgagaaagaacctgggaagcaatttcaaccctcctatagatataagtgagctaaggcggattgaaacaaaaccaatcaatcgttaaaatcaatttaataaccaaaccatctatattttctatctcactttttcttgctacctatcccaagtatattctccttaaaccggacatcctagctggcctgttgagtctaggacaaaccggcgtgtgttcaccccgacggggtctctccgagtgctcgttcggcgacatctatccgcgccctataacggcgcgtctctgggtgccgcgccatgggttgcacataacgtgtgtggcggcagcacgattctacgtcaacagaacgctcacttgtagctggtgtacagagctcgagcctggttgatgcttggtagttaggagagggcaagcactggccaaccatggaagaagaaggggaagatgtagattagatgggcccaaaaactactgagcagtgaatttgattttcaaggcgcgttgttcttggcggggagagaaaaaaagggaatgctaatctggccatcctagtgctgatgtggcacaacttagtgtccttctcgtcagaagttccctaggaacatggacaaactcttgtaccaaaataaaaacttttattggattaattatgtagccatggatatatgatgatgctaagggctgtggggcctctcttacaaactcctggtaaaaaatgatatgacgaggacattactcatagagaaaatttcctatgtacccataaaagttcacctaatctcttatttgcttctgaattttgctcattctcttacatacccctgaattttagtttggatcgcttccacgcccttttctctagttgactgctaaattattatgaaaaagtccatttttccctttgctacgagaaacataataaattaatggagtacattgttggatgtagaaatttgttggatgagactattatatttatgagtttgttatgcaccatattaactgcgacaaatttagttttagatttgatataaaaatttaatatttatttattagttattgaatgtttttttatgtagcatattgttgacgaaaaatccgcactcggccagtggtgccgggtctgtgctggcgcaaactaagtcgacgaacataacggtctgggagatctgcttagctccagtgcaggtccaaaggttggtgaaatacaggcgtgtcagtcaggtttatcctgaaactaacaagatatacaaatagcaggtcaatgagcctatcggctgacgagccgatggagtagttccagtcgatgccgataccagccgatagtgatagggtttggagctatcggttatatatccaatttagattctgatacttgagacaatcggctgataataataaataacaataatataatccagtagaaaccaatcggctaacattgatatgatagaataagcactgatccgaaggttgaagaatacatcggttggagatccgatgtcataaaatccagaagattagattaaacagtgaaatctttgttatcatcgtctaaatccaacttatatgcaatccttgtaaaccgatgcaacatctagatacctcatcggctgaaaccctgatgaaacccttattggcagtccaaaagcaggctagagattatggttctaaacatgacttagtagatcaaacttaactgatgcagcactaagtttgaaaagaaacacaatatctagataatcaagccgttgactgatttttcgggtggtagaagccttagctaatctaatctagtaaaataatttagccgataccggcagaaaccctaaagcgagagacaaccgatagagctaaattgagaaactaagactagattaactaagacatatgataaatagccaagcaaatatatcaacatcccatagaaatccaagaagtcaaatgtactgatgcagccttgaacgacaccaatgtagccaatacaattgactaggccggtagaacattggacttaccccttcgccggagatcgaatagcgatgtagccccgcgtcaggtgtcaagttccaccgtgataaataaaataaagtagaaaaggtaaaaggtggcgatccaccgaattgtattgatcgtggagatattacaatgaccccgggtgtacatatttatacccatgggtagatactagtccttgtaggataagaaagagactttcctaaagatgaaaggaaaacataaagtccttataggacactaaacatactttcctaaagataaaaggaaactgacaaactattcctaattagtagataacttgccatggcgcatcctccttgaacacggtcactagtggataagcttcctttaatcgattaatttccttaaccgaatatagctggaatccaactatatgtgttttgatagtaatacaatagatagatgttgtataagacaaatatatttatatgcaacataaacaactttcaataagtaataattaagtattattttttatgtcatctctaaatgtatatttatcgcaaataatatggtgcataactaactcataaatataatagtcccatttaacaaatttttaccctccgataatacactctattaatttatatgcttcttcaaagcaaagggcaaaatgggcttttctcataagaatttaacggtcaactaatggaaaattcatagcctaaactcccaagtaggcaaaaggtggtgcggacccattctcatcctcttccttcctcaagctcccgcctcctccctacaggtcttcaaggttgagctctctccttgttaagataatattttgtcccatgttcgctaagataatattttgtcccaacaaactgtatgttctttcattaaaaacacaaaaatgtatcggcaatatgaagcacttgcaccacataaatgctttaatcaggtctgttatgggtggttgcattccaaatatagcttacatgtggttggtcacctaaaaccagcacgatgcaaaaaaagataggaaaaacgtgtctgcctcgttaggacaacaaatatcacgggaaaagattcatcttctggcataagatcctgtgggaaaattaaagttttactaagtttcatgtttcaactatttcatatggtattgtaggctgaatcgacaaaaaaatcattttcctcgcacttaagatttttcttgtgttgaacatagatcttttttttaatttatccactcagatcttgtttttctagttgctcattttctagataggaatttcatcgtttataagcattaagctggtaatcagatgcaacaaatacatgaaccaagactagcttgtagggatctaaaaaagggaaaagcgaaattattattaaaaagggaaatgggatgatgggatacaaaatagaaaggaatgatatattgggatgtaaataaaggagtgattgacaccctccaaaatcgatagttgaccatgctttctctggcaaaatattatctcagaaaaagtccacctttgccatgttgtccaggcaggcaagtgataatgagtctcgcattacttgggtggcaaatgaaaattcctgattggcctgtgagaatcctgcaacactgttgaaaggctaagccatgtcaccattggatctagcagtgccgcttccgctgctacctccgaaccgattgtaccccattgagccaatgccccttgcaacatccaccagcaatccctccctctggattggtacttccgtgctcgacaatgacacggatgcaggtatgaggccttcctcacggagcttcttgaggcggtcgttgacaatcttgaggtgtgcatttgccatccatccgaggctggtaatttgctcgatggtgagaccctcgaggctcgggcggtggccattgatggcttcaatgaggagtagcttggtctcgctttcatcagcatcacgtcccaccttgtgcaactgctctttgagcttgttgacctgctcgttgaggatgtcctctaggtctgtcatcttcttgtatctgaccagatgcggcatggccttgaagtgctcgagaactctggtcgcctcccacaccgacggccaaaccttcgttgcttgcacctcaacctcaccgtacaccatgaggaatagtgttgcgaactcactaaccttcttcgtcaagcccttgagactcttcatgaatgtcacccgctgcttcacatcaatgacgatcccctgaagcttcaccttcttgcgagccatggcctacgcagttcactactttctagcaagaatgcacctgtagattgaggagagatggttagattgatgtgaaatcaaggaaaggggaatatggtggatttatagtgggagatcggattgcaacaatcgccatgttgtggaaagaaattattttgcaaatccaaaaatatcaaatgaatcaatgcaagttaatgctttcctgacaaaaaatgctcggttaatgtgtagctggcaagcatatctgtcaacctttaatcgtgcctgtcaatagccaatagatattactcgctagatgataatgagttcacaccaaatatacattcatgcccagttcatcatatatgtttgagttaatcctctttgatatgtgcaattggaattcaatttacaactacagaaacgatttttgctacattcaaagagttccaaggattgatcctgtcacgatagctgccatcggatgggccatatccacagaatggatgatttcccccatcactcataaacttgtgaacaagggagccgccttcatgctccgctcgccatcacagcttgcatctgttaaaaagcacacatggctatcttgttaagaaagagaacactagattactcggaaaccatatttttatcaactctacatttattggattgtttatccatctatgcagttgagtggagagaacattgaagctagcaatgtaatattaggctcctattaaagcccctttggtccaaaattatctcgagatatttattgcaggtcatcaattatattattaaaatttagtaaagccacaatgctcagccaaaagaactagagaaacagtacaatattccgagggaaaaaagaatttacatctttgatcgtgcagaatttagattgtgtcaatttagactattctaccacatccataacatcaattggagaaaaacaagaaagattaacaccgctatgttcgatgggtacagattttctcactatattgattggtctgccccaaccataaaagaagtatactagtataactctattttacagtgaagattgcatgaaaacctcggctagttcgtaaaattttatcttgtatctgttcatggattttgggaagcacataagcacatataaagttggcttgcaaattgcacaagaattacatttgggagtttccgtgccgcgatcatttccttcagttcttggacagaaggtgacttttatacctaaccagatcaactttgcatgcatttgtaggatgttgttccaagtataattaagtccaaaaatagcttgaagaaacagttggagaaaatagaaactcccaacgctgaagcacagaagattgttgacctgccaaacttgataagcaataaaaaaatgacaaccatagacccgatgcttttgccctatatatatcgattccattgcagatccaccacgctaggtaatccgatgaagtatgaaacgtcggcagagaaaaaatgtgatcaatgacgatgacaacccaagtcccgctgttcataaatgttattatgaattggcatccatggtatctgtggatctggaaagataactctcgcacaacatgtttgtgtcggatgcagaaaaagtccgctatttcgaacttgttacgtgggttaatgtttccaagaattttcatatagataccattttcacttagatgattgagcaagctacagggcaatcatgtcgtcggttgccctcagtatacgagactaactgccctaaaaaggatattgaagaaagccctggatcataacttgctaaattctactttccaaattaaattaatacaacactaaattaaaaattgacgataattacggcatcatagtattaactttgaattctacaaatattaatttttggtaaatgacaattaaagggtccatgctatttttattttgcatgttttatttaacacaaacttgaaatacaatttacgatcatcataatacgattttagcagccatactttttttagttattataagatcatcaagataatgtccagttaatattggtatgggtacttagctgacacaaaataagttgtgaatcaacataatgtaagcatctccaaccattaatgtgtaggatagaacacaagtaaccaaggcatattgactatccatggtacatccggaaaataaaaaactttgcccggtatatgagatctattttttaaaaaataaaaacagagaagacaatggagaatgctaattggaaggaatcaatataatatggcccaagcagcatggaattcaaggattaagtgtgttggggattatttcattcctaggtaatatttttagaattatataaattgtgtaacatgacaccaaatgtacatgtgcaatgactaaaattccccaaaactatatggctgcaaagcacctcaaaaaaagcctaaacccccaaatgggcaaaaggtggggcaaacccattctcaaccgctccacactaccacattttccttcctcaagctcccgcctcgtccctacaggtcttcgatcaaggttgagctctctccttgtctcccatggagggagcacttgccatgttcgctgagataatattttgtcccaacaaactgtatgttctttcattaaaaacacaaaaatgtatcggcaatatgaggcacttgcaccacataaatgctttaatcatgtctgttatgggtggttgcattccaaatatagcttacatgtggttggtcacctaaaaccagcacgatgcaaaaaaagataggaaaaacgtgtctgcctcgttaggacaacaaatatcacgggaaaagattcatcttctggcataagatcctgtgggaaaattaaagttttactaagtttcatgtttcaactatttcatatggtattgtaggctgaatcgacaaaaaaatcattttcctcgcacttaagatttttcttgtgttgaacatagatcttttttttaatttatccactcagatcttgtttttctagttgctcattttctagataggaatttcatcg

SEQ ID NO: 23823 - DNA, 11311 bp, Oryza sativa
  unsure (1)..(11311): unsure at all n locations
tactcaaagtagaaatacaactcatattcccaataggactctattgctgaatttccaaaccaatctacaatttccaaattgtaaatatctcttccatataccgcagctgcagataatcctctatgcatatgctgcatgatacagtaccatcgctacagtacatcaagcactgtagaaaccatataatcctcaacagttttccttccgttttccttcacgaacaccaacgcttaatgtagaaacacctcgtgaagcccgttgcaaagatctctcccacacggtgtccatccactatgtgccatctcatatccaacttcgtcacccattatcactgaccgtttgcacctcaactgctcccttgtctagtcccgatcccacgttgaccgaagttgacctccaaaaatcctaactctagtcgctttctcacatggtatcccaaccgcactggacatctgctcctccctgagcatagtctcgatcctcaccattaaccaagactgaccataagttacctacacactatcagacaacacgaattgactcgcattagccaacttgcgcttcttgctttccatcttcggtgcttgtcctccaagcggatcgccttgtcgactagtttttggaagtcttcgtagtcaccagagatgagatggattgacaattcatcattcaacccttcaagatatttctcttgcttctcttcatcggtgcgaacgtcctcgggagcatagcgggccaacctattgaactcgtgcaaaaattcagtgacggtcctgccatcttgcttgagttcacggaattctttcttcctcagggctaaaactccagcaggtacgtgagctctgcgaaaagcaatagagaaacgagcccaagtaataacttgtccagctggttgggtggcctggaagtggtcccaccactcggaagcagtgccatgcagttggtgagcggcaaaagcgactttctcctcatcagtacactagataaggtccaacttcttgttaaccgcgtgcagccagtcatttgcttcgacggggttggttgtgtttgaaatagtgggaggccggacttggagaaattccgacagctttgattgtggtggagcgtgtatgggagcttgagcagcaggtgcttgcgggttttgcatttggtggagcaaagctgcgatgagatggttttgattggcgagcacttgtgctaagttggggtgatcatggattggtggaggtggcggtggtggtgcgtggccttggttctgattctggttctggttcttgttctgattctgattctgagctgagttcccagcacgagcattgttagtagcaatactccttgtgtttaccatctgtagtaaccaagatgagaggaaaagaaagaagggagatattaggacaagaacacgagctattaaaccaacttatttaaattttattgatgtgatgttggttacatagagttcaagttgcttaagcaccacaaaggtacagctatatcacaacgggtcgatatagtccataccaaaaagcacacaaggcaacaaactcaagtagaagataaatgataaaaatagacgcgtactaagactacgcgtctactcgtcctttgttgcgttgtcgtccactgtcggctctgactcatcatcaccgtcataggagttgtcgttggagtcatcttcattggcaagagccacagtcaatccccttcgctccaagtagttctggacaatcaccctggctgacgcttgagcatcgtgcaccatcggaggaaggccatctcgcttgcgtgtcgtgatcttcaaggacggtccaacacggcaacgcttagaccccacaacagagcttccttctccaacctgaccatgtccgagctcgaggttacgcaattcccgcttcaggctagccatctccaacttcacacacaggttcttcctccttagccgtagaatcctactagaagcttgaataaaacctctcttcgccatcttgtagtagtcgacacgagcatcatcatacgcctgcaccatcttggccaggtgatcgatcgtggtgtcgttctcgtgctcggcatccctgaaggtggcatagtcctccgccaaactgcgagtaggatgatagcggaatggagtgtgttgcagacgtgtccagtgtcgttgaagcagcctgccaatgcccagaagcaccacttcttggcatgcgtcgatgaaggtgtcagtccctcccgttagctccaatgattccaagctagggttggtggagagcaaggtggccttgactgaccatcggggggatgccaactctttttctccttcgtctggcacagtggtaccaacaaactggacttcttcggtgtagcccagctcaacgatcaagtggcgaagctgcagaactaaccccttaagtgagacgccattgtaggggccaaggctggtcatctatttttcaaaaaaacagaacaaagaattagtaaacaattttgcaaagcaagagagggtgaagatagaataaaaaaagtttccacaattaaagaactattttctaaaaaaaaaatatcatcctaaggcttagaccacttgctcatcctacggtcaaggtggctctgataccaacttgtcacgcccggaaatatacaccatttccaaacgctcagtgcattaatcctcgtcccagaaggcgaggtacacatagacattgttgattattacaagccacacttgcggaaatgtaaagcaagtactttattacatgggcgacttaggccctcacactcaaagataaacaaataaaacagcggaagactacagaacaggcacttgatggcggagcgaactagagatccaagccttcatcttcctcaggtccatcctctggattatttttgtgagcaagactgagtaccaccaccgtactcagcaagtcacaccggaaatgcaacaataatgcatagggtaaacaaggaaatggcctaatagggtttattttgcataaagccatagtttaaacattttaatcaggttaaagctcattctaaaacacgatcctgttctaagccaatattttcatatcatcaaggtcgcatgagcctgcgaacctgtcttaacccaggctaatctccacatgactacaccatcatgatttcaccctcccaaggttttataaaacaaaactaactttgggtacattgctcagcttgcccataaccgagggcgcggctattcgaataatttttaactctgatcagaggtgtacaactttacccacaagacacaacctcaacacacgttaccacgcaccgggtactatcacagtactcgaatagaggtcgtgacaagactatccatctaggtctacccaaaacaggagaacccgctgaggtttcgccgcccgccggtccccgacaaggtaaaggatgccggatcccccaggacgagacaggtccccccttgcaccgagtgaaaattggccttaatccaggccccacacgcttccaaccaatggtctttgttttgagaagatctaaacttctagtcaggccttacccactagacttgtggttgcacgaagatgccttgcaacagaggcccgaagaccggtccttatattagccggggtgtgactaccaaaataacctgcttgcaccccaagcccagcccaaaaatatgttttagttgtacaaagcattttatcacccatctattgacaaaccagtcaatagtccataactaatccagttttagttgttaaccaccatagtctagtttatccaaaagttctacttcctccgtttcacaatgtaagactttctagcattgcccacgtttatttagatgttaatgaatttagacatatgtatgtgtgtagattcattaacatctatatgtatgtgggcaatgctagaaagacatacattgtgaaacggagggagtaggttggaactaagcatgactaagcatttacctaaaacaactagttagtccatcatgtaggatactagactagtcaagttataattttactagggttcacaatgatcatggatatcaaatcaacatcatggccataacaaagagcataggaataactaataaaacaatattaataatgaacggtataatctataaagcaatgcaatataagtaaaaccacataattttcacaatatgggattcaacatgttcaaggtagatatgacttgccttcgctcacaaagtcttcggcgtcaacggcgatgaagagctgatcttccggaacagcgggatctacacgaccacacgaagaaatataaaaaggctaataaaaaccacatgaacagaagcgacaaagcacataaatgggttctactcatttttaaggggaaactagagatttgaacgggtcgattctgagttcaaacggtcaagatatggccatttgaagtttagttgttatttaaatggaaatttacaattttgtgaattatttttctaaaggaaaacttgaattattgagagagagcgcacgcggaccggtccacgagcgggtcccacttgccagccgctcgatccaccgtgagccgagcacaccgagggcggctcacggcacaccgacgcacaggcacgacagcaaccgagccaggcggctcgccggcgacggccaacggcgcggcggcggtgcgacggactacaggaaagggaaaaacgaaaagaggaggaggtgacggttctcaccgagcagacacggcggcgagaggtcgacggtgttgctggcggcgagggagaaacgacgaggaacttcgggttgtcggcgtcgtcgtcgttcccgcggtcctcgtgctcgacggaggggtggacggggaagaggaggaagcgaagaagcggatggtggcgacgccgggctccgacgaggtccggaccaccggcgaggggcgaccggagctgtgacggcggcggcacaagaagagagcggcgcggcggccgcgaagagaggagggacagagcggcggtgtgtggggagggaggagggagtcgagggtcccttttataggccagaggggagggataagggtgccggggagggagatcgacgccggccatggtggagctcaccattgatgaacaccatcaaaatccaccgcaaataatgcgggatcgagtgtgaaattatgggggaattggacaggatgaggtggaaattaattcccctcaattaatttgatgaaacggcgagtggaggaggcgaatctgaggttgccgtcggtaggaattcggccggagagagagaggatggctggaggttagggatgacgggtgggacccacctgtcatcgagagggagcacacctgtctctgactgggcgcgcgaaggaggaatgatggacttagtccgagggagaaggaatgagctgggctggcccaaggagagggagggggaggggggaataagttcaccttgggctgggccaagagagggagagatgggctggaagcagcccaagaggaggaaggggttttcttttagcttttcctttttataaaattcctttaattgtttttgttgccttaaaattatttaggatgctctgaaaattcaagtaaaaattggttacacattttgaagcatggggaacttattaaaaatacccactagccaacttgacataaatcttggtgaattttaattgttggaggctcttttaggctttttaaatttctagaaatgcattaaagcacaatttaaacttagagcgattttcagggcgttacacaggcccaggaagccaatcccggagcccacgagtcaccctcagcctggcctctcctttcatccgcgtcgctggcccacgctgccgtcgatggggaccgactcagcccacgccctacgctgaggcatagccgccgctgaacttccacaagccgcgcaaggagaaccggtgtcgtccttccttaaattggtgttatgcatcgccctaacactaacctctccctctatagataccgccggtcgtcgccccttttcctccccttttttcctgctatttccactgtcgccgtgccaccgacttcgcctctgcctcctcctaccgacaccgcagctagccagtgcctcggtgcgccgtcgccacagaacgatgttgtcaatgccgttgtgccggagcgtgcccatggagccatggctgctcttcctcctccgttgtgtagctgatctgtgggtcccgcgacaaaaaatccccaaataatcacagccatccaaacccttgattcaatctcaaccattggatctatttaaccctagatccatccctgtcagcgccacatcattgccctgtatcacctcatgtccatacgcatcagctgagtccacatacaccgagtccaccatactccataacactgtcagtgggccccacacatattttcttgtcagaaaanaatcaatccccgaaattaagtatccaaagaatattcccggaatattacttttttcttttaccctcagattttctctgaattcaaacttctgaaggctataaattttccattcgaactctgattcaatccattcttccaccttaagtcctctaaaatcgagctctacgtcctggtttaatttgttgtttcattttatgttctttagttagatttttcttttgtttatttgtttttcgtttgcgatcgtatagacattggagcagaagagcagtttgtttcagaagatgtcgtgcaagactgggatcaacgcaagtgcactctttgaacatattgatcccatttttatcaattgttttgttttgaatacatgcattattttatttacgaactaatgatgggtagcgtaacctaattttcattatatcctaccttgataacttttgattacccatgataccttgtcaccctagtctttgtgagttgaacattaggctcaacaggatgcaatgtcgtacaccccgtaaaatagtgaatgctgtacaattggaaactttttttttcttgttgtgcattagcttaaattgattaacgtaaattattattactccgttatgctctatagatagtagcaatatgaaataactgcatacatatatttgtattaactactcaattatagttgtctcatttatttctttcagaggataccatgaaatgcaaccctacaaaagcatagtgctaccaatgatatatatgtttgggcttcaaggatagaaactatatcaaggcggcaatatattactatttattcgctcttacagttttataacatcggattgggaaaaccatttcatgaaaaaaagtttcctgcacatggagaccaaggtgttgccctcaagtatattaggaacccaaccgccgctttattggatttaggagttggttccattgtgcaacatgtgtgctagtaggggtgaaaacggtacggaaaccatctttatcgttttcgtttcaattttttttcggaatcggaaacgctggatacaaaaacggaatcgaatattatcgaaaccgaaaacagagtgaaaacgaaccggcgcgaatacggtaacgaaaatttattagaatacaaaaacccatcaaactgataaattcaattctcaagtctcaacggtcaacaatttattataaaacacaatcatataagtccaattgttaagtctcaacagtacatcacaaaacacaaatctatggaataaattatctatatttaagagagtaatgttgttgataaatcccaatgcagaaaaaatatattcttatgtaacttcaaatttgcataacaaatattttttttaaaaaaataaaagccaaacaccgtggtagatttgcataacaaatatttttttttaaataaaaaagccaaacaccatggtattcactattcagtgctaaaaaaaatccagggtattccgagaaaatttccagaaagtttccgactgattccacgttccgacaaaactgcccttatcattttcgattctgtttctgagaaaatatttccgaattcgtttccatttccgaaaaaattccaaccaacagattccgttttggaaataagtccggaatccggaaagtttccgtaccgttttcacccctatgtgctagtggcgtcttgtgcttgcttaggttgatttctgacctggtcatatcttatttcatattctgtaaattgctagcatgcaaatatatttcgagcatggggagcagctctccaacccctgggaaaaccggttgatgcaattaagtgaagttacatgcttttagactcaagtcttaaacagtatggtgatgttatgaggttgtgtctttttaataagaaatgttatgtcagtttacaatataatcgcataaattgatatggatctgcactccaagacgctgtttgtgctaaaatacttaattaatataataaaatcatagtacttttgtacatatagaaacagcagaatagaagaaaatttctcataaatattagccatataaatttcagctctttccagtgggaatatacaagagtgcagtatatcggagatattaaagaggaccatagaatgctcgcaccacagcgattctgcggtttttcggctggcgtgttcgcttcccgtgatgtccacgctgggcgctggagctggcaatcttgcaaaaaagtccttgattaacttgataatcattcttaagtccctcactgtatgtttctgtattttgtattcttttgtaaaagccctcaatgtcttggtatatcctacgtgaaggagacgaaattccaaatataggaccgcgctctgaaaaaaggaaagtaagggtgttttctgcaaaacagaacatccctatcccctccattcccctcaaaccctagccaccactgttcacccaccccttctcttcctttccccgctcttgcgccgccgccgccttgccttccctccccggcttctcctcgccaacgacaacttgctcctcgcgctctcccctatcctccccttctcctggtgctccctccatcactctcctcccagtggagcaaggggactgggggactcgatggtgcaggattggatttgggtgcggtgatggagtttcgccgacgacagcctccccctcgagctctcccctgttctcccccatctcctggcactcccccaccgctctcctcccagcaagcagagggagcggacggcgtggcactagatccgcggcacggtgatggagttcgatagtaaggagggtcaatctgttgcctcaccccttgacccattggggaagtcgttctgatgtgtgcaagggaaaaaaagaagaagaaatccccttcatgttggatctatgcatgactgatctgcttcccgttctgtgtctaccacctgccagccatgttttttctcagatgagtgcaaacctttcctctattcttgcttagccatggtcatgagctgcttttgacttattgccacaatcttagccgcttgccatctatatatctatatatatataatggggggaggtcagagattaatggtatggcccgtgcaaatatctaccaagattcatacacctacatgcgctgcttagggactctgcatttttcttggtagaacttgaaatcttggtacatatatagatggcaaatcttttcctgtagaactgcaaatgttttttaattaaaattgatacccccatatatttcttgatcactgcctgcgaacctctgtaactattagattcagctataacatgggattctaagtagtgaataagctggttatatttgcatatttaaatccgatttttaggtgccatctatctatttgttgtagttctctacagaatcaaatgcaaaatctgaatgttcataaccactttataatttaggccagtttgaggttgcgtcattgtgtgccatgccgtcgagcacctacacacctgctctttttaggttgaatgtgctttgtgtttctatggttcatcctatgaaatgatttattctctgaaaagttattgttatgcatggactacttttgttccagcatgatgacccttcttgggggtggatcgacagcttgagtaaccatggctgtaaaagttcaagcggagaaagttgcatggtgaatcaaattatttttctttttctagcattcttatatttgccgtgtaaaatactggcatattcagtagatgtttattatgtgaaatgatggtgaattaagttttcttatgttactcagtgcacatcagccaataaaacctgacatgctcagatttttttccgagctggtataatgttgctttggatgttgggggtccctattgactttgcctggcaaacataaccctgacttgaaaatagtgaaaacattatttgtgacataactcaagttacttattcgggaaaactttattaaatgaaaatgtatgctctagactggattgggtttaagagtaggagtttaattaagtatgcaagaaatggtttatgtgctttcatgcaattatatttaagggacttacaatttcatagttgctgttgatttaaatccaaaaaacttcttgcctaggagacacaacttactcttttttgctgagccatttattttgcatcttcctagctctgttaaaattaccgtcctcatcggctaatgaaaaagcagattaatgtacattacagttgtgtttctatgtacaagaaggtgaaagattgttaaaatctatgtttttctcttcagtttgccttctactctaggtgatactttgaagtgttggtcaatagataagtggaatcttttttcaaaaaagagaaaaaatgcaatctaattataaatatgaatatcaaatatgataattgattttgtcttatctgtataaaaaggattggttgctgccatagaaggtgctcaagtttgtcaatactgtgggtgctggttagcttgatgctctgtcggccgtgcggcaccaccactgtttaacgattccagatctggtgatattggaaccatgtgttgtcgccttgcccagggtccatttgtagtttgcttctcatggtcacttttggtgagttaagccacaacccgttcctttctacactcacttatgtatgcttggcatgtatcttccatttcctgcctccagttccctcgctagctttgctttttcatacaccattattcccttacaaatgatagtctacctttttttttaatcaggaatgctacagtatttctgatttgtactgcatatctttttctttggttgtgtttgtatatagttccaacaaccannnnnnnnnnnnnnnnnnnnnnnnnnnnnnnnnnnnnnnnnnnnnnnnnnnnnnnnnnnnnnnnnnnnnnnnnn

SEQ ID NO: 23824 - DNA, 929 bp, Oryza sativa
  unsure (1)..(929): unsure at all n locations
tttgctttaattctcttctagcaagatcacttgtacacaggatcactcctagcagtgcagtggttggcctgtagacgtgcgcatctcaaactagttttcttccagcaacaacccgcgatgttgttgggaatagtccaacattgctaatctagggggagttgaaccaacttaaaagtaaaagtgggggaagcccttcacctcttgagctagcttttggggtgtagcgaggctttctaccagttggttttgggccaacaaaagatagtgttgttgtggagaaattgtttagtgcagttcccgacaagtttcttcacattgttggcaccatcgagcaatggggtgatgtgtcgaagatgtccgtggcggaggcaatcgggcgcttgagggcgttcgaggaatccttgaagggtcggcgccgcgaaccggaggttgagtatttgttgctcacacgtgcacaatgggagaatctctatatcaaggagaagaaaggagaagacggcagcgactccaacagtagcgagcgcaaggttgataggaagaaggtaaagtgctacaactatggcatacatggtcattatgctaacgaatgtcgcaaaccgaagaaagaagaagcgctgctcgctaccgcggacgacgagccaacgctcctgtgaagattgtttactaggtattccaaaataaagacaacaagattaggggggcaattgttagcactaatcttgttgnctttattttggaatacctagtatacaatcttcacaggagcgttggctcgtcgtccgcggttgcgagcagcgcttcttctttcttcggtttgcgacattcgttagcataatgaccatgtatgccatagttgttgcactttaccttcttcctatcaaccttgcgctcgctactgttggagtcgctgccgcctctcctttcttctc

SEQ ID NO: 23825 - DNA, 55806 bp, Oryza sativa
  unsure (1)..(55806): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctccttcttcttctccgcttctagtagacttctagtagtagtaaacttggcgtcgcgatctccgcgcgctccgggtgcttcgcttcggaggtttgggaggatggcggaggcgtgaggtgaggtgagggagtgtgagatcgcgggggggcaatgtcggtgctgggcgcggagggggcggcgatgggcttcctcccggccgcggagcacggcttcgcgcgctcggcggcgccgtcgccgctgcgggaggaggaggaggtgctcgacgacgacccgaagctgccgccgttgcggatgcccacctccttcgccgcgttccctgggtccagctccggctccgactccgactccttcctcagcatgagctccacgccatcaggtaaattttgcttcatcaatgcgtgcgaacagtacaaaatctcctccagagagaggaagcgtgtgcctggggcagtatgatctcgatctctccgcgcgtgattgggagacgcgccgcctcaaattgtctgttttttttttgctcgaattctggtccaaaatttgtcaatctgtttggtggtggtggttgctgtttttgggttgatgtcagggctgatgaatccgtacggcgtgtggtcgccgcgcgcgccgccgtcggaggcgtcgtcgtcggagatggagttcggcaccgcgcgcgagtacgacaccaccgatctcttcttcggcgagaattggctctacgacgaccacctcttccacaccaattcggacggcgacgagggcaatggagaggacaagttcatcgttggcgctgactctaccgcccagtggagcgaaacgcgtgagctcgacgattgcggcggccgccaccaagtgcacacgaaatccaaggccgacgctgaagcctgcgcggaagtgtatacctgctcttcagcgccctgcagctgctgctacggagggaggaagaatgatgatgggttgacgagggattcttgctctgctgtctatgggaggtacctgatcatggatgaccagacagaggtgctggatgagtgtggtgcagatgcattcctgttcacacgggatggagatgccatgctcaaaagtgaacagccaattgattccaaaggcggagatatcgagttgctggacatgagtacggtggagaaggagcttcagatgctcagtccgtatttggctgaggcagatgctcttgagagtgagtattttctgacttgtcctcttaattatgttcaatcttgcagttcacgaaatccttgaagctcattaattttgttgttgtactggatccagaatactcagttcatttctcagaatttatttcacttatccttgcaaagttttgttttcttgtggactagttggttttaattgtggttatctcttgcagaggctgagcttgaacacgatttcagcggcaatggggaactagatattaacgttgttacaaacgagaaaactgccgatgacaaagaacttctaaaaaatagttacagcatacattctttacctgagataggtgatcctctagatgtttatgagatggaggactttggacgaacagatacaagtgttcaaaattctacagccaataaaatcgctgaagatgcgagaacagatattgatcttgcactttctagatttcatgaggaatatgaggtatttgagctgagaattttccaccggaagaacaggttcgtcatcagatgctttcttttttttgtttattcttccgccatcatgtaaatatactttccatgctcatgtcataagtgttctttgcaggactggttttgaggaaaacaaagagttccctattgtcatgaattcagttgtaggtggaagatatcgcatcactgagtatcttggctcagctgcattcagcaaggttgtacgggcacaggatctttggacgggaatggatgtctgcctgaaaataataaaaaatgacaaggatttctttgaccagagcttggacgagataaagctccttaaatttgtaaacaaatacgatcctgatgatgaacatcatatattgcgcctttacgattttttctactatcaggtatgtgatgtaaagataaaatgaacacaatcttttggtgtgctttactcaatctcattttgtaccctgtggaatgctgtcatccaaaaaaatgacaggaacatcttttcattgtcactgaattgctacgggcgaatctgtatgaatttcaaaaatataaccaagagtctggtgatgaagtgtacttctcattgcgcagaatacaggtatgcctgactgttattcccttttccctgagagtatctccggttgtgttgttatgaaagcttgtaaccatcattttgtctgttaattttatgaagccttcattactaaagaaatcatggaacgatgcaaaagtgtttacttctgttgttgcaatacacttcagttgtaaagaaatttctcttaagaaaaacagttgtagagaaagatctcttcatccattgatcttccatgattaatatttctctgacattctgttttatggaaggttaaaataaatacttctagcatgattaagttatgctgtaaaaacataaaaaatcctgctgaaatatgatatgttgttgtttttcaggctatagctcgacaatgcttagaagctctggtgtatttgcatcatttaaatatcgttcactgtgaccttaaaccagagaatatcctcatgaagagttacagcagatgtgaaattaaggttattgatcttggaagtagttgcttcttgacagacaacttaagcttatatgtccagtcacgttcttacagagctcctgaagtcattctaggtcttccatatgatcagaagattgacatttggtctctcggatgcatcttggctgaactgtacactggtgaagtaagttttcaactattcatctttacttactaatgtccatttgtcggtactatattacattgtcacgacatgcttacattttgtctagggaaattgatgtatttactcagtcgaaggaaaagaaaagtacaaaccaggatttgtccatggttaaatgaattattgtgccttttaactcatcccgcaattgctgcagtcaaggttttgattgtgggcttgtggctaatgttctttcttgtataactattcagttcatcccaagaaaattaccacctcctcaattgtcatagtcttgaaatattggtagaaccttcattgttatcgcaacactgttattaattttaagaaactgtatgcagaaattggaagagtgattcaagtgcttatggcttatctgcagaacatttaccaaatttaagaaatgatctattagtaactgtaaatataccggggaatccccatcatgtttctttttatctagttccaattgaagatattgtatttagtatttaccacttttgttaaaagtacttgaaacataaaaattgttttgtaactgtaaaccaaataagccaatgctctcttttttttttctcacagagacaatgtgattgagatctttcttatacatgtggcaggtgctctttccaaatgaatcagtacaaataattcttgctcggatgatagggacaattggtccaattgacatggaaatgcttgcactgggacaagatacccagaagtactttacagaagactacgacctgttccacaagaatgaggtacatgctatttcttgtgtactttcttctgtgctggacgtattgtcaatacttaagattaagaaaccaatttaatttaacaaaaccaacgttttttgctactttatgatgcaactcttatttgaaccaataatcagtggatgatatgcaagatttgatctctctttttggatcctctttgtgctacatgctttaaatgttgaataccaccgacaatatcattgacaattaaatctctcttaggaactgcacttagctcatttggtgccatactgccatgttcctccttactactcagttttaaacggttgcattttttttttgtttctgtagaatcttatatcaagtgaagctttactctaaatcttgttatagaaaatattttgagtcgttaagaaatgatagctgacaactaaaactctagtatatgttatattggtggtagaaagtttagtcagaaactgagagccttatgttcctgtcatcttaatgtttctttgcccaaggtcttctgtgattgggcacccagattgtttctgtactttcgtgtggatctggttcccaactcaggcgttttggctgacactgttgtttgttagcgtgatctttagaacaagaatttcagttgttccccgtcactcagtttggtactgttgccagtgttgttcaagcgatgccattaatttcttgtccaacttgttttaggagacggatcagttggagtacttgatcccagagaagatttccttgcggcgtcgcttgcagtgccccgacaccaaatttgttaaatttctttcctacctgttacaaatcaaccccagaaagagaccaacagccagtgaagcattgcagcatccgtggctctcatatgcctatcagtgagatgtcaaccaaatgtgtttatacgggatggatcgtttttctgaagttccatttgcaccaggatttggcttttccgtttttttcagggcagtccttggttagcatcgaaaccctgttttccgagatgaatgcaaacttgctcgtgcatgtaaatatgagaagaagaaaaggttccttgttgcatatatgtatagctgtcactttgatgtacttcacccaactcatcaatagaaatgtgtttcaagtttcaacatacccgggtctatctttggcgtttgctctgaggcacttcacctaattcaagtttcaacggtcaagtgcgatgtcaatgatcttagtttatgatgttgccactaaatcattcattaacagaaaagcagtaacattgaaaatttgaaatccaaacatgtgaaaaaggatggggggcacaaactaactgaaatctgctggaagcctaaataaagaggggatcaaatacaaggcctgacatatgaaaccaaaaaaatgcacgatgtagctccaaaagaccatcttaaggtcacaggtgccactgaatcatcgctgtagaaccttgatcaaaatttacaagccttcaggaactcacagaccattataactgtcagttagattatcagaactgtcagcaacaaaaggtcactatacaacaataaatttacgctcaggatacaaatagtgatctgcgatctccgtgtcgaacaatggcttcgccatacggaagggcctggatgaataacattatatacaagtgttatctccaagagtataggtggcctttgagcctttgcctaataatccaatgccctggtggcaaaacttatgctgcttgatcaatttgtgggatcccatgtctttggaaccactctggcatgtgaaatgtttcatacaatgccggtctaacatcattttgcagagaaaggtgcttgagaagtggaaatataactcccataagctaaaatgtttgagaatgtcagtggatcagtacaccagaaattgtatgttcagaacaaaaaggagagttatctaaattgtaaccttacctgatcatcaacaggttgtccagccgagaatgtaagacaaggtattccattcaatggttgcagcaggaaactatatggattgttatcaacaaggacaattctgtggaaatctttcgacaaacaagaaagatcttttacatgctctctatattccctggaattcagcacacggcagcgtcaaataagtgaaaagctcagctaacgcagcaggtagcacaatttcttaaagaatatgtgtctttgactctttgtgaaatcaagctggtagcaaaaccaggaagacatgaataagttatgatcaacatgatatgtgaattaccaaaaacatcattacaataattcagtttcacataaaacagctatacattagagattccatgggcatgaatcggtgctacctatgggtgggcacttgcaatatttaagtttgtgcttgcaaaaagcctcccactaaaatcaattgaaatcacatctcaatatttcagtgagcaagacaataattcattaaggcactatggaagtcagaagcaaaataatccattatttacaatccacaaaaatgctaacagtaacttacgtggtaacagttgatggcctgtagagacggtgacagaatctgttgtgagcatctatcctgtcaactaatggttttgcatatcctggagagaaaagcacaggttactaaaatgaggtgaattcaattgagttctagttgaggatcaatatgactattcaggtaacagaccttctaaaccagcagtgaagagaataagatcagcaaattcgctagttctctgcaaaaattcgtgcaaaccaggacgctcaaatacagtaacacggttcaccctctgacttccctcagcatcctttatatcaaggaaaatacaaactctgataagcaacttcctggattttagcagaatatcaataagaaaaggatggcagcttacttgccttttcagcggatatgcactccatgtcaaagcaatgcagtcctgcttcaacagcctcggcacgaagagcagcaggaagacttgatgactcatatgcacaaactagagtttcatccaaatcaagcactacctggagtcgagcaatcccaattatatgattgtaagttacacaggtggatgataagtttattaaaaggggattagggaaatcagtcgatgtagaggataagttcattagaggggattatggaaatcagtcgagtaatcccaaatatacgattagggaaaagataggttcattatgtccttgttcggttaatccctcctcgaggccttgttcgtttaaggattaattccacactcccttaatcccctctaatcccttttctcctcaagaggatcgaattaataccgatattaaccgaacaagacctaaagggaatcgatatgaacacaacaaagatagatagaaactaggtctaatacgctgtcaatggcgactcaatatcagtataattaacctgctatgtgtgaaatgaccacaaattagcaatagtagtttgtacgatcactcaacagtcaacagcaagaaagtgaacacaatacacacagctcgctccaaagatgcaggaatgaactaacacacatctcggtccgtaccgtgagccgcctgagcggcggcggcggccccgtcgacgacgcgtcggcgggagcctcggaggggagccgcacgaaggcgaccgacggcgacggcgacggcgacggctggggcggcgcggcggagaggagagggtggcggagcccgaggaaggagaggaggtgcgcccaggaggaaggcgtgccgcggacgatctggagcaggatctggaggaggaacccgagccaccccaccaccgcccgccacgccgcctcccccggatgctgctgctgccgcaccggccccacccccgccgccgccgccgcctccggcgacaagaactcggccgccgccatctcccccccgcgccggaccacggggctgggcttgctggctcccggagtgcggctgcctgggcggctagggggagagctcggggaggaggagagcaatcatagggtagggagaaggagaggaagaggagggaggagtagggcaggtggccgacggagtgtgggagtggatgtcgtcggtctttgccctgcgtcgtcgtcggacacgagggagggcttcggcttccctcggataaacggtggaattcggtgacaggctgacatgacagcccagccgagattatacaaatcagctgttagacatgttcttttctgcaacgaaaacggtataaaaggacctctttttaaactgctaaacgatgtgtttcgtgtgaaaactttttatatgaaagttattctaaaatataagattaatctattttttaagtttataataattaaaatttaattaatcacgtattattatcatctcgttttacgttaaacacttaatctttattttcatcttcgttcttcaggagatatcaaacaccaccttagtctcaaatctgcattcgcaaaggaataatctttcttttctttaaaaaaacggaaggaataatcacctcataaactcacttcattgggaagtactccctaacagtgaatcaaattagtttcacagtatactttcatattatggcctattcactttgatgaaaaaaaccctaaccaaattttgccaaaattttggcaagttgtcaaggcagaattttttatatagttattaaaatttggcagcaaactaaatgttgccactttttttggtaattttaccaaaatttggtagggttgaaaatgaccctatatttgttttgcgataaaaatattactatattttttaaaaaataacttgattatatttatgtaagtttaacttagaaaaaaaaataaaacgatttataatataataaaacggagtactcaatcacccatatgcactcaatctagattaaacctcggatctcaatgcaaattatacggatgatgagctgtggtgttgccattttttttccagaaaactacctacacctgaactggtaatatactcactacatccatttcaacataaagaatttcttaatcatataattaattatacggacaaaattcattacattttggggacggagccgtgcacgtaaccactcgctccaatttatcttctcacgtccaggtcccagccctttggtcgcgcgagaaaacggaacaatgctgctgtgtgcagcctgcagccaaccaaccaggcacgacacgtggtgcggatcgcgaccgaagcctcacaaaacgcggttcatagccaccgtgccaccgcccaccgctgcccagcaccgtcccaagtacaatgaacgatttttttcaaagaaataatgcagctttaataaaaaaatgaaaatagatatcgatcatctaaaatcataaatttaatacctcgtcaaataaccattgtttaataagttttaaaaacttaaaaacttgagatgtgagtatggctgagtttagttccaaactttttcttcaaaattcgaatttttccatcacatcaaaactttcatacacacataaacttttaactttttcatcacatcattctaattttaaccaaactttcaattttggtgttaactaaacacaccctacatgcatatgagtaggtcgtgggacctatcgaactttggagcttcaatagaccacccatgcttgctactcctatttctttttcttaatcaagctagttaacctatggaatagcctgtcgaacaatgattatcgaacttcagttgtttgagagggtgttaaatttatgatttttatctatcaacatatatttatacattttttcactagagttctattattttttaaaaaattctcaacaaacactcggtctaaattatcccgtcacattacatcacaccacgtcacagtcaactcactaaaatgcagcagcaggagtagcagcgaccgatccaaaccccagccctcgcgccgacggtccgagccgtctcgatcaccacgcagctcatcatcccctgcgccgaagggaacagatcagagccagccgagccagcgcggcgcggtcgcctttgccctgccctgcactgaccgttggagagccaagcaacccaacccaagcgctcttctcttctcctcctcttcctcccaaatcgatcgggatccgatgcgcacggaggaggaaggagcatggtgaggacgcccgagaggagctactcctgctcctccgccaaggaagtcgcctacaggttggttcgcttcgatccccttcccccttctttttccgctgcttggatcaagaacacgggttctaggagaggctaggataggcgaaaccctgggttgaatcattcgtcttgattagtgtacttagaagagtgtttcttgggttgttcaagagtgcagttataaattcgatctgtttgcagctgctgggctcggatggatcttgaaatttcttttaattggttttgactgttagtgattggtgtgcttgctaatggctcaaactggactgatcagaaagcgcaccaacttcgatcagctggactgaaaactgaattagtggcacttttacttcttgtgacagatcatggtcttttgttcaatagaaggaattgaatgtgacattacgtttggcttgctgaaaagtgaaaattacatcctcatacctgaatcgacagtttgacactaacaactctcctatgaaacttaatttttaggattttgattgcgtattgaacacggaattgtcattttcgtgaaaattgtgaaaattttcttttcgtggaaagtggaaacggtagcatggtgatatcagttgtgagaaaggattcagggtcaattctcatggtgtgtgcaactgtatacacgtcttccatgtaatggaaaaaaattatctgatggtgtgtgctattctaacagctgtggttactgtggctatgcattgaacctgagctcctcaacacggaacacagcgaacattggatccaagtatggtaagcagatcaggaaaggtgtaatctcattctttgcgatcgacgagagtcggttcacacaaactgatgaggtgagctgcatgccatacttccattcaaggcgctcctggggtttgttcagaaagaggacaaggttgatctgccgcaaatgtggtggccgtatcggtaatgcttatgaggatgaggattccacattgtatgatggttcagatgatttgcacatgagctccgagggctacagcatgtcgagtggaaagaaatatgttatcaagattaatgcactgcagccttcaaccgatgactctggtgttcccttcaccctgtgatgctgttctgaacttctgcagtatgcacttttcgattcttgccttgcgctatactggactgtcaatcaagtaactgcagaaccaagagattacgtgctagtgtgtaactgtatattttgataggaatgctgaattttgcctacctgtatttataaaatggaagagtttgttgtctatttacatatacattcagagttcagtgggtgtgcaactgtgcatcatggacctggatttggcaatccatatttgggcaaatgtttagttagaaatcaggtttctgatgatgttcagtggtgtgtacttgtgtcttgtactgaaatattgtagtgtcttttgattttttgtgtatctaaagaatgatgtaaatcttcagctattctaaacggcagtttttttttgtttgtgttttgaagctatgccaattaatttctgccactaatgttgatatgatttgaagtgaattcctgtgactctgagcaatgctatgccattttcagaaattgcaattgtgagtaatgtgcaagagccaactgccaagtgcagaaactcattgttaaaattttcctgcggagaaatctattgaatctaaagctcagatgaattttcctgaaactatccagatttcaggctaattcagttgcaagaattaactgaaactaaagcacagatgaatttgctgagggaatacaaatgcaactgcagtaacagaaataactaaagcacagatgaatttggctactgcagtaacagaaatataaagtccaaaatattaaacgaattggatctatcgtcaaattaaagcaactcagacaccgcttgatattctgcaaatccgctgttcttagtattggtcagcgatggtcaaatcaatatatagcacatttcaagatgtatcagcccaatatgcaatgtagatttcaaccagaaacctatatcgaactcagcctaagttcaccaaatcgcactaaccaaaacaaaatttcatcccaaaacggacaaacacaaattgcacatcaacaagaggacagatccacaacattggctctgaaacatgtttcaattcaaatcccagttgcaaacatcatttgcttcacaatttcatgattcaggtaaacactagaaaaactaaacagcgaactgaacaaggtggattccacggctttccatcaaactttttttcttgaccgcaagacttgtgggcacggccagacgacatgggagagatggcggagggaggcaagatcgatcagccgccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatcagcccggagatgcgcttcacgccgcccctccttgccagcctccggatcgccggcttggtgatcccctggatgttgtcgcggagcaccttccggtgacgcttggcgccgcccttgccgagccccttgcctcccttgccgcgccccgacatggccgccgacgacgacgattccggtggctcgacgcacgagagagagagaaaagcgagtggaattggagaagaggtggtggtgattggagtgggatttggggaagaaaggggagggggttttaaaaggggacgagaggatggagtggggaggcggctgccgttggatgggggagggaatggacggtgaggatctggatcgcggggggaggagcggatcgttgacgtggcgtgaggcgcggatcggtgatttggcgggatagtgggaattttcgtggtctgagaggcggccagctcaaaattttgacctgcaggcgccgccaaatttggcctgcggcgcggccatgggactatgggagtagggacttggcgtttggcctttgagagatttttttcactgtttagtgtttacgaatttccaagggtcagtttttttcttaaaagtcaaagctgattttgaaatttgaaatttaatttttaaaagtgattttagatagatctgtacttgtgattttacagtcatttcaaaataaattgcgcaacaaatgtgacggagaaaccacccaaaattagccctagaaccaattatgagaattcaagatcaattgtagctctttcagtaacacactgggctgcgttctaaaataaggttgagttaggctaatccctcatttatcatgagcatattttccaaactactaaacatatattctataaaaaaatactatatatatataatatcaaataaaattatttttaattttataatagtttatgttagttccgtcctaaaatatacttcatccatttcatattataaaactttctaggattatcctgtctatctagattcgttaacatttatatgaatgtgggcaatgctagaaagtcttataacctgaaacggatgtagtatcatataatatcggatagtatatgtagtattgtatatatggatctcatccggtgttagattactatgttttataatggatgagctactttattaatcatgtgtaatgaataccttgggttccataccagtgactagctaagcccaacccaacagttgtaccaaactcaaccttagaaggttcaatatctacgattgttgacgaaaaatctgcactcgcccaatggtacaggaactgtgttggcgcgaactaagtcgacgaacacaatgacctaggagatctgcttagttctagtgcagacccaaaggttgatgagatgcaggcataccagtcagtttgatcctacagcaagtgataaaatatacaaatagcatatcaatgagccgatcggctgtcaagctgatggagtaatccagccaatgtcgataccagccgatgtcaatagtgtgttgagcaatcggctatatgtctaatgtagataatgatatagagacaatctgtcagggttacgggttaggcataccctttacccttcgatatacgttacatatcggtatggcatacccacgcgcatatggatacttcccgcgtacactaaggaaatccttcacgaagtctacggatgggaagagtcttactcggacaagactgggtcatcaatgtatcgtatagggtctgttatctccgagttctacttggaaaccgcctgacctgcgatataaaagggaccccccggggaggacctgaggcatcgaatctcagagccaacacaaccctcacagcctacgaagtcggagcctgcaaggagccaaatcgccggggatctagtcgaaccaactcgaccacgatctcgccggatccgtcaagttccattgttccctttgtaacctgtgttttctaccatataatcccacatcaactggattagggctattaactaccaaggggcctgaaccagtataatcctcgtcttttgtctgtttgatgtcgtattacgtagattattgtaccaacgtaccccaataccctctatatccggtctacgggtaccacccgtcgacagtggcgcgctaggtagggggccttggtactcaaggttctactactatgtcatccagcctcgtcgacaacagcgtcaacaccaacctcagccaagtattccctgcttcaacaatgctggtgtagactcaagtcggcgaaatcgtcttcccggtttacaccacgacgccgatctcaaccggtccgtcaatgactggaaacgagaacgcagtggctacaaaccaaggtgactccatgtcaaaaaatcctcccgccgaggcggagaacggagcatcgacgacatccgagctcgagaaggattctaatgcggccaaaccttgtcgttccgacatgaaccgcgagccgacgaagatgacttctgaagcgacaaggtcctggtgtcctatccacaaaaccaggaaacacactttgcaagcctgctgggttttcctcaacgtccgcgctgaaattcgcgcctgtaaagagcgtggaattcaacgtatttctccaactcgtgatgtctactgtcctattcacaagacaaagaatcacgacctctcaagctgcaaggtcttttccagcgccatggaagcgccatcccctaaggtccaacaggcacacatccccatcagggataaagacaaggaacgaggagcgatgccaacttcagatcgatttgttggggtaatcaatatcgatcctcacgaactatcagtcttgcaccttcttgaagactatgggtcatcgacaacaagcgcgccgcgggaggtattggctatcgatgatgtcggcatatcagcgtgcaccaatgcagaaacagagaatcaattgaccactccagctcagcacatcagagccgtcaacgctataatgagggaaaccccctacggtcccgttctaaacgacgatctcgcgcgttggacagaatgactacgggaatcagtgaccaacctcagcaacgcgttcgaagaggccgctgccgcagcgcacccagagcagccaccaactggcgatgccaacggtgaaaatcctgaatgaagggaatcgcctcagcgagctacccctcaacctcgcggcactggcgatctccgagatcacatcaacggccgccgagaggcacgacgcacacgagacaatgagaatcgttcccgacgtcatgtctcttcacggcgccatgataacgaagatcgaggagaccgctcaaacgaggaccgagaccgtgataaccgccacaaccaccacgatcacaacgatcacaaacggcgggtgctagacgatactggttgaggacgtcgccataacgacgactatgatggagaccggcaccaagacaacagcgggagacgacgacaggattctcgagatccaggccgacatcctcgtaatcgtacgccagaaccaagcgacccatcgtcatcgtcatcatcctcgtcttcctcatcatcagacagacatccacgaaggacacacgatcgccgacaacccaccgcccccagcgctgggtgtagggctttcagtcgttccctacatgatgtccgatggcctgagagattccgacccagagcaatagagaagtacgatgggagcaccgacccagaagagttccttcaagtctactccacagtactctacgctgccggagcagacgacaacgcattggcgaattatttgccaactgcgttaaaaggctccgcacgttcatggctgatgcatcttccgccctactcaatctcttcgtgggcagacctgtggtagcagttcgtcgccaacttccaaggaacctacaagcgccacgcgatcgaagacgacctacacgcgttgacacagaacccgggtgaatccttgaggaaatatattcggcgcttcaacgagtgcagaaatacaatccttgaaatcaccgacgcttttgtaattcgcgccttcaaatccggtgtcagagatcgctatactacccaggagttggcgacaagacgcatcacaaccactcggagattgttcgagattgttgagcgatgcgcccacgcagatgatgcgctaagacgcaagaacgataagccgaagaccgagggagaaaagaaaccagccacggacgcacctgagtcaagcaagaagaagaatcgcaaaaatgggaaaaggaaagctcaagcggaagtcctcgcagcagaatacgcgaaccctcccaagcgcccagacccacaaagtagcaacacaaagaaagcttggtgccccatacacaagacgaacagacattctttggaagattgccttgttttcaaaaaatcgctcgagaagcacattgcatctgaaaaaggcaaacgagtacgcgtggtcgaaaaggacgcggaggcggctccctaggaatcggactcagcatatccagactctgacctccacgtttcacacatcttcggaggttccacaacatactcctcgaagcgagagtacaagaaagtggaacgcgaagtctgttcgacatggcagggggctgcacccaagatgaagtggtctgaacagaagatagagttctcggaagaagaccaccccaagaccgccgtcattcctggacgatatccgatcgtggtcgaacccactattcggaacatcaaggtcgcacgggtcctcatcgacggtggcagctcaatcaaccttcttttcgccagcactctggacgcgatgggaattccacaaagcaagttgacaccaaccgatcaaccctttcatggaatcactccccaatcctcgtccagaccattgggcaagattacgttgcctgtgactttcggccaagccaacaacttccgaacagagcagatcacctttgatgtcgctgaattcgatacagcttacaacgccatcatcgggagaactgcacttgcaaagtttatggccgcatctcactacgcgtatcaagtgctcaagatgccgggaccgaagcgaataatcactattcaagggaacgcaaagctggaggtgcaatgcgacaaacggagcctcgacatggtcaagcaaacgcccagcccacccgccacaactgagccacccaagaaagtgagcaaaacaaacaagacgccgaaaccggacggcgcaatcaagattgttccactctccagtgccaaccccgacaagaccgtcaagattggggcgacactaaccgagaaataggaactcgcgctcatcaccttcctccgcgacaatgctgacgtgttcgcttggtagccgtccgacatgccaggggtccccagggaggtaattgagcacaaactcatggtgcaacccgatgccaagccagtaaagcaaagactgcggagatttgcaccagaccgaaaacaagccatacgagaagtacttcatccagaatggctagccaatccagtcatggtgcggaaggccaacggaaaatggagaatgtacgtcgacttcaccgacctcaataaggcgtgccccaaggatcacttccctcttcctcgaatagatcaactggtggactcaatagccgtctgtgagctgttgagctttctcgacgcttactctggctactaccaaatcagcatggcaaaagaggacgaagagaagacatcattcatcatgccgttcggggtattttgctatgttaagatgccgttcggattgataaccgcaggaaataccttccaacgcacggtccagggcgcacttagcgatcagctcggcaacaatgtcgaggcatacgtcgacgacatcgtcgtcaagaccaagacatgcgactcattgattgacgatctgtgggaaacgttcgacaacctccgacgatatcgcctcatgctaaatccagagaagtgcacgttcggagtaccatcgggaaagctgctcggtttcctcgtctctggcagaggaatagaagcaaatcccgagaagatcaaggcaatcgagaacatgaagtcacccacaagactcaaggaagtacagaagctaaccggatgcatggcagcattgagcaggttcgtcgctagtatgggagaacgagggcaacctttcttcgctctgctgaagaagcaagacaaatttgtatggacacaggaagccgaagaggcattcgttgcactcaagcgctacctatcaaccccctgtacttgttgccccccaacctaatgaagaattattcctctatattgccgccacgccatattccgttagcaccatcatcgttgtcgagagagagaaagtacaacgaccaatctactacatcagcgaagctctccacgacgcaaagacaagatatccacagatccaaaagcttatttacgcggtcatcatgacatcaaggaagctacgccactactttcaagcccacagagtcacagttgtctcctccttccctctcggtgaagtcgtgagaaacaaagacgttgtcggccgcattgcgaaatgggtgttcgagctgagccagtttgatgtccactttgcgccacgaacagccatcaagtcccaggtactcgccgactttgtagccgattggactatgcctgataacaaatcagacaaccaagtcgacaacgaaacgtggactatggcgttcgatggtgcactcaacagccaaggagcaggggcaggatttatcttgatgtctccctccggagatcaattcaagcacgcaatccacctcaacttcagggcgaccaataacacagccgaatacgagggactactcgccgggataagagctgcagccgcacttggggtcaagcgactaattgtgaaaggggactccgagctagtcgcgaaccaggtgcacaaagattataaatgctctaaccctgagttatccaagtatcttgcagaagtcaggaaactagagaaaaggtttgatgggatcgaagtcagacacgtctaccgcaaagacaacatcgagccagatgacctagcacgacgtgcatccagacgagaaccgctcaagcccggcacttttctggacatcctgacgaagccatcagtgaaagaggttagcggcgaagttagcccggacaccctgtcgcgaccgagaaaaatagattttcccgaatgctagtgtattaatccccgtcccagtaaaagccggggtacaccacacaaacatgatataaaagacacatctttattatatcgataatatttacattattacaaaggcacttaaggcctgacaataaaaaataaacagtagcggactagcgggcctacggctccatcttcacaggcgctcaactggggtataagccaggactccacctaagacttcttctccaaagcttctcttactgaaggggggagggaaagattgagctaagaatgagtataaccacagtactcagcaagccacaccggtagatgcatgattaatgcaagggggtacaaggggtaataatataggggttaagttttgcagtaaacagcatttaaaattcacttagttgcccaaagctattttataaagacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattccatattttagttgttaagtaggttttaagaattaaaacactaacttgggtacattgctaggcttgcccataatcgagggcgcggctattcgaataggttatactttgatcagaggtgtacatctttacccacaagacacatcttcctcacatgtaaccacgtgccacataccaccacggtatacggacggaagacgtgacatagttcccaacccatcctagccataaacaagagtaccgacccaaccccacctacggccggaacctccgggacaggcaggcaggattgagcccatagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcaccttgagcccagcctaaaaccattttgggggttttgaatagaggtggaggtgtgtgtccaattccaacataagccaaccactccatagtgtccaaatgatatgagaattcccaaagtctaaagttataaaaccacctaatgttgcctaattaaccagcgaagcatctacctaagttcatactagtggaaccataaatagagtacccactagttggggttttattttcctagggtgaacaaggtaataataacaatagaaataataataaggtcataacaaaggtaaataggcatggctaaataaaacagtgataacgcaggaatttaaataaagcgataatgcattaatttaaatcaaaataattttataaactgggattcaatatgctcaaggatgatgtgactttccttgctcagagacaacggccttccgaaccttcggcgacgaccacgaaccatgcttcgggaacctccggaacgatagaagctacgcgaagcacacaagcaaagctacaagcctataaagaagcaataacaatacataaaaagaaagcacacagttctttaggttataacaaacattaggagacttgaacggatcgattcggagctcgtatgaccaagacatggtcatccgaagtttaatgctgttatatggagatttgcggattattataattaggttttacaactataaaacatgtgtaagcgctagcctggaaaagacaggaaggctgcgccgttgacatacggaccccacatgtcaacctaaaggaccgcggtagaccgagtatacagagacggtccacgggtcgatggaagcggaccccgtgtgtcaaccgaggcgagtagctgacaaacggactccactagacaccacgcgggccgcacacgtggaaacaacgcggctaccgagcgggcacactaacacggacaccacacacacaagcgaacgattaccaacaccagtacacgggtaccggcgtcgacaaccgcacaacgggtacggggcgacaccgaaaggacgaggacggggcagcgagaggagagatccttaccaccacgcgacgaggcgagggaacgacaacgacgaacgagcgcggcagagacggccgggaacgacggagacgaaaggcgaggggacgacttcggcggtgatccttggacgaaggcgagacgcggccggcgtaacgcttggcgatgcggaggcgaggacgaagacgacgacggggctgcagcggcacacttgacggacgcggacaacggacgagaacggcttgacggagggacgaacgccacgacgaccgggaacgacgagaggacgacgaccggaatcggcgaggaggcgacaagggcagccggcagcggctgcacggagacgaggacggcgtggaacgcgctgctgcgatgaggacgagggtggcggcgcagcgagacgacgtgccgggcgaccgacgggacgtcgacgttgaggacgaacggagacgacgacgacggacagcggaggggttcggatggaggggaggcgaggccgagggagaccttgccgctgcgaggccggaggagatgacgacgcgatcgaccggggaaattccggcgaggaggatggagaggtcggcgcggcacgacggtgttccggcgaaatacgggcgacgccgtggcctggccggggaagaggacggcgttccggtgccgggagaggcagcgacgacgaaagccgacgctccggcaatgcggcacaggcggctggaggtggtacagtggcggcaacgccactgtacaccagcgaggacgcgtctccgatggtccccgtgcgaaacggagggcaggccggcgtagaggggacacctgcgaggccgaggaaggtggtggcgacgtcagccgccgcacgggcgaggcggcacaggcggctggagggtggccggcgccgagggaagagaaggaggaggcggggagaggtggtgcggccacgggggagctcgggaaggggctaaaacgatagaacgcacggagggggttccattttataggtgaggggagggagccgggcatgggagagggcggaacggtgcgggaaacacggccggcggccatggaaggcggccgggaatggcgcggccgttccgggcgattgggagcgccattcaagggggaaaacgggggaaatcaaagaggaatcaatggggattaattccccctatttaattttggaatcccatgattaaatcgcacggatttgagggaggaaaggagctagggttcacgggagagggaggaggccgtgcgggaggaggaagacgaccggcgcgtgggccccacgcggtcagcgcgcgtgaggggtgggcggctcgggaggctggggcggctgggtggcgcggcttgtgccaggcggccggcccaggaggagaagagggagaggcggcctaggggagagagggaggaggagggagctgggccgaggggaaggagaggaggcccaagagaaggagggagaggaagagagggagagaaagagagggaggaagagaggactttggccgcgggccgagagagagagagaggggactttgggccagttggcccaaagggaggaaggagaattatttttagctttttctttttaataaactttgttaattgttgttgttgtttaataaatatttccggtgctctgaaaattcaagtaaaatttgagggctccttttagaccaaggagaatttaacaaaaaattctccgggctacattcgaaattttcttgtatgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcaagaagataggttgggcggtcttctcttcttgtctgacttcttccatcgcgtcttttataacaaacttgcctagcaaaacttctccactctggactgcttggctcgatctcctgttgcagatggaatcttctcttcacccgacttgtccctggttgcacctttaactgactcagactaggctacggtagttgaggatggggcttcagttccagaacttcttataattcatatctttggcgtcaacctcatacaagttacccacttcacgttatgcgtcgacatcagcttgtcattactaggataccatgcttgtcatcatgagaatatcatgtttgtcatttacttctaacttaccactgaatgctttggactatgatatcacgcttatccagcataccatgtttgacaacttgccactaactgcatcatattagctttcctggtctccgggtgctagatactattgctattcgatgcaagggtcgataacttttgcctttgaattacatttctcaatagaaccgacttatcccattggtcatgcttcgacgacttctcaaatgactttacagctggacttgtaattgtctggttgttatcctgccaaatctgaagattcgttgttagatgtgattttaatctgacctctgtagattatcttcgaacatatcacttggttcataactgggaatagctctcatgaacaagcagctcggattcactttctttacattcagtttacttcccactattatcttcaggttgtcattatttagcattcaacgtattcctttacaccttcgaccttgatgagttccttcccattggatcatctcccaagacatggcattgcctggtaatcggtgcctgcacttttcactccgtgtagcatctgataccgagttgaagatttcactcctcgccttcatggaaacacttttacctaggtcatcttgcttactcatgatttttttttacctcaatgacaaggtgattgttgcggggcaattactatcaggggtcttccttgagcgatgcagagcatgtttttgtttatcctttatcaatcacctttcggcctacttctttcctgctagagaacatctttgccaatctcttttatcaatcatctttcggcctatctctaacaggtggtactctttaatgtgggttgcggacgcttctggggaggatgaggtcctttggcctgctgcctttcagtgaaaccttgaagtggtttgtcaaaaattagactaacggttgttgcctttgatccgaagaagacacatctgaaactcttagtccaaacaaaagtcccttttggctttttaatccaacacagtttaattggttttcttttccatcaacaggttggttattaactcgaggttagaatatgattcctctgaaatgagaccctaggtctcctttgacagtaaacaattatacacataatgccatatcagcatcttccaaaagaatcctcatagaacttgtttttattacacatttctcccttattacatgaatacaaggccctaccttaaacaaaaagggaaggtgcttaacatcggtacattgcatcctcaacatgaatcatccataaacatagcaaactcactgtttataaacatgaatatatttatttattacatgattgttgcaaactcccgattacagtgataggtagcgaagtgaaaatcacaaacatggctactcattctgattttggagagatatagctggcattgttctagtgactgcatcatccttgattggttccgtgatgatgtgataggactgcatattgctatcattcacaggagaagcttccttctgattgctggttgaagcggataacggtcttctgcttggtatcgccctcctgaggttgattgccctttgctcggcctggagtaggtcggggagagacacaacttcttccatcgacgacaattctttgctgaggctgtcggtgcagagaatggttggtgctgaaggtattattgctatgatttattgcagagtcaggtggagcaggaggagcattggtgctgtggatgatattgtcaatgttgctgttggagctgactagctgatgagacaatcgtagggttgttcgttggatttctgcggtcttggtcaacaacacactgagttggcaatccttgggcacatggtttgtaccttcgcatagaaaacatgtgaccttacaggtgggacattcccctggtggatggtcttcttcacaatgagggcagagtgtgagacacatgctagcaacgtgtccaatttctccacaacgggtgcatgcttttgattccatctcttcctcgccgagatgtcggggaggctcatcttcatcatccgaggagacttgatctgacccttcactatcagatactctgccaccatggcttaggaggtgctgggtcaactgtcgtgcacctcggaaggtatttcctctttgacgtctaggaatagttatccctgctggaggccattcggtgctggtaatagtcatcttacgtacttcttcttcagttcgcatcggtgcttttctcttctgagtcttactcttcttgcctttggcttgcttagtacgtgaccccacgtggtacgaaaggctaggaggaaagcattttctaggattcaatggattgtctccattgggctctccactttgcacactaggctgcaaacttgacttggtgcaaggtggctggtttagcgatgtctgccctgctgaaccaaaggaagtggcttctttggcatatacccatgggcaattcagggcatagtgtccttgttctctacaatcatgacaaaaggggacatcctcttctggcattggaagctcattgacctggggggcaaatgcttgatcaaacacatactgattttggttttgacttcgaatcaatggtagctgtgaactcagcagcatgcttggaatggaccaagggtgtgcccttgttaactctcttgaggctagtggtggattgagttgaaaacttgagttactggaggcatacccgctgagagggaggaggagggagctgggccgaggggaaggagaggaggcccaagagaaggagggagaggaggagagggagagaaagagagggaggaagagaggactttggccgcgggctgagagagagagagagagagaggactttgggccagttggcccaaagggaggaaggagaattatttttagctttttctttttaataaactttgttaattgttgttgttgtttaataaatatttccggtgctctgaaaattcaagtaaaatttgagggctccttttagaccaaggagaatttaacaaaaattctccgggctacattcgaaattttcttgtacgtattttagtgtttgccaatttcttttcgaattttaattaattctattattccttttagaaaatgatttttatttcgggatgaatttatcaggacgtgacacacccccgacattagctcggaggccacaaaggcagaacgcgccgttgccgatatcgagacccagacgactggcgcatcccactaatcaaattcatcaacagcgaggagctgcccgaggatgatacagaggccgagaaaataacccgtaaagcaaaaatctactgtatggttggcgacgatctatacaagaaagcgccaaacggggtacttctcaaatgcgtctcgtccaacgatggcagacacctcctccttgatatacatgaaggcatttgtgggtcacacgccgctggtcggacattggtcaggaaagcttttcgacaagggtttttctggccaaccgcccttaaagatgcatgtgacatggtccagcgatgtgaagcctgttaattccacagtaaacacacaaagctacccgcgcaagcgctccagactatccctcttacttggccgttctcgtgctgggggctagatatactcgggccattcccacgaggacagagcggctacaggttcctattcgtggcgatcgacaaattcaccaaatggatcgaagcagtacccacgggggaaatcaaggccgacaacgccatcaaattcattaaggggatattttgcagatacggactaccgcaccgcatcataaccgacaacggctcccagttcatcagcgctgatttccaggattattgcatcgggctgggagtcaagatatgcttcgcctcggtctcccaccctcaaagcaacggacaagtcgagagggcaaacggtatagtactacaagggatcaaaacccgcgtctacgacaggctcatgtcacatgacaaaaaatgggtcgaagaactcccatcagtactatgggccatatgcaccacaccgacaacgtccaaccaggaaacacccttcttcctcgtgtacggctcagaggccatgctccccagcgagctacgacatcagagtacacgagtacagaagcattccgatgaggaccaggaggagcagcgaaacatcgatgtaaatctactggaggaacatcgcgaacgagttgccattcgagcagccagctatcaataggccctccgccgttaccacgagaagcgcatccgagcacgcatactttcgatcggcgactacgtcctccgatgggttcaaagccaagcatggcgaaacaaactctcacccaaatgggaaggaccttacacgatcacacaagtcttgcggccaggcgcattcaaaattgtagacggcgagggtcgcgagttagcaaattcttggaacattgaccaactacgtaaattctgtgtatgagtcaataccatccgtacttgtaagacaccttacagtatcaataaagcctattcttaggcccatattacaatcaaagtgtccccgcccgatgatctcttaccctgatgacacctagcgttaaaacctatcctcatgtccctttacgccgtcttgacaaggcctccgaggaacctaagggatcttcggctggggacgcccagagccgataaggccttgttagatcctgtagagacgaaagacaatgtaagatctggtcgtgtaagagttctcgccgtgcgtattaaccaagccgcgaaatcggaaattaactttccaacttcacggctgggagctaggatcagagcttattcaaccaaggcaggtcaaaggtccaagagccttatcctccgagaaaattcctccgacgacaaggctgggggctagggagagtgtacgactcaaacgactgactaaagtcgtgaactgagaacacactcttacacacgacatccggagtaagaaagatctgttaaagatagatttcttttctatttcacaaaatacttcttacagtttttacacaaatccaaagctatattacacctttttcctgagatatctatcacagggtacgaagactaccaagaaggccaacgccaatccatagactggaatatcttctccgccaacggcgccatcgacctcgccaggtggtgtatctccgccggagtcctccgagaacgagcaaaaccctcacggaggaaatcgagatccaggcgcgggcgatgatctcgtagacaagccaacacgtgccctccggcatatcggctcgatcgacgacattcctgcttcaaggcctcgtcgatacgcttgccgacgctatcaagttgagcacaagctccgttcagccacgagatgtacccggccgcggactcctcgggatccccacgaggtactcgaagctctctacaaaccttggctatggatgtgcagcaactcttcaagtacgagttgaactacacctcgcaacctcggagcgtttccacagcctgctttttcttcactgcaagcatagttctcttgagttccgctacttcaaattttgtcttccaatattggatacgacgatcttggccagcaagagcgctctcgagatctgcttagtatgggaatgactaagtcaggctataggcctcttccgagaacataggtgatctagtcgaaggtgcaaaaagggatgaatggatcactaacctaaggaagtggtcgccatgtccgtccccgtggcaagggtttggtctacattgtcgggcgacgcatgtggttcaaacgtgagagccggaataatcgccggtgactcgggttgcccgcgctgctggacatcctcgtcatcaatatctctacaagggacaaaaaactttcaagatcaacatgcaagagtaagctagaataataactgctcgcacaaaggcggttaagatccagttttacacagcatatctagggagtacaagaggccctactcttcaaaaagggagagaacagattcccccaggtcaccgacttcttccatcacctccttacgcgtgttgctagctgccccctgatccaagatctcgcgcagatcgagttcaagatgcgccagctttacacacgcaaggacgtggcacgccccggtgtagatcccgttcgatgtctcctccccgatcctggccacatgcttggaggggatctcctccatcgccgacgccagctccgcaagagaagatgtcagcgagaactcgttgggattcgccgggatagtagacttaatgccacactccctggcgagctggtgcagaccagtataggtgacccgcaacgagccacggatttccgacatattgttcccgagctccgacatgcggtgctcgagcccctggtgttgtcgctcattgccagccaccaactccctcatcttcttgaggtcctcacgagcctccgacatctcgtgtgctagccggtcagcccgctcgtttgccgacgacgccgccgacctcgcctccgcaatctcgcgaccgatgccgcgagcaccagcctcgaggaggcgccccatctcgacctggagctcctcccaggtgaggacggtagccggtggaccacggccagccgcgggatcgctgactgggccgcttggtgtcacctcgcggcccccgggtgcgagcacgacattcgacgaggccgcagcgggcgacgcgccagaggtccctccggactcgttttgcgcagccttcacccgcgccgccctgtgagacggccatggttcagacaacactcgaataaaatcacgaaaacttaagttcgtctacttacttttcgccaaccgtcacaaggcgttgtcgtcgtggaggccggggagatgtgtccgaggcctgaaaaacggtcgatgcgaagtaaggcgaaattcttctggctgtacgatctgacgacaggatagcttaccgagggggttgatgccttgcgatgatgtccgctcacagaggagaacttcctcccctttgtcggaacattgccaccacttgtagtagcagcagcagcatcagacgcctccttggcgaccttctctttcagagacgccgccacctgatggtccgcgagcggcccgatgatgtcagtcagaggaagggcctacgcttaatcaagtcacaatgtgatatcgaaaggaaaatgcagaatgcctttggagtacacttacattgatggcaacatcacgttcggccgcccctttctcacaaaggggaacggggatggtactcgccgttgtcggaccactgatcatcacctggccaacacgacgttccacggcttcgctgttcagacctgtgaatcgagaccaaattttgataaatcaagaggaacgcgaacatgagcatgtcaggataaatgcgagaaagataccccgaggagaaacccgagtcgcgtcctacggtctggaataatcaaaggctggatgggcccgagcctggagcggctggatccgcctaccaacgaagtctgcagcgacttcataccccgacaagcctcgtactcggagatcgtcgataatgtcgataaacgactagagagagggggtcaaagggggctttgcggtccaagacgaaatcttgtccggttgttctttgggaacaacgaagacagggtccgaatctttgatctgaaggtagaaccacctagtccgccatttgctgcgagaagaagggcactggaaggggatataacgcgacttcaggccatctcgaagtcggaacccgacgcaaccagacaccctgttggactccatccaacgcagctcgtagtagaaccgaaagagatcaataaagggctctaccccaatgtaggcctcacaaagatgagaaaagatgctaagaaaggcgatagagttggggttcaaatggaaaagagaaagaccgtagaagttcaaaaccaagagaagaaattcagaaggcggggggagaaaaccgcagagaatatagtcttcgatcgcaaccatgcgacctaagatgggctggggattagtacctcctgcttccctttccatggttccgcgaccgggaagggcgctgtcttcctgaagcttcttcagcgacgcactggtggaggatgatttgccgagatccatcgctgatcagagatcgccggagaaagggctcagatcgatgaactagggtttcttgtggcaacggagaagacgaagagcgcttacaggtgggatgttttcttcacaataggcggacttcaaaatggatccccaaaattcctttaaatagacgcacttacgactgtgcgaattccaaggaaaggggagagatgcccgccggagatttctgggtccgttacgtgcggcagttttttggacttcagtttaaattcactcgtgaccgttgggcttcacacggtgttctcgactacgtcctgtctctatggtcctcacaccgggaatgacaacagtctcgacacgacaagtcgcgaatggttacacgagttcatttaagcagaagtcgggggctactgtcagggttacgggttaggcataccctttacccttcgatatacgttacatatcggtatggcatacccacgcgcatacggatactttccgcgtacactaaggaaatccttcacgaagtctacagatgggaagagtcttactcggacaagactgtgtcatcaatgtatcgtatagggtctgctatctccgagttctacttggaaaccgcctgacttgcgatataaaagggaccccccgaggaggacctgaggcatcgaatctcagagccaacacaaccctcacagcctacgaagtcggagcttgcaaggagccaaatcgccggggatctagtcgaaccaactcgaccacgatctcgccggatccgtcaagttccattgttccctttgtaacctgtgttttccaccatataatcccacatcaactggattagggctattacctaccaaggggcctgaaccagtataatcctcgtcttttgtctgtttgtgtcgtattacgtagatccttgtaccaacgtaccccaataccctctatatctggtctacgggtaccactcgtcgacacaatcgactaatggttatgcaataaaacaatagtaatatccagtagaaaccaatcagctaacagtaatatgatagaataagcactgatccagatccgcggaggagcagcagtgctcatcaacatccagatccgcgaccatctcttccgcgcaccacctccttcgctagggtagcttgtagaaggtggaaatgagggagaggaggagctggcgggggcgcgctatcatcttcctccttcttggccgctccatgttgaagcgcgctgcgcgtggccgctctgactcgagcccacgtcgtcgacgctctgccttgggccacaccggtggctagctcctagcccgccgaagccgtctaccgccgcctcccctcatcccgctcaagcttgtcgtcttcgttgccgtgcgcccgtctgcctagtgcattggataagttggagcggagaggggagtaataaaaaagaaatagtatgcgacactaacgtgcaagtccacactatatgactcagcaggttgcaccacgtcagcgaaatcggccttcaaaaccgttgagagagtcaaattgctctagttttaatagctgaggggtgaagctatagttgagggagtcaaagtggacttattcccattagcaaacaccaaatcgagcccaccaccaccgcgctagctgtagccctgccaccgcgccacctgccccggccaccgcaccaccccaccgtacgcctcgccccgcgcaaaaagagggaaatccaccgtaagccgcgcgccccgcctcctccctcgctcgcgggcgcggctgccatggccatcgcggcatcgccctccggccgccacggtagccgacgcccccgcgaccgcccgcgcgttaaagccggtgtaatttccgcctctctcgcgcgagcgtccatccatcctcccccacccgcccatccgccccccgcgcgcgtcgcgcccagccgcccgccggcttaaccatgcccacgcctcctatttcgcgatgccatcaccaccaccaccaataccccaacctcgccccttctctcctccggccgcctcgccgtctcgccaccaccgcaaccctcgcctcgtgccgtacgggcgcgccgcgggagccaccaccccacgtccgtcgcgtcgcgtcgcgcggcacgcctcgccgagagagcgggtggtggtggtagtagtagtagcagtagaaggagggggggtcgggcggtcgcggcgcggcgcggcgtgaccccggccggctatgcttcagcgcgcggcgagcaacgcctactcctggtggtgggcgtcgcacatccgcaccacccagtccaagtggctcgacaccaccctccacggtactcgtctcgttcaccccccgcatgttcggcgaaatgcgcgtttgcagaatcttccggtcatgttggtgacggtgccgtgtttgggttaatttgtttctctctgtgtgtgtgtatgcagagatggaggacagggtgaaggccatgctcaacctcatcggagcggacggcgactcgttcggcaagaaggcggagctctacttcaagagccggcccgagctcatcaaccacgtcgaggagatgttcaggtcctaccaggcgctggctgaccgctatgaccggatatccagcgagctgcacaaggccaaccacaccattgccacagcgttcccggaccagatccaattctccatgcaagatgccgatggggaaggattccagaaggcgatatccgggatcgatctcagcaacttcaaatttcctgcgctggaaggtttgccaatggggtcacgcggcgctagccggggaaccagcccggtcccgaagaggacccagatgcaccggaggatcacctcccacatgaacaaggaaaatgcacaggaggagatcgacaagctgcaaaagcaaatcctggtgctgcagactgagaaggagttcttgaagacctcttatgacagcgcgctgggcaggtatctggacattgagaagcaggtggtggagttgcaggatgaagtttgcagcttgcaggatgcttttagcactggcgcggccattgaagacaatgaagcccgggcattgatggctgcacgagccattgtgtcttgcgaggatacattggttaatttacaggaccagcaacgtagatcatctgaagaggcaagaactgagtttaaacgattcattgaagcaaagaagaagcttgataccttcaaagctgagtgtgggcagcctcatacgcaaaatgatgaacctgataacagtgacaaagaatacatccatgcaatgccatctggggatgttgatgattctgttcagaatgagatcaggtttgacctgcaggaagtatgccaaaaggtcaaagaactaattgaattgcacccaggggtatcggtcactgatttagcagataaggttgaccgacttgtggagaaggtaatcgacctagagcttgctaccacttcacagaatgctcagatcaatagaatgaagactgagatagacgaccttcacaagtgcctgcaagccttggaggaagagaagtcggctttggttgctgattccagtaagctggtagacagattgaagcaagttgaagaggttttgcaagcagtccaacatcttggaaactccatacaaaatgggacacagaatattcataaagaaatgaatgcagcctgcagtgaacttgctgaatttgtagaaaaattacatgaacctgagccccaaaacagtggtttcatgaattcatcccaagagtcaagttgtcaagaagaagattcagaggtaacaagtcagtatgccaagaaacaaacatccgactcaatagatggttcaaagaatgaagtggagaaacaagataaaggctccgagggtcctttggtgcagcaacatcctgacacaaatggatctgatggtgaggacaagattttattagaggggtatgcatctgtccttcagagctacaagggtacagagcaaaagctgtcagaaattgagaagacaaatcaagagtaccattcaaggtcaatgtcagagctgaaggatctgaagagtgccaatgcaatgaaagatgaggagattcactctcttcggcgcatgctaagttctttgcagagaaagatgaatgcccctgctcctgagaatgtggacaagtctgaagaaacttccaaaataagcaccactcctgtcaccgaagacaaagagattgcagaaatagaggagtacatgaagcaatgccaagttgaagagcaacttgcttcgtcaatttccgaggaaaaatttagagcagagattgacagggtgttggagaataacttggggttttggttgaggtttagcacatcatatcatcaaatacggaatttccaaacatcatttgacaagctaaaaactgagatggataaattgattgatgcacaggcacagtgtggtgcagatggagttcctatcagttatcaggtagcaaagctggagtcagctgttctagaaaaaaaattccgggatttgaacacagatcttcaagtttggatagaaaaaaatgtgctattaaaaggagaactagagaacaggttctcatcactctgtggcatacaagaggagatatcaaagatcgcaactctggataaaagcgatgaagttcacttcacccctttccaagctgcaaaactccaaggagaggtgcttaatatgaaacaagagaataacaaagtcgctaaagagctagaagctgggctggaccatgtaagaggtctccaagtggaggttggcagggtgctcttgaagctccgagaaaatcttgaattatctatagcaagaagcaaccgagctcagcaaaacttccgtaacctgtcaacgaaagctggagttccccttagaactttcctgttcggcacgaagccaaagaaaccatcactcttttcatgcatgggtcctggggtgcataagcatcacagtggctcaagggctggtcgtagatgagaatggttggatcatcaactttcttttgtcaattaatacagaacagagctcagtgtacctgtcaattgatttgtggtatatgcagtttctcatagaccttaaatgtaaagaaccctgcatctcttaatataaatttggttcaccctgtccgctcatttctgcattgttagcttgcttatctgaccttactgccagaaccaaacctgatggaaatgtatcatgttaaattcattataattctcctgttactgggagaacctgtgcttattctagtgccttcaattgccaaattgaggtcaagttgataatgcctatataaaatagtggtacaactattttgctatatcccaagtgtatcatatcatgagttaatgacattgttaatcttctagccatgtttaggaaactatgaaattagtctgtgtattgtgggcatgtggcaaatgaatggaaattcagatcaaatgaaatttcttgctgtgcacaaacttgtagaacttagaattgctgatatgcacaatatccttccaatttaagaaaacataggtaagtgcaatctcaaacatgtgtgaattggaaaatactattgcatgtgagaatgaaacgagggcttgcatgtgaaaatgatgtgtggtcccaggcccacacgcctttctcacatgtttttttttcttcgaactttatgattttttgcatggtaccaagcaaaatggttcatttgtcaaatcttgggtagcaattcctttcttgcatgcatgattcaactagtggcaggttgcctgacaatagtgtccattgacttattgtatttgacagtatggttcatgtcatgattcaatataaatttcatattttgacatgttaacatcacaaaaaggaaactgtaagtttcttgtgctactgaaattctatttagtttcttctgtagcaccttttttttcatggaataatggtggacgctgtttgtttcattagatgctcttgtctcttaatagttttactgcaagtcttaggtctttggtcttaccttgggtggatttgatcaggtatgtctgatattaatgatacaaaatgcattgtatgaagttaaaactaccttggccgttcacttgtctatgaacagtaagattttctaggaggagacaaatgggctgtcaattatcagatgtgaccaatccttttctatccacaatacactcactgtttctagttccatgcatagtgtgctactttgctttatgggggaactgtttagttttccagtctgctcaccagctttctcaaagctcttctgatccttggagtggtattgtggtaagttcctgtttcttactttcttatagtcaaatatctaattatggatagttctacagatatctgaaaatgacaccaaccttagatggaactcttgcaaattgctgcaatagtgatgctttcatgttggctacagaaccaggatctcattgtacagaatcaaagataggactgctgggaaacctctagactctgtttaaggattaaaattgaaacctttggaagttgagaaaggcgggcttgagtttccttgtagcaagcagtatacggatatcaactacagtatgtcttctacacctttctatcccttctccatatgttagttgctagtcctgttgccttggtgattctcgtggaccaaagtatatgtgagctgtgcatttatatttgaaacctgttgcttgttactgtcccaaattctgttcataattggctcactgaactcttttatttttttaaaaaaatatgtgcagtgcaatacataaataaaataattgaagtccactgtttcctagttcttgaaaatgtgctatggaattctttaagtaggtttcttagaaaaaggtaggagcttcttatttctcatgtgtatcagggagggacaagttcaggctgtgactgctgtgagcttgtgatttgattgaagatttcaaaactaccattcctggtaagatcaccggtatatacatgctcgcggtaggtccacgtacaaaaatagcagtagcagatggttttctgtaccttcgttcatctcttaatacagaaggattgatggcaccttttccttttcttaatacatgtatggttggagcatattccttagctatgggtctgacacctgttcattcttcaactcttaaattcagcatgcttcttagtcttttatcaaagcagctagattttgaacatcttttgctttgttggaaaatattctcgtttccaatgtcctttttttcaactacatttccaatgtcttagctatatagaaagggggacaactttgccttgccatacagctcaacagtagatgagcaaacatgatagtgattctcaatggcaaatttgattatcaaataggcctgatattgtttacttggagcacacagtaacacatacatattttattttagagtaaattgcgtccacggtatataaacttggtaggtgggtgcgatctagtgtaacaactttgaaaaatgatcatttttcaatttatcagatgcatgaataaaagattatcatatctaaatagaagatataccatcttaatacaaagatatgcaagtcttatgcgtactccccccaaaaaagatcatttagacatgagtacaattgcatctaaatgatcatttaggtgtacacctaaatgatcattttaggtgtacatgacatggtatatcttctatttagacatgatgatcttttattcatgcatctgataatccttttgacttgatgattgttggctgttattagcttagagctgtaatgttaggaattttatgcccttgttaaaatgagtggccctactgcctttggtgcatagtatacactgcacacacttaactttgtctttttataccaatccccttcacttgcaataagcctcccaacacatcaaagggatccacagttcaaaagccatgttccatccttcttcttcctcgtcgccaccaacctacagtgactcctccatgcaccatgcactgagcttctcttcggctctgcccacagctccaactgaaattcctggcagcggcggcggtttcgtcgacgacaagggcagcatgttctctcttcccaatgttgcgggctcggcgccgcctccctcctactactcttccctcccttccttctacatccacaggagcaccagctcgcactccctccttcaccaccggttgtctgacctcctcaacagtaatgccgcattctcttactcgtctgctccagcttgccaattgcagcccctcccacctgtttcttcctccacttcatcatcctccggcgatctcttggagttcagctccgggaccctgcgccgtgtcttcagcaccggcgacctgcaggtaatgtaaccccaacccaaatctcaagctggaattgtagccattaacaaacacttttggtaaattcactttcttaaccctatgctgatgcacaacaggcgatgaatgtaccgccatcgccaccgccaccgccgccgttttcaggtgacatctgcatccaggaggtcggcggcccgttttcgcagaaggtgggccgttacagcgccgaggaacgcaaggagaggatcgagaggtaccgcgtcaagcgccaacagaggaacttccacaagaagatcactgtactggcctacaaaaccgcatttccatttcccttgcaagcaattgaccatggcagctactgtagctcatcatcatcatcatcccctggccgtttccagtatgcctgcaggaagacgctggcagatagcaggccaagggtgcagggccgcttcgcgaggaacgccgaaaccgaggccgatgccgaggccgatgcggtggccggcctggacaccgaggtgtacggcaatggctatggatactgcgcctacagcggcctcaccaacagtatcagcagcaattgctacgacaaccagagccagagccagtggtggggaacgccagctggcgcggccaattggcagcaccagcagcagaagcagcagcttggtttcgacgtcgccgtcgacggcgacgacgaggactacgagctgtgctgtgggccagcatcgctgacatgtgctcagggacctgaccctgagctgatctgacctgtccggccacacacgccggcagcagctgattggcgctgccaggtgcaaggaaggcggggggaggcaaccgagcggcggctgccgtggacagtgcggtggtcggagtggcgtcgctgaccttcttgtcgccgtagtgtaacttcgccttaaattagttatagaagctaagaaaagagaagggtaaaaaaagggaaaagaaatagaccctctcgtgaaccaagccaagaaaaaccagcttgttgtttttgtgtggtcaggattagcaatttagtaggcatttagtactactttgatatctttctccgatagaagtttggccatggttttgctttgtcacacctgaaatttgaagaaagtcttgagtgctgcaacttttgtcttgctcccaatttgctcgttagtggcggctcatgttggtcgcccctgtggttagtgcgtggcatgcttgcttaatctcttctctctctgttttttttttcactgccaaagtggcaatggcaagtagctgaccccaggagctcactgagccaatcagccaaggggtgtgtgtacctgcctgccggaaatttcctgtcttgttacatatggcaaattgcctttcattggtactccatgttctcaaatataagcatttttaagacttaaatttttatccacaatgtaagcagttgtgaacacagaataggagtccaagcattttcaaccgatcaggagaatccaaacaatctaaaatttaaaaaaatttccaaacaattaaaaattaaaaatttaaccaatgagatgtctgaaaggggatatttccttatcattattcttttctaaacaagttacaaggtgccggtcaccgtctgactgtctctgatagcagtaacacaggcgaggcaggtagatatctttcttcttgcaagtgctatacgtccctaattctgaatttgtagacatctgtgattaccaataggagtgctttgacatggcaaccttggcttggctcaatcagtgtggcacctcatttttctgcagatttgccactatggttttctagggaggtttgatcttgtcgattgtcatcctggagatgggagatgcacctggccatctccatcttgagagtgctatatacttcctctgtctaaaaaaaacaaatccttgctacatcatgtttagatatatagcccgagtttgtctttatttagatggagggagtatgtcgtagattctgatatttaacttctcggtactttcacatggaccgtaaaatttattttttgaaaaacaaaggcagaagctgcctaacttcatttagaaaaataaaagtacaaacaccaaacccagagaaggggaacatcgaaaataacatccaccaaagtagatcctgaaattgtatatttattactatcttaatctaccaatacgaattcttcgaggaaaaagtaattctgtttttatttggtacgaatacggtcacacggccggtttggccatcggagatcttggtgcttacactgtctggaataacacggtttaagttacgtagatgcttatatctctttcaactgtcatagaatcaagatagtggaatagctttgctgccttgatgatgcgattggcaaaagcagcgacattttctctatatactatccatgtcttgcaaactatttcagtcatagaatcaacacactgatttcttgaacacggcactacggaagcctgaagctggcagctctaaacatcctactgctatcaagcaaaatttaaccaaatgaacagccagtgcagcattaaccgtgaggaataatcttgaccgatctttctgcaggcacatatcgattcctaagagcccaaatgcagccaatcttcagcagccttcctttttgaccatctgaaaccgttcaaatgcagcaaatgagtatcatcaagaataaagcaggagttgtcctagatatgtagcctataaagaaattttaaaaatggcatgaagagcacccaatgaagcagagttcagctctgcagtgcttgcttctttctgaagaacggcctgaattttgttggatttcggaatcttcagtgaagtaatggacgaccaagaactaccctccaaactgtttgcaactggcaaaggtgcagcaccagaggttgccatgatatcaaaagatcggtcaagagggaatccaagcattgtgactcaatgatgagaagagcaatgagtaagctttttacagtcggcccaatgttgcatgaatgaaaccgatgcctcttgcaactagcatacggctatctcgtctccctacagtcctaagatatttcttattgtcactagtcatgagattccatgaaaagttgcaatgcttctattgttgtatcagcaacttaaacttgtcatagaatgtaccatacgctaatgtatagaaaattttcagtacatgatgcaataaatatcgaaagctctgatgcatgtttgtaatgggtaaacaattcagatgtacctgaagacggactgcgagtctgcaataactctgtcagcacttgcagtggcggatccagaaaatcagtttgttggtgtcataacgtgtctgtcggtgtcatagtatgctaattatacttagaacatagtgttatagtatatggataagcagttttgttataggttttgccgaaagtcatcggtgtcgcttgacactgacgcttatactgtagatccgcccctgagcacttgacccttgcaggaatacaaaggtaagtaaatccaaagaacacaagattccaaaatcaatatagtaggaattagccgaatagattagcaacaaaactacaaaagtgtactacactacttcttactttagggcaaccaggagagccagtggtgagctaatcaaaatggtatgctcttgctgcctctctggaatttctgcttttccatcaaaaggctatgcatgagctgcattgtagagggagaatgaagggatacttgactgtcactcccctcccctagaggtggggagtgtggctggcggattctctgtcggccgctaatgccaagtacgatgcactgataagtgataactttgttaacttcactatgatgacaagtctaactagtagtactgtttagtacaagcttttgtgtagcctaagcctgcatatatataattctgatgaatgtgcctggtacaagattagttggctcctgtgctagtaaatttaactcccaacactgtttcatttatgtgatgtggaaaaaaaaaataaaacaagataatcaataatgctaggagcaaagcatgttgccggtaattaccagcacagtcagcaactcagcaagccggccgatttcaaattacaggaacaatttgctttctcaagtggagggagaagaaaggcatcatgtgaggtgtttcactcacaccttattccattacccagagaagaaatgaagcaagaaccgaagtgatggcaattctcccgtggacaaatcaatcataaggagattgtgagggaagaacacatggcatgaacaaaagtgcctgtggatgctaatgttgactctgataagaaaattaggagctggcctactaacccttcaccaattacaattattagttcttgattgtggacacgataaggatacacaatctttgtgcactcgacagatctctgtcggaaattggaaattcttcatttcaattggtccaattaaagcttaaacagggctgaatgaagttttatttgagaataaggtcagaaagtgttgcggtattcaacggaagtggagagaccatacgtaaaagatgcatggaatattcacctaaaattcaaatataataatgtgcatgatcagaacataaaaggggtccctgtgaccaaatggtaaatcatgcaaggcttgttcatgacacccaattcaggatcccccactgccaagtggctagtctcagataatttattctaggaagaatgttctgctggacaaaaatatatatttaagagtggatgtctttccaatatttgttgggacggtcaaacgaacttcacagtataagtactaggattagtgacttagtgttgtataagtgaagtgtagtgtaggtattgtgctctttctcctgatgccgtcaccatacgacagccaaacgtgcaaatcaaaaatcagaaagtgatttgtagattgtaatgtcagcattggtgcgcctcagagactatgcaatctgatataagctgatgaaaatctgaaatgttgtttgtcagtgccatcgatgtcattaccgtacaaatgctgctacagatttcagaactgtagtgtaatttagtgaatttttcggctcttagaggaaaggagatttcatgcagcaggtatacggtataccttttccccaccaaccggctgcctgcggcgcgcggtgcgccggcccgccggagaaggatgcggccgccggggttggcgcagcagacgtcgacgcccggtgccttccacggccgcagccatgttctcccgcctcccgcaacgcacagggcgtagtacttactgctgcgcgggggcgcctcgatcgacggctcagcggcgcgcttctcgccggcgttccgccgccgtcgccctcccccggcgccaccgcgcgggggccaacgcctccagcttcggcgaagtggtgcggcggcgacggagaagcacggcgatgcggtccccctcgccgccggccgatctggtcgcctgggcccacgaaagcccgcaaatcgattactgtacatggaaagtactcgctctacctacttttccaaaaccgaaaattttatttttgatagttttatttcaatccaacaacctatcatcttaatgattttctcaaatttaatgcatgactcttcattcttacacatatgattggctacatgggttttgagaaatgtaaatactccccccgtcccaaaataagtgcagccatgattttccacgttcaactttgaccattcgtcttatttgaaaattttctaaaaaaattgaaaaacacaagtcacgagtaaagtactactcatgttttatcatcttataacaacaaaaatgctaattatagaaaaatttcaaataagacggacgatcaaagttgggcgcggaaacttatggctgcacttattttgagacggaggtaatattaatgaatcgcttgtttacgatgaatgactagcagcatgcttaaatgaatgataagtaaaactacttatccttggtctgtgtgtcaagatgaaatatgactatcaaaagtacatggagggagtataccatatacgtatatacctatacatacgtaagtgtgtatatacgtatacatatacatacagtacatgagtagggtaagtagcttagtggttgtagtgatatgagtagcactgttaatgtcaaaaaaatttaagtcctagagtcatcagagttagtaagcgtggatttttcgtcaacacatccaaggtgttcaaatctccatagaaacaaattttagattggattatttgagggctatcttccctatttaatatgttaagtttctaatttaaaaaaagctacatatatcatgttagatgtagaggccgggtaaaaaatacccttccaaaaaatgagtatggttctgtacgattcaaaaccggggatcaagcagtaaatcgtacaatagtgcagggccttccatgcaaaataacctccacctctcgtagacgtagctctccatctaaggcgttcaatcctgatcggtcggctggtagttgtccattttggatcgctatcgttggtagcgatccgggatttgaggtcccaaacggtaggactattttagtatagggtcttccgtgcaaaaaatcctccgtttaaccgttactcgggccgactcgatcgatctgggccgcggaaacttgatcgtgtggctgagcctgatggccgccgtccaaacttccttctcgccgttcgcgtcagcggcgggcggccggccgcttctctccaccgccggcgaaggcggcggcatcaaaggtaaagccgtgagccttcctctacttcctctccattagccatcttcttcccttcccgcgcgctccatcatcgtacgatcaccctcttccgccgcggcgttcacataccgccatctgctcggcgaaatgccgcacaggcctcgcgcctctctctgtggctcggaaaagattgtgatagcctgagaggctacgacgagtcgacgattacctgatggatgggcaggcaggcctgagtttctggttgcttaggatgaaatggaaatccgatactttctgttattcccacggtcctacctggagaatgcaagagcaagacgtaagccttgcgaatgctggaattctttttcgttttttttttgtggaaatcgaacggccttatggagattcttgaactccagtagggcttaagtatttcaaaaacgcacaatattctaataaatctcattctctcgtttcttctaagaagcagtctcattgcttgcaaatctgtactatcgaaatctgtacaaatcagagggcaattagcgaggccacgtggcatgactggattcatgggtttggtccctcgcgcacagccgtcagatcacgcatctacggtgatatatcgtgcggtggatcttgttgtaaaatataatctttcgagggagtttaatgcaaaagagtagagtatccatactccagtaaatacttcgttcgtcacccgttcccatccgccgccaaggctccaatctccgctcgttccacaccgcggccgtcgcctcgctgtcaccgggcggctgccgatcccgagccaacagcccgccctgctgccggcacgcggtcgttgaatcgagggcgctgcctcgcccccatgattttctggtgcgtcgccgctctccacgtgttcctcatcagccgcaacgtccactttctccgccaccggcagccgaggcgccgcctccgcccacatcgcagcattgacttctccaggttggctcacctactccatcggctattccaggtcatccaccgtctcacccctctgaattgcaaactactatcccctgctgcactctgcctgttcgttgtaatgcttattagtggaaaatagttcaacaatgtcatctgccaacgattagtagaacctatgatgtgaatccatcatgttgtttgtctgtgaccactgagagtttaataatgcttattaatatgttgccatgcgaatgctcctagaccaaaatgtagtctctgtcagtttcttgggtttctttgtaaccatctgaatttaaatcggtaaattgcctatctgttgtatgtaatttcagaagtttaaaatagcaaacgtcaagatggggctatctcatgataaccttaagtggtaagatgaggttggggatacaattcatatcaagagttttttactgatttggaccaattatcatgtacaattttaaaatgacacaaataaaaaaaaatgacacaaataaaaattatgtagacatgaactgcaaaaacatatatggtgattagatacttagatgaatgagagagaatccttgcttacttggtgcaagattaaagattaaaagaaacggtaaagtttatctacggtaaagttcagctgcatatataagttacaatgtgcaacacgtaagaccaggcttctttgcaatcatttatctactaagaatctactggtacaagaggattaggaggcaccagcatattctgctcatgtttgaggtaaacgctataccaaattattaaacgaataatcaattcctcaggctctttgtgtaaactgaaatgcactcaaaacgtgatctttagagaataagaagtgaaagttattttaaaaaaaggatttccagagttcttatagacatctggagggataaaatgaagacaagtactttcattactttggttcattggactttagaatttgtgcgcacatattcgactttcaactgatgtcgatgaactcattgtcttgcagccttcaattgatctgaataaagcttattccagaaactatgtcatatctgagaacaattagatattagaattaaattaaattcatattacagagagcagaaattggtactagaactgttatgtcgttagcattattatgttactttatattacagattgtttctgcattttctcagcactcaagtggaaaataagctggaaattcatgcatcgttttgtaattttaataaatttgtaaactaataaatagcccatggagatctttctcatacattgtagtgctgtcgaaactcaagtatggttgaattagtaccatgattaatcgtagcttcatgcactttcttttattttggcaatggtctctttgcgtactcttctattcatgcaatgacatgatactgaatactgagcattgaattctaaaactgaactggcattattttgaagaaataaaaaaaaaccaatcatgttattaggcaacaagatcagtgatcatgctcaagttgataaggaaccatattattaaatgtttaattttgattattttcctagcctggtactgaagtactgtctaatttgacctctgaagtacttgacatttgaattttttctaccattgccatgaagattttgtaaggttgctttttattatacctgtacagttagatgcaatatttaaccaatcgaagtaggcgttttttgtgtattcttttaatatataatttttttcttttcaaaaatgcggaagaaaaacaaattggaattgcaaaatttaacgctgacaaagcatccattcaaggcattcctttcttttttgagagaatcccttatatgccactagaaattggttagttctcttatatgccactcaaaattggcttctcccttatacaccactagttcaagtttttctatccttttatgctactcccagcactatagcatttgttgactgttagtcaaatattagttttttttcataaatgaccaatatgccatctcaactaaaaaatgtgtaaacttcaaaaaaatcataactaattttttttaaatcctttttgagtgaacaaagttttgtcagaacaagtggaaaatgctctttgtaataaaaatattgttggaaagctgcatgtttcatacttgtattgaaaatttgtttgtgatagtgatggctaaaattgcatgtgattgaaaaacaaaatcaattttcatatgttgtatccagtagatatattagtactaaaatacctatcattggttatataccaactctcaatggtaaatgtgtctttttactatgaagttaacggtcaactgacggtggagtgacggcaatggcataaaagggaggacaaacttgaaccggtggcataaaaaggaagagacaatttgaaggggcatataaaggaaccggttaatttggagtgacacataagggattctcactcttttttcatgttagcaatggtgtaattaatactcacctgtcaaatacataaatcccctgccaatggttctactgagtcctttttcttgctcttgttcaagaacattttattttcctcttctgatctcaagtcccaacgtctattaatttatttctttaggtttttggttcaatatgttaagaaaaaaaaccattgatcctaaacaaggccactgacaaaatagattggcctaatctaaattgggcgcggcaaagccgcacgttgtttctagtacattctaagaaacaatcaaattgctcagaaaatacatgcctttctttttcctccatctataaacggcagcagcactaactaatgcccacgtacctttgtacaccaatgttccagttcttgatggaactttacacagaaagagttgctaaccgatgctaaaatttcttgttctatataagagcgcctgcgattattttggtgtttttttcctggtctggtcttagaagttctccttgtggaaatggaaccgagtcgttgtcgtctggctgaattctagtgaaagatccctcagcattttcgtaagtgttggagacccacagtagaaaacgcctgcagatttatgaaacatctcagcattgctatcctgtaaactaggaaccatcacttgagatttatcacatagaactgacctatacgagagttctggtgggcattggccagatctgagaatacctttctccagttcggccttgcaaaatgtgtccggatctgcataaagcgagaaatattgaatcaaattttgcacatgtgatttagtttttatttttatttttgcaggaggatagaagtgggaaaaaccttgctgccagagacgatatccacaccatttttggcatgttgaagtgattggaccatggcaatcagagctgatcttgcatctccttcttcatacacgcttgtcaggtaattgtgcatctctattacattctgtatagtgagtgattatgttagtatctatttattaatctgaaggagagaacatggaagttgcactgaagcagttagactgagtagtacatcatgatcactttcagcaacatcattcatcacgcctttaaaccattcaaaggaaccttgctctctggtgacccagtagaaataagctcttcctggcccattgctcttaaaggtgcagcctaactcagcatcatgcgtgctttgcacatcctgttgaatccaattcactttagatattatgcacttggtttactgtataagaaagaatttgctatagttaagcagtttactccattggattttatgttgttcaggagatccttcagtatgctgatgaaaggcgttgctccaattccaagcccgataagcaaaagaatgtcatatttcttgtaattttgagctggtgcgccgaaaggaccatctataaagactttgggaaagctaaatgaagagaaccaaagtcaggaagattagtgaaacaattgtatagaaattccttcaaaaagtagatgaatgtagaatatgaaacaaacagggcataattaccaagtctcctctttcagaccatctgctatgatagtggtttcaagtcgtgcaagtgtagccttcttggaacttacttgtgcctcacaagcctgcatgaattagcataaccctttagcaactttgttaatttagcatataaatactgcataagctcccattatgcctgaactattctccttttctttttgtttctgtttgctcaactgaccttcccaaataggtttctaagttctgttgtccagtcacctaatgtacggatatgaacactcaagtagtcatctccaggtgcagaagttatggagaagggatgcctggaagcattgaagaatctattaatccatagcctggataaacactgacatttggacagagacgatcagatggtaccattcaaaaggcgaaacatctgggcattttacaaacatatacatcccacttttgtacttgaaacttgatggtttattcatgtgaatagagagcacatttccagggtaaattgctgcctgcatggcacatttgatagtcaattaatggtattcttgtacacttagaagctagaataaattgaaaatactcatcgtgcaattcatgtgaaatatgttgcttaccttgatgacggtcaccccataactgctctcacgaactcttctgatagttctctcgcaggagtaaaagaggactggaactgccaagaacatccacgtctgtaaacacaagcgtcaatattatgcacaaccactgaattcacaaaagaaatagttgtgccaaacatatgccagagaaataccgttcgattgtaccactgcttggtgagaaatatgaagtaggagtgcagcaccaagaggatatatgcaatcaccagtaggtgatgggcgtaccaaaaggcattgaaaccagcaaggtggtgcagtggtgatggaagcttcacaacgctcctcctgaacgaatgtgtcgcaagtgtgaacgagaatgacattatcaagatcatgaggatgccagtccaccctggagtgcttgcaaccagcgatgagtatgttggttgaacatagttgaagtaaggccccagtgtggcctcgaacttgtcccttggacatgataccaatcttgggaagtcgcaggttacatgagcaagagtatgagtagccgctccaattgcaatcgtcagtgcgataacctgatatggtgatcagaacaaagaggtcaggctgtgtaatcctggaaatggcaaagagttccacacgtgtaccttgtggaagtttatgttatcatcaaatggtacgactttgctgagtgctgttgatcggagccttgttagtgtgtttcggcacaccgggaggagtataacggccatgttcagcttgagtgtttcggcagcaccctttgctatgcagacacagtagcccatcacctgaaatgcatcccgcctactgtactgcacaaacttgtacatgaataatgcaatattgaggatcgcccacaaggagagcacccatatcctcttccaattctcatggatgaagtcaacagtcttgttgaaacgcctctgcattggactccggtgactggaagggaccattgtccttgcaaggcttgctgaagccagcttcaccttctctggaggcccttgggctgtcaccataccacggagtagcgtctccagctgccaaatctgcattgagacaagcatatctgtatgctgctgtttgtcaaaaaaaagggagataatttcatgtcttggtacctcaatgtaaccgcgatgatcaggatccagctcttccatgatcagtgaggcgtaggttgcagcatggcttttcaacttggcaagtttgtttgctgcggcactcaacacaataacctgcatatggaaagagaaaggtaaattcttattgagatcatttccacaagctttgtggaaaaaaggtaaattcagagatgattgggaactgacctctttgacctcgtcctctgtaagctgcccatcaccattcttgtcacacctgattgcaaagcaatctcatcaaggggcaagtcataaggttttttccattgaagacaaggaaggtagacctttacatgtcaaagaatattcgtagtcgtgaatcaaagttctgatcagtcaactcctcccaaaattctttcagctgttcctttgttatcccatcttctggtttgatgctcctccttctcgccaatgccacaaacacctcgcttgcaaactccttagaatccgccatacctttaagttgcagaggcattctaagcttagagcttcaatttatatacagaggatggatttattgctattctgatgtcatttatttacctgactacacttcttttaaaagaaaatgtcgtaagcacgagtactccctccgtttcatattgtaagactttctagcattgcccatattcatatagatgttaatgaatctatacacatatatatatgtctagattcattaacatctatatgaatgtgggcaatgattgaaagtcttacattatgaaacggaggaagtatatcctattcttgctacgtggtaagtattgtctccgagttatatttgggggggccaaagtctgaactttgtgcaacccgtggtcgaccaattatatcctcttaaattttccaattttctttcctccgttttttgttaaaataaaattgtgaataggaatgattatgtatactttatcaaagaagtgctgcaaacatgtatgcatggatggcaggaggaggctggctgcttaaacagttgaaatggctgaaattttggacaaacaccatcgacatacgagctaggaatgatctgtaccaatttctcatctactaactgttcccctttttccatcacatgcacaaaagctttgacaacattttccccttttttttttgcagggaaaacaaagcttgtcaattttcgatgtgttcttgctaacaatgcaatttcaccgtctctcttttcatgctgtggtgaatcactaatcactttggaggatggagaacaccatgggggcatgtgcaggagcactcaccgatgcatttggcgaagctctcctggggcaggcgtccgtcggcgctcatctcgtcgaaccgcttctcgacgttcttccacccgtccttccccgccgacgtcttgtcgaggaagcgcaggccgcgcagcgccggctgcgcgctggagtgcgtccgcttcagcttcatcgtgtcgggcaccatggacgccagccgcttcatcccggacgccagccgcgacggctgcttcttcagcggcgccaccggcggcagcgtgctctgcccgccgccgcccagcggcacgtccacgtagtcccccgccatcctgatccgaactaggtagcccgctgctgctgctggtggtggtggtgggtgccctcaccgcaggaggagcgtggccccgggcgccatggcgtacgtggtcgtcgtcgttccaggccaatgaagaaatggcgcggtgtaaatttgggctactggctaagggaggaaaggcagaaggcgagaggacacgccgcgggatgcgggggggagggggagggagaggccgtgccaattttagattggtgctcgcgcgccgcgcggccgggaattctcccgtgggtgcgagtgcggccgtgcgggcgcgggtgggctagcttggctatagcca

SEQ ID NO: 23826 - DNA, 11021 bp, Oryza sativa
attaataaattcatcatctctcttctctaccgattatatttattcttcatctattatgaagacactattatctcccaattaaaaacttgatagtgtctagtgcataagttctcgtgttgaaactgtgtcttgtatgagactcagtttcttcctctcttcactctctctctctcttaattaatatagtgccacataagctaaaagtcctacatagcaatgtagttaatgccataaacaccatcctaggtggagggttgggactgtcctaaggtcactttagagcaggtacagcaatagactataagctataaacatattttaaaaagataagagcaaatttaatagtataatccactactagctctaatttatctatagccgatctaatagccaatttatacaatagttgcttactatactattaatatatgttctcacatgtcatacatatattgcgttttgaaatccgtgctgcagctggctacagatctgtagcctgctacttttctctctcatcttttatcttattaaaatatgtttatagttggctaatagtctgccattgtacctgctctaaaagataagagagaagagcagcgggctatagatttgtagccagctgaagcacggacttcaagatacatgtgcgtatgacaagtgggactaggtattaattgtgtactatgttaggctattcccagctcaatgattaggatgatgtccatagcattaaataagctgccacctagaattaaaaaataatgtaacaagtgaataaagaaggaaagagaaggaaaccaagagtttgtacacaacatccaagacatcatgtgagataagtatcattaaatttaagtatggaatagtggtgtttgcattgaaagggtagtgtctggtactagtttcttgatgatgtagagtttatggaaactatatttagtgttttgggttgggactggccttataagtatctattatatgaattggctattaaggcagcgttcgagagggtgagagagtgaatttgtttgtttcgttttccgcacgtacgtttctcaaactactaaacggtgcattttttgcaaaaattttctataggaaagttgctttaaaaaatcatattaatccattttttaaatttaaaatagttaatacccaattaatcatgagctaatagctcacctcgttttgcgtatcttcccaatcttctcaatccccttatcctcaaacacaccctaaattgattatagatggtttggagcttgtagctggctatactattaaacttactcttaggtccctagattttttgactggtcaaaaattcatccctaaaccacaataccagatataataggactcacatgtagtgactaatttttacctcctcatctccccacttctctgccattgcggtatcaggatgtaaactgaactcaacgtcaagttgaaggacctaaagtgaacttattcctgccttcttaccttgtgtccttgtgcttcggctcgtgctgggtttgtttgggcctgaatttcccgcagtgtaatggatatgaaacgggacgcggtttgtttgagtttttgatagttcaaagcaaaaattattaaggagagaaaatgaccttaatatctctcactaaatgtgaatgattgagagtggatctgtagttaaggggggtaagaatggaaaaaaaataaatgggaggtaattggagaaaaagaattatactatgcgtacaaagcttatatgctgtaatggcactcatatggtacggagagagtagcctataatatagaaatctagaattgaatgtgacataacatagtacaagaggtatatttagatttatggtactatgttatatctaatctggttttagatctatattatatggggcggatggagtaacttctttcatataaactatagcatctctagtttctccagataatttaaatcctcatctaaattatatataaaaataattatagattacaaataaataactataagtcagaaatggaaaaaccccaacgttattctcacgaactcactagttgctttttttttaatcttgagctccccaaacataatcataagttggtgacgatagcacataagtgagttctagttacactaatttctagaagtattccaccaccccctccccttctctctccctttgaaatctcgagcatgggttttgcatgtagtggctaagggttcacaatactactatgtgagaaaactcgaggagttccacccatttcaatagggtttattgtttagttttaaaaaccattcgaagtcccctataaaccatgaaattttgtgaaaaccaatcgattttgttggaattgtaaattttggtggtggctacaccagcaccaaaaataaagatctacaccataaaactaccagcaagcatgctcgaaacatgaagtttacaatgaaatcccgttcacagccaatgttggaaatataaataaaatattttccccatgattttaatatgtttcaaaagggtcttgatatagcggatagtggatagcatgtaaagcgtgtcttgttctaaatatgtttagtaccgatagcgtgtgtttctagcaagcggacccatgaggatgagtcctctatatcacttacctatgtttttctgactttacgttctaggtgctccttactgtggaagaggcgaaggacatgaaccgcttgattggtttagtaggccaggtagtaatagggctagtcatgtactcgtttacatatgtaaacttctcctctcaaaacattattccgttgtagtctagctggttaggatactcggctctcacccgaaagacccgggttcgagtcccggcaacggaattttttttgtttgcaaaaggtagtcgttttttgtcggcaaaaggtagtgatgttttttttggtcttgagaaaacgatagcacatctaactgcttattgtattcttcatcctcttccatttgttttaaatatataaactggtataatcgttctctaaataattgctcccttattattttgtctcggtcattgtcaagtctcaaggatagtgtaaggggttgtttactctactactactattttcaaccatactattttttgacaaaattgtaaaaaaaaataatatctacgtttaatttgtggctaaatcttggtaaatacataagaaatcataccaaaattttggcaatattaccatcttgccaaaatctaaagtagcatatcgtcctctaaacatctgattgcttactattttgtctccgtcattgtccaggcttgattgttgcaagagtccagttccctgatagaccattacagacattatatgtgatcaaacgaaaaacaaaaactggatgagttcattactaactttgatagaaagaaaaaggaagaagtggtcaaaatagaagttaccaatctgccattcttggcatgcaatagcaacagggtttataaaaagcgatgaaaaccggtttgtatttcgtaaaatccggatttcccgaaccgaattgaaaacaccaaccacttgtttttttatcaagttcagaaatatttcaaactaagttttaattttttggcaagatttttcctggttttattggtatttttttcgattcatcaatggtttccgtaaaatccgaagataccgctcgtgagctgtttttatccggtatcagagttgtgaatattgaatatcagtactatgcatgcatttccccgctaacaatggccatgttcatacatggtacatccagctaattaatccaagattaaagagcggtttttatctgatatcagagttgtgaacactgaataatagtactatgcatgcatttccccgctaacaatggccatgttcatacatggtacatccagctaattaatccaacagcaaaaatattgcagatttcaacagcagctggaattagtatatcctgtatatccaaatatccaaatgttccaccctgtatagagcacaacatatggcaaaaccaaaatgcagaggaaaaatttgggaaacggcatgcatcgaggcctatatttattggctctcccctctgttcaccaagttaccccgctcagttggaggctctcacccccacattgcaaatgatttcattgaggtaaacgggaagcaaaagaggcggcaaaaattaatcgagttcatcctttcttggctcgtttcttcctcgtcccatctttttttctttcttgcgtgagtttaattcgctttgtttctccccaaaacctccatttgatttggaaccattttctgcaacaccatggattgcttcgatccaaatggcatcccagataccgattttctttgtttggaatgctggaattttctgcagattcctgcaagatttgaattgtttggtgtaaaattctgccatgccatggatgtgctaattaacttggacatggtttgattattatccccagggtctccaattgaggcgggcggtggcaggtcaaggtggcgattgacaaggcgggaggggatccatcggttggccggccggtcgtcgacgccatggcggtgagccagagcgcgcagctcggcatggccaccgcgttcttcggcgcgctgtccttcctcctcgcgatcctcggcgagctcaacaaggtaattaacgccggcgatgtcgccgccgcgcgcgccgatgctttccgttttttttcctccggcgaatacgcgagctgaaacgggaagctatgggcggtgcagccgccgcacgggacgccgatcaggggcaggggcgtggtggtgtgcaagttcccggcggacccgacggtggcgctgggcgcgctctcggcggtggccgccgcgtgcggcgccggcgtcggcgcgctcgccgtgttcttcccctacaacggcaagcccgtcccgaggaaggccctcttcgactacaccctcctctacgtcttcttccatctcgccatgtaattaatcaatcaagaaacgcgtgatcgatcaagaactccattaactctcgccgcgccgtacgtgttctgagctgagatcagcctcttctcgtgtggcagaggcatcacggtggcagggatagccacgacggcgtgggtgacggcgagcgaggccatgcaccgcgtccggaacgtgcacggcgtcgacccggagtatgcctgcccgacggccaagaccggggtgctcggcggagtggcgttcctcaacctcgacgcgtcactcttctggctcctctgcctcatgctcgccggcaacgtcaaggaggagtacttcgacgacggcggcggcggcggcgaggtcggcgacggcgtcgcggggctcgaggagaaatagccagttagccaccctggcttgtacatgactcgcgcggggaaatcgccaccgcagatttgcatcaagattcggacatatacaactcaggtggggaaaaacaacgtcacgagggagaaatacagcacgcatcacggaaacgatcgaacggcagatgggctaggtgcagaaaaaccgcgtcccatatgcgtgtgaatatgcatggcaacatgacatgtgtgtacatattatgcctggtcgttctaccgagactctcctttcgttgtacataaatttgtctgatccgtattggctgccgctgaagtgcattgttcagtactccctcagactcataatatggcaatctagaattagatgagatatttcaatgaatctgaatagaagggtgttcagacgttatactataaaatgacatatccgattctagattgctattattatgggatggagggagtatcttgtaaccgtgaaatgtgacacgtgtgtaacaccgcaacccgtttatcacctgtaggctaatagggattggtgaggttcgtgtgatctagaggtagagtaataggtggtttagtttcattctgaaaatatagacggatgaatgtggttagtttgacgatacaactcttatatctgagttaatcctttactcaaaagtgaagacgaaattataattaagtaggtatcgtgcatacgtagatccactctacgtgagagtgtactaatgtatattttagaggtagtgttatattcaccaatttacgaaattttagcataagagcagggttatatttggccactttagagattccaaccctaagccctaaaggtttgccggaataaaagggttaacccaattatacagtgtaagattaaaactgtataagtgtctagtgaggtggtatgtcggtcagctttaggtgagagcataccaatttggattttaaagggcagagtattacaatgtggtaccatgcattcaacaatttgtgggatttcaaattggatctttaaccttcaccgagatcccaaataaaatttagagattccatacaaaaattgaaagtttgataaaattggaacgatgtgacggaaaaattggaagtttgtgtgtgtaggaaagttcgatgtgatggaaaagttaaaagtttaaagaaaaaaagttgaaaacttggtgcagattggttcaggaggaggcacaatttagaagggaagtagtaccgactctctctagtggataggggtgatgagacaacaacgggtcactttgatcaatggtggattcatgatttttttagctaggaaaatctaataatagttaatgagtgcatgcaactctatagaccatctacatgaacgaaaaaaaaaagaagtaaacatcgagttgagatttatggaggaaaccaatgcaaaaattaaatcagtgtgtttatatttgtgcattgtcgatgacctacactacatatctacatatgactaatatagtgctctctcacttttttaaggtatattataaagtcaagaagtcaaaattagtgatttgaccatctcaaattatattgttttaacttttatattttttaatacactttattaaaacagagtgagtatataatacattagtatcttgagaaaaagaggtaattaagtggttccagtgaattgaacatgccgataccatttttagcttggaaactatatacggtatgcggccttgctttgctagcgaggctgtgttcgcatgcaccttttcccatcccctccctccttttctgcgcgcacgctttttaaactgctaaacggtgtgttttttttaaaaaagtttctatacgaaagttgcttaaaaaaattaaattaatttattttttttaaaaaatagctaatacttaattaaccacgtgttaatagatcgctccgttttccgcgcttaccgttcttgataggaacgagccactgcgaacacagccgacatgttcttcattagacgtatcagagcaactgaaaaatgtaagggaaaataaaaaaaaaagtaccactacaaagatactgacatgtaggtcgtagatccacatgtcaatgtgtcacgccccgaattagtaccgaccggaactagcccgtgacgctccaatttaacctgttaatcgataccagtcccaagacacagtgctggtatcacaggaagacagattatcacagcaacagatgtctctttattatagagtagatgtacagtcatgttgggctgcggacagatcccgagctcacaactgcattacaaaagggaaacggaagccgggacttggaccaaacaacacaggcgcgacttgggaactaggccgaaaccctaaaactcatcgtagtcggcttgctcctggaagaactcctcatcagcaggatccgcttcgtcttcttcagcgactgggggggattatttatatagagcaagggtgagtacggggagtactcagcaagccaagggaaaataggtgtttaatgcaggcttcaaggaaaggctgttgtttttgcagttgattttatttgaactcctttttctaaaaacaactaagtgagtgcttctcaaacgacacggttgagacggtgcgtctcgtccggtcggagtatgtgcaatgtatcagtctttaaaatttaaaacaaggttggcacccggccaacagcttttcaaacggccacccgggccaacaactttcaaacggccacccaggcctagctgatcccatcagctgcagatttttcaaacagcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcattttcaaagccgatacaggtttaccatatgccgacgagaggggtcccagaccaacaacaggttaggtcccagaccatactatgccaggaagcccaggggtcctccccgacaccaccccgacgaatccacatgtctctcgacatcaaggctcccctgataagctagttactcagccaagggtgtcatattccacccatgtggtcgtacttgtcttatgtttggatgaaattcctaggaatcggtccttaagtgcgagagcgggaaaaccgtacacccggtacgttccccggtccacggttttggaaattcatttagttcacaagcaccgacccaagtgtcgggttttccaagtcttttgtaaaactcaagttttacccaagaagttgctcagattttaaatttgaaggcgcccttcggtactcgcacagattgcacgatttccgaggcgcaactgggtggttacaagggaatatggtataacaattaacaaaggaaggatcaaatgcaacaaactaggtagatccgccaatctgccttgctgacgggacagcagattaagtgcgatcctatcaatgcaaaatattttgcaagtaacataattaaatttcaaatataggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaatattgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaaagaaaagaaaagggaaagagggagggattatagacttctcctcgggcggctagggcgcggcccaagggaaaaggagcgaaccagccgagctaaatgggccggccggcccaaggcggcccaagtgcgcgcgcgcgggaggggaggagagagagggccggtggaccgggctcaccgtgcgcggtcccgggtgggacccgcttgtcagcggctcggctcaccgtgcggagggagcacgcggcgcacgcgcgcgggcgggggagggacgcggtgcacgcgcgcggtctgcggaggaacggaggcggcgggcccacgcgcagcctcacggctcgcggtggaacgcgcgcacgggaggggctgaccggggtcggcccgtcccgacctcggctgagctggcgccgacgtggcgcctacgtggctgccacgcgggccggcgggaggtagacgacgacgccggccggaacggacggcggacaacagcggcgagcggcggagcgaaccacggcgataccggcgaaagcgagcacaccgggtggttgcacgagacgaggggagacgagccaacggctcggattcgccggaggaagcttgacggtggcgaatcgcggcggcggcaaccggcggggagggaagagggaaacagcgacgaggtcacgaggggccgattcccggcggtgagagcatctacgcggccacgggaatccgatgctagcgtcggattgggcggagctacgccgagcgaggctggcgacgagcgggtgctacggagctcgagcggcgacggcggcgagcacacggcgggcgacggcaacggtcggggcggcgccggctagctacggggaggccactcgtgctaccaccgaaaactaaggggggggagatggagcgaggaggaagaacggagggaggcatcaccgaggtgaggaggggcgctgtgacgagaggccgacggcgcgggagggatctctccggcctcgggccggggaagaggaggaagacgagcgcccggagtccctttccgcgtcctagtgcgcaccggctcctccggcacacacgcgacggctgcggtcggcgagagggacggcaatggtgcgggcgagaaacagggaagaatgggagaaaagggaagggagggcgcctgggtttatagggggcggcaatgtcggtttggaaaccgactttggcggtcaaggcgcgagctggcgctctggctaccggccaaaacggtgacaggagggagggaggatgacgccggcgggaggaaaaggggaaaaaggagggagagaaaggggggctcgcccctttcttctttgggaaaagggggaggggagcgggggcgtcgcggcagagggaggagggctcggcctccgtcccttggcggcttgcgcgcggagtggcggggccgaggcgatgacgacggcgatgacggcggggcggtttggagcggcgcgacgacacgggtgacaggcgcgggctggcgcggcagagggtgacgcggcggcggcgaccagacggtcggccactcggcacgcgcgcgcggcttgcaacgggagggcgcggcggatggagaggcgcggctcgagcacgcgcgctggctgcggggccgagcggctgcaggcgcggcagggcagcggggccgggcggcgcaaacgcgacgcgggcgaggaccacgcgggcgcgcgcgcgaacgacgcgcggggagcggcagcgaaggggcggaaaggagggctcggctcggcgcgggcggctctcgtgctcgcgcgcggggctcgcgggcgga

SEQ ID NO: 23827 - DNA, 5935 bp, Oryza sativa
ctcccccgggggagatgggccgagagggaatcggcccatcgaccccgggggaggcaaaatagacttttgcggagggatttgatttggaaggatttggattcggatttggactcgacgatagatcggggattgagatccgggatggcacggacactagacaacaagcaaggaaacaaatttcgcaattagggtttttaagagataattttcccgctaggcgccacgacggaatgggcgctacacaatgacacatacgcctgctggagctagcttaaaaaaaatctcaagttctgtcaggatggtgatggttgaattttttagagataatattattttaataaaaaattgcaaaaaatagatgtcagttaactaaaatcacaaaaataacatcatttcgaacctctctgacaagtcacatatcgtactaccatgatacagttaggtaggagatatctaaggccctcatcagtaagccaatagctttggctgatcagccaaagttggctttttcccttaagctaaagaaaaaccattgattggcttgattggcttatttggcttatttgatgaagattttttgtggccggtgctcatcagcccaataagcaattcaatgggctttggctgaaaagcctcagcccaaacatctatccgatgaggccttaaatcggatggcttatcaaacaatgaaagttcgacatgcgccgaagatctacaattgtaatacaacatatagtttgaagctagacgtacaacttacgaaacaaatagacatgtttgatttaccccttacagttttgccctaaatatgatacttcttccgtttcatattataaatcgtttgatttttttgttaaaattttttaagattgaccatgtttgtaaaaaaatatactaacgtctttaatacaaaacaaacatattatcaaaatatattcaatgctaaaattaatgaaaataatttggtattattgtcggtgatataggcccgggggtatcaggtttagagggaggaggctgccccccgatgccacgtagccctcccccgaggggagtcaagcccaaggtggggtggcggccactccttccccaaagactagtcggaggaggctgccccccgatgccacgtggccctctcccgaggggagtcaggcccgaggtagggcggcggccactccttcccaaagactggatggaggaggctgccctccaatgccacgtggccctcccccgaggggggtcgggcccgaggtagggcggcggccactccctggccgagactagagggagaaggccgccccaggcgccatgtggctcccccccaagggggggatcgggcccgaggtcgggcggcggccgccccctcccgtgactaggggtcgggctcccccgacctcctctctaggtcaccacgtacggtgggttaggtgtccgcctccaggtgcccacctacccgcatttatggcgtcccgagcggtcgcgccacgccgcatttaatgcggtgtgcagtgcactcaaccggtctgtgaccggtcgaatgactgatgggacccaagatgtcaggcgcaccatcgcgtgtgtcaggcgacgtgcagcccgacatatcccatcaaataatgatggtgagaggttctcatcctcttatcccagccggaatcggtcctcccgctctggtcaaggcaaggctcccgttttccggtgtaataggagcccagaagtcttcacccattaaatggtgactgacaggggcaccccccgtgtcaggcggcaagatttgacaggccccatcatcaagacgacgtgtgcttggcttcccaagtcaagagacaagacatgcatttaatgcaaagattataatacttctccaccggagctaggttaggttgttgggcccatgtggtaacccattgaggtataaaaggagatccaggcctagtggtggaggaggggacttcggggcgaactggcgcttgggtctcgcaaccccaagcacttgtgttctacattcaatcaatcatgcacaggagtagggtattacgcttcatagcggcccgaacctgtacaaacctcttttgtctcatcgtcttgaaggggcctaaccccctcaagatcacacagctccgctcaccaaaccctcgaatctcacccgctgcccccggccgaactcacaaagcggggcctcacggttccctggtggaggagttcattctctgacatctggcgcgctaggtagggggcgcgttcgtgatttttgaggttctttcgagcgccggcgtggtgagtgtcgcgccgccgctacgggggaaggcacagcatcctcaggagtgtcgcgccaccccaggcaggaggcaaggcccccacatccccaccaggtaagcttggctaccaggtctttgtggcgagtcttcggaatgtccgagggcccccaaagctccagccctgcctcaccgagaagtacgatgatggcgtcgacccctccgagtccctccagatctgcacagcgatcatagaggcggcgaggggtggcgaccgggtcatggcgaacgtcttccccatggccctcaggggccaagcgctgggttggcccatgaacctgcagccgcctcggttcactcctgggaggactcttgcagttttgagctccgggtgccttcaaagcccgggaccccctgtgctggctcttctgtagcggctggctttggtcccgccggctggctacggtgctcggcctggctcaactgatcgtcctttcaaacttcaagtattttcaattttgcaattcattagcttgaaatcttatatttatttcccccattctattctcatggccctgcgacgcccgcgtgttgcgcatttgtttgctccctcggtggtaagagcccaacctctctcccatctacatgaatgattcttcgctaagtgtgggggctaagttttctagccttatcctagccttaagttgagccccgggtgccgtcgacgcccgggaccccctgtgctagctcttccgtagcggctggctttggtcccaccggctggctatggtacccggcctagctcaactgtggacggggattgctggctctagagttttcggctctcacactcatgcgaaagtaatcgtccatgtagaaggaaaagagattggaaggaggccaccgaaaggaaagagcaaacagaatgtgtagcgtggggacacaggctcgtgggaacctgacctcgtttgctaagtggtcacaggcttcccaagatggttcggaacccatggtggggggccctcttcgagctaaaggtttgtgtttgcttcattcatacaagcaattctttgctataagtgtgggggctacgattcctagctctatcctagccctgcgtcgagctctgggtaccgtcgacgcctggggccccctgtgctagctcttccgtagctgctggctttggcctcgtcggctggttacgatgctcagcttcgcttgatcgcaggcgaagattgctagctatagaaagttcagtcctcacactcacgcgaagataatcgtttgcataaaattattattgcttatatttatctctcgcctatctctttgttgacgaaaaaatcgaatacaccggcctgggagatctgcttaactccagtgcaggtccaaagattggtgagatgcgagcgtaccagtcagtttgatcctacaactgacaagatatacaaatagtagatcaaaacagtcgatcggctgacaagccgatggagtagttccagccaatagcgataatagccgatgccgataccagccgatagcgatagggtttaagaaatcggctatatgtccaatgtaaataatgatatgaaggcaatcggctgatgatgatgtaataaaataacaatataatccagtagaaaccaatcggctagaaacaaaatacaataagcactgatccgaaggttaaagcatacatcggctggaggtccgatgtcatgaaatccacaagattggattaaacagtgaaacctttgtcgtcatcggctaaatccaacttatatgtatatgcaatccttatgagccgatgcaacgtccagataactcaccggctgaaaccccgatgaaacccttattggcagtcaaaaagccggctagagattatggttctaagcatgacttagtagatcaaacttaactgatgtagcactaagtatgaaaagaaacataatatctagacaatcaagccgttgactgagttttcagggtggtagatgtctaagctaatctaatctagcaacacgatttagccgataccggtagaaaccctaaaacgagatgcagccgatagagctaaattgatatgctaagactagattaacagagacatatgataaataggtaggcaaatatatcatccaaaccggagcaatccaagaggtcgaatgtactgatgcagccttgaatgacgccgacgtagacgatacaattgcctgggccgacggaacattggacttaccccttcgccggagatcgaacaccggtgcagccccgcgtcaggtgccaagtcccgctagacgataaaataaagtacaaaaggtaaaaggtggcgatgcaccgaattgtattgatcgtagagattgattacatagaccccggtttacatatttatacccatgggttgatacaagtccttgtcggacaagaaagaaactaacctaaagataaaaggaaaatataaagtccttatcgaacactaaacacactttcctaaagataaaaggaaactaacaaactattcctaattaatagataaactgccatgccgcatcctcattaaactcggtcacttagggataagcttcctttagtagattgatttccttaaccgaatatagcaggaatccgactattggcgacttgataactcccatcggctgattccgagatgttgcagccgataatgattctaagccgatgatgactttggccttaccaaatttcactatcaacaccgccgccctacctcgggcccgacccccctcgggggagggccacgtggcattggagggtagcctcctccatccagtctctgggaaggagtggccgccgtcctacctcaggcctgactcccctcgggagagggccacgtggcatcggggggcagcctcctccctctaaacctgataccccgggcccatatcaccgacaattataaatgttgctgttttttctataaatttgatcaaatttaaagaactttgattaaaaaaaatttaaatgacttataatatgaaacggatagagtattaatgtatagtagctatatccaccaaatatgatacgacatcagtccaatatggatagatcgaacacgtcccctgaaatataaaagtccaaacgtgggagcacttcattccaacatttccatcagcatgcactctagttagctcaatgtaaacaaacaaaaactgtcggccggtttggtgaactatcagtgtacttaacaacccctctttaaaaaccaaagcgcacgcaccacgcccgcaacaaactccccaccctcaacctctatacaaaagtaatccaccttcaagtctaaacaaagactaccaaccccaatatttactcatcagttgacccctgtcaatttagtgtgactatgtgagctgtaactagcatttaggcagcacttgaatagcagtttggctgagctagctagtgacatggaaactaacatgttaattagcacataagtaattaagtattacaaattttataaattgatctttttataaaaacttatatattgtttctttaaatacaatatttagcaactggaaacacatattcatgataaatgagtaaagcccataaaaccgtaggtacggctgtgttcgttatgtatggttgagaactttttttctcccacgaaaaacgagataactcattaccatttg

SEQ ID NO: 23828 - DNA, 20968 bp, Oryza sativa
  unsure (1)..(20968): unsure at all n locations
aaaaacacggggtggcgcaccgcgcgcgacactgcgctcccgtgcacgccgcacggaggagatcggggatctcggtctccctctctctctctctcggcgcgtcggtcgcggaggacacaggtcacacgagtcacggagccccgtactactcgccttcctcctcctcaacccaaaccccatcccgtcctcctcgcgtgtcaggcaacgcagagacgaaacccacgagacgtgttcgttcctgctcggtctctgatcagtttgctttgggcgtggtcttcctcgagtcccccacatttcttcctcccctccgtacggatacacacactctttctctctcgtgactgatccgactccgccgccgccgccgccgccgccgccgccgccgccgtttgctgttgctgcggggggtgggaggagatgaagccgaagagcctcccgttcatcgccttcgagcacaagcggtgcgtttcctctctcgcccggggtggggggggggggggggcgtgtttcgagttttgccgtctccttcctcgttgcgccgcgtgggtttcggccggttgctgtacgtcgcgtcggtttctcctcggcgagccgcgacgaggggatctcactttttttttcttgctgaggttttcgggtaatgcggcgagggattggctgtgcgcgggagcggcgagggctggatctcctccgcgcgaaggagtgtagggttgaagcataggatggatttgccggtggaattgcacgagttgagagctccgtgatgtttgctttttttttttttttgaagagatctgggtttcgacgtccgcatcctgctgcacgacagtaggagcaagcagtttccactgttgattcaggcattgagttgataggattaaacctgacgaaatttgatctctggtttgaatctaggagagggcacaaccgcacaagtctagaatcatcgaagttctatgcggtagttagttgccgttttggagaaatgttccctttctgatgctgtgtgattgaagcagggatgcctatggcttcgcagttcggccccaacacttgcagcgttacaaggagtatgcaggcatctacaaggtagaagacacgcgccccctgactttttttaatctgcattgtctggtgtggacaagctacatgccttctggtgctgtgtttgcaggaggaggaagaggagagatccgatagatggaagaattttctggagaggcagtcagaaccatcgggacaggaagagaagggtgaagctgccgggcgtgttgtggatagcagtggaattggcggttcttcgttgctgcaggagaagattgtgcaaggaccacacaagatcgagatatggaagccaatcagaccatccctgggcaacatagagcagatcatgagtgtacgtgtcgaggagaagcaatcacctgcttctggcaatcaggacacgaaggatgtcatccatccggtgaaggttcaagagggcaagttatctgaggattcagatgatgagttctatgatgtagacaaggttgagactagtcaagaaatgcattcaagtgatagtgcgaatactggcattgacaacaggggtcaagaggaaaattttccttcgatggaagagttggagtgtctagtccatggtggactgccaatggctttgagaggagaggtgcagcttgtttcatggaacctttttgctttgtttccttttctaactttagaattcttcagttcattcagcagactcttgcttttgtggtgacagctatggcaagcttttgttggcattggagtgcgtagggtaaaagggtactatgatagtctccttgtggcagaaggtgaactagaagataccagtggttcgcgttcttcaacctcggatgttgccggggaaaatactgaagtatcttctgaaaagtggaaagggcaaatagagaaggtaggtcactgagtccaaatttccttttttttttaatataaaaagctagttttattggaggctaggatttttcttatttagcgtttttatctggaaaatctgacaagaagccgtatctgccatttctgggctccttacaggacttgcctagaacttttccaggtcatcctgctttagacgaggatggaagaaatgctttgagacgtttgcttctagcttatgctagacacaatccagcagttggttactgccaggtaaatgtgccgttactggtgatccgcattgtgtcctttatcttgatggaagtcagcttctttgtaactctgtagcaacaattgattccaagtgttatgataaaatagtttgagtaacaattgtacttggatattggtgaactgtaggcaatgaacttctttgctggtctcttacttctattgatgccagaagagaatgcattttggtacaccctcatgccaagtgttgtactatttgtgtgttttcactgatataaaatattgtgatagttgaattaaataatattttaaagctgttgatggtgtaacaggacattggtaggaattatcgacgactattttgatggatacttttctgaagaaatgattgagtcgcaggtattgtgatgtttccatatccaggtttctgttggttgcatgtttgagtgcttggaagatggaactgcatgtttgattcaatcttatgtgaaatgaaccttgggttgtttccaggtggatcagcttgttttagaggagttggtacgagaaaaattcccaaaactaggttcgcaacttattgcaaatatgatatattggtgtggcgtgcctcatttagctagtaacttcaaaaatataataattaaaagctgatttccttttttgtgcagcaaatcacctggattaccttggtcttcaagttgcatgggttactggaccatggttcctatccattttcaccaatgtgcttccttgggagagtggttagatttttacctttgttgttctttcatgtttgtttcttgtaggaaaccccatttttaatttataccttagctaagccattggtggagatataacaactggatatgtgcaagttgaaattttgtgtttctcttaaatacttgtggaacttgttgtgtatctttccaaaatggtgtgaaactattgtaattgattgattgtggctttgtgtatcttagatgcggtggccagtttataattatctaagaaaagcctacatagttacctccacaaagcacattgatactacattatcttactagtatttattattccattctgacttgctggatatgtgaactagtctagtcaactataacccccttgggggtcagaggtagatgatgcagatccaagttatctttgtaagtagggagaagtagtaagacgagcccttggtccccacaaaaagttcgaaagtattaccatgttttccttttgtctcggatgatggctgtggcattgctcggaattgttgaaaatgtctacactactatcagttaaatttattatttgttacatctattatctatgtaagcataaccttgtttggtgtaacagcctcgtacatattctgcttggaagaaaaatgacaccatgtttatttctatatgttgtttgaacattttcagttctccgtgtctgggatgtccttctgtttgatgggaatcgtgtgatgctattccggacagctcttgcactacttgagttttatggtactgggaatgcttctgattctcatagtttcctaaaataaaacgacaataagtagtttcatctcgtgggctagctaggtactgatatttttcttgattgcaggtcctgcacttgtgaccacaaaagatgccggtgatgcagttacacttttgcagtctttagctggctccacttttgacagcagccagcttgtcttgacagctcgcatgggatatcagtctgtagatgaaacaggattgcaagagttaaggaataagcatcggccatctgttctatcttcaatggaagaaagagcaaaaggtctaggtgccttggacaccaacggtcttgcatcaaagctctataatttcaaacatgatcctgaaccactggtgtcaataagtgattcgcaagatcagatgagtgatgtgggagatgggaatgccaaccaaagtgattctggaaatatggatgatatgtatggcggtctgacagtcagttctgagattgaagctttaccggacccaaaggaccaggtagccatctcatcatagtaattagatttagtaaattgttctctatacctgaagtggctactgtagtttctagtttgaatccctgcagatcttctgatacgaaccagtttcattactgcatatcctttatctgaattatttttattacttcatatcttctatgggaatcagttttactacagcagatcttcttgtctgatttactcttcttacattagatctcttggctgaagtttgaattatgccgattgctagaggagagaaggtcagctgttctcaggtatgttttacatttcataatttgatattgtcataatttgctggaaagtcgtttttcattatttcaaaatgagaaatatacatgcattctgtcataggttgctggaaccatcttatgcgactttgcttttaaatagatttatggctaatttacccgtatcagtccttgagtcctgatctggttgtctaccagtctgaagtattaattccaattttcttctttttgatatccagagctgatgaactagagacggcattgatggaaatggtcaagcaagataataggcggcaattaagtgcaaaggtatagccagataactaaacttttgtataaggaggtgttcctttgtgccaatagtcagattgcaagttcagagatggcgtttacaatgcaactatgccacagaaataaatttcaccatgttctttatttcaagtatatataacagtgttttagaaataatcattctaccaaattataaatggtgcaagatttatctagtagaggcactttattttgaaatatccaaatcataaccaacaccagtatatcataattcatcctatgagctaaagatatctaattttctaacataagtgtgtttgaatgtccctcttctcttttaggttgagcagtcggaacaagaattgtctgaactaagacaaaccctattggataagcaggaacaagagcaagcaatgtgtcaggtacagttgacccattagtttttatagatgtatctttctaccatggcatgtccactcaccagaaattatattgaaggtactgttgcgagtggaacaagaactgaaaattgcagaggaagcacgcatctctgctgagcaggatgccgcagctcagagatacgctgttaatgtgctgcaggttagtcagtcaacaagctcggtccatccttctgagatcatattttctctcttaaaatcacttactccttccggtcctaaatatttgacactcaggacaaggttcagtcaaacttataaattccaacaatcaattttatattagaataagtttataaaatccaataagcttatgatattatgatagtactttttgaagcaaatatacgtgtatcatttttttgttttaaaactaagtatttaagaaatttcatggtcggaattttaaaagtttgatcaaaatcttgtcctaagcatcaaatatctataactggagggagtatttttatctgaactaaccaaaacggtagtcacgtacatttacatgcacacatgcaaatactgtgacatatacatatgttgtgcccttaaaacatatttgtatacttattttctatatttttgtaatattgggctctcatcggatcctgacacatatgcaggaaaagtatgaggaagctatggcttcactcgcgaaaatggagaacagggctgtaatggcagagacaatgttggaggccacactgcagtatcaaactagccagcagaaagctcttctttcccccttgccttctccaaggtatcccaatttgcatcttggaatgttattagtaccaactgtgtgctactcaactgcttgagagttcagatcgcaactctcatttgcttatgaatttctgtactgttagaattttgaaaatatttttggctagcttttagagcatgtctaagtttctaatgagcaactgtcagttcggattgctcaattattcgtgaaaattagtaggctttcatgacaatgcattcatgttaaattatgttccaagttattcatgttatttagtgttccaacattgacatttgcttgactctgtttcccctccagaacatccatgatagacgcatcccctggtcgagcaaaccatgattcatcacaggagttccagcccaaaaaaataaacttgctctcaccattttcactgagttggcgcgataagaacaaggttattcttctgacctaatagatacattactgacacacgaggcatcctgtatgtggccgcaccaattttggcttagttaaatgggctttcaattcggtagataatgttctgtctgatactctccatccttgagttagaagatgacaagatgttatattataaattatatccactgtttagtgttttacaaatcatacaaaatgacctgccaatctgggttcttcacagggaaagcagaacaatgttgatgacagtgccaagcttactgatgcacatgatcaaagggaagaaataaccaacaacaatgacgagaagcaggtagaaacaccaaaactggatgtgctagaagagtctatgggttcacccaaagaagataacaagtcgagagtagaggtgccaaaggaaacagcgatttggcaagcgtccaagtagtcgcaaatgatatgaatgggcagcatgaacagttgcaagaaataaaactggattgaacagttgcaagaaatcacaaaccaaccttttgcatatatcttcaccactatggtattcttttatctgatcttaccatggttgtcgagagagttaaacctggagggcttcaaggttcgaacacgatcattgctgtacctattttttgctctgtccccttctttttaattgtttccttttttttttttatcattgccactcttgtaggtctataggttactttttctctccattattactcgagaagagaaaaaaagggcgaaagttatctggttgtccattagttaactttcgatgtaaatgcatcaggggaaattaccaaatgtagaaacacactttgcaattatggtatgcttgtttgtgaatcgtcatttccgctagcgagggcttgcttacgttgtcaaatgcaggaatctgcctcatttttggagttcatttgaaaagtctgaaagttctgaatgtcaaaagctcgttttgacgaggaaaagagcgtgcttccacttttatggattcttctacgtcaacttttcattttattctatttactatcctctgttattatcacattattaacatggttaacagacctgaccagtattacggttgtggtcttcgcagtagctaaaatcatttgttgggttggactctgttttggtcaaagtcatctcctagagattattgcctgtgaagacaagaatcatacgcccttattctccttaagattattgtaaagactaatgtctttttgactggagcattaagctgtgattgctgaagtttgttggatagcttggacccagcttattcccatatctttccatttctttttttgtttgcttactagctataccccgcttgtcatattttcaagaacaagtgaaagatcagtttggagtagtagttataaaccaccttttagagagaaaaaacgggaacaatcacacgtatttttgtttaaaaaagtctctgatgttgggattttaaccttggtgtcctgactcccgaacatctgaccagttggcctacaacatggtcggttaattctgaatttgaaatccaaacctcttggcattacccaactaatctaatgtttgtagatgtggccctggctagtccagtcaaagaatccatctcatattcatagacaccccaattccaaccttgactatgatcttgtgagcagttaattagctgccgatgaacaggccagcaccatgccaaccaagagaatgttggaccagtagagctctttcctgcctctctcagatgtgacctcaaaccccggtaatcctagcattagggatactatatattgcacatttgcactccactgagtaagatggcaataaaaaagcctgaagacttgctggcttgctgcatggtcttgcatgacattcatatctctattgtttgcataattgactcacattcatctgtatatgcttgtatagcctagtagtagcctttgcactatgttcagttaaaacatccactgtgtcaacaccttttatttgccagggccagacagctcacagctgaggcaagtgacattgcagcaagtcactagccagccagtgtatatatatacacacacacatacacgtgcaaacgggaggaggagagtacgggggttcttgtgtcacctcccttctctgaaaactactgaattcctaaggtgatcacattcttcttggtccttcgaaaagaaaaaaaaaagaaaaggcattcttctctgaggtaatcaagagattcttgtcacaattcatggtgtacatctgcaatgtgtttacctgaggtgacccatttggttttcttgttcaggtttcatcaaatggcagatgattccaaggcgcattcggtgaagggaagcgggagaaagataccgaagagaggacaaataaaagctaagatctttaggtctattttcgcctccctcgtagcgctagttcacaagatcaaagacaagaagaaaggataggaaatgtacatttggacctgtagtaatatcttcatcttggtgtatcgagctgcatccagcaatcatctactactagtataatactagtagtatttacggtattaatatcaaagaaataaaatctgggtaaaagcttcatgctgcgtttgcatatggtcctatgttttttttttccaagagggaactacacaaatcttaatgaagtcgatggaagtgcatagatttaatagctagaatgaggattggcttagttcaaattggcatgtcccccagttctaacctactacctcctccgtcttaaaataaatttatttttcacacataataatatatataaaaaatactagaacactctctccatgttaccaaatcctaatggaattgtctcccccactttatctaatatcaatgcatttatcccttatttttaaaaactccaatacaaagattacttgaaaataaacttattttggaagttggaacaaacaagaagaaacaaagataaaactattttaagatggagggagtctccctccagtaatgaaatcatatcattttgaacgtcgatatggtttgcaagatacaaatttgatcggaaaatatttaaaagcattaataaaattgtattatgaaagcactttctgagatgagtccaatctaaatatttaaaaagatgttaatgttaaagaatattaaagttctatttgaaacagtatcaaatataacatcttcttttaatctttttaccggaagcagtatacagatcagtaaacctggaaacttcagtgagttatcgttgtcatccacatcaaatcaagaaagcagcagtgcaaacttagactggtctcccagtaaattgcaggacagccaattatatgagcaaagatagaaaaccaaaaggagatagcaacatccacaaaagtccatttagtttggcgagatggcaactaattaaacatgtgtgcgtcagtgcatgatgatagtaataagtgaagaagaagaagaaggcaatgagaaaaactttatttgaaaaggcatgagaaaattaagctactcgctgaaaaagccaaagaaccacacacaagccaaatagacttggatcttgacttcccagttttatcatcagcataagcaggcaaatcagatataatctacagtggatttgcagtggagggggccacatgccaggccataggccgacaggatgttggacaaaagatgcaaggacagagacacgtcgggccgttggggcatgctaaagactcgaggtgagcagacagaaggacacaaatgttacaaagagttgtgtttgcctttgaatggtgatgcagagaattttcctctaaaatactccctccgtccttaaaaaaactaaccttagtatgaatgagacattttctagaacaacgaatctggacataagcatgttcagattcgttgttctaggaagtatcccatacatgttaagattagctttttttttacggaacgagtatactccaccgtcccaaaatataatgatatagaagatgattgaatatattctaatataatatatttggatgttttgaaaaaaaagaatgtatagatacattatactatgatacattcaatcctctccttggttatggaggaagtactgcttataactctttgtttgttctaacacagaatttcctaaaattcttagacatccataagtataggtcttaagtgttcttttttttttgaaagactagcggattttcccgtgcattttttgtttctagatagattttagtgtactaaattggacttaatacaagtctcttcaactttctatgtaatagatttgaaatggaattaaatttgatatacaattgtcgtcttttttttccatggataaaattgcattttgcataataaaattatattgacaatatacaccattacaatctaaactagacacatcacaacgtaatgatgcaaatcatattgcttttctcttattaacatggtataatttctagtagacctttatagcaaattgaatgagggtagttttctttttctccttagtaatatactactattctttttagataatggatatatgatttggtatttgcttcaacaaaagctacttccacttattacaaagtccttacctcaaaaccaaagataaaaatatctaagcacggtaagacgagaagacaaatttgaatcccaccaacaaaaggaagaagatacgcatacctcttattcacatagtaaggccctgtttagatcccctaataaaattttacaccatgtcatatcgaatatttggacacatgcatggagtattaaatatgaacgaaaaaataactaattacacatattacgtgtaaattgcgagacgaatcttttaagcctaattgtgccatgatttgacaatgtggtgctacagtaaacatttgctaatgatagcttaattaggcttaatagattcgtctcgcagtttacaagcggattctgtaatttgttttgttattagactacgtttaatacttcaaatgtgtgtccgcatatccgatttgacacgccaaaactttacacccctggatctaaatacagcctaaacctatttaatcttcatctaaagttgtggtaaaaaaattcacgactgttggttctacatccggcatacaagactgttggttctacatccggcatacaagattgaaaaccttatcctcatcatacctttgtaatcgggactaaaactgaagctagtaccaacgtataagattaaattgaagttgcataacatatcattcctactatatcaaagagtgcaacatacaacagatagatagatagatagattgtgctacacttgtgatgacattttgactgcgaaaaagtgcaaaatctttagctatgtggaacacctcacaccccccacccccccnnnnnnnnnnnnnaaaaaanantnnnngngnnataccannacaaaaatgcccaaggataaatgttttgcacatttgtctttttgttgcgcgtgtgtctcctcaaggctagtgtgttctatcttcttcctgaaacaaatgacatagctcatgcatgtcaatttcatagtagaaaagatatcaaaccaaacatgcttttgggtctcatgtcatgtccctatatatttgtgaaatttgggctaggtcgtcgtttgtctttatgcaatccgatccaccgacggtttgttggatcatgatattgttttacccatgtccctggagatcagcacacatggggccatcatgtagtgcaatatatcggcaaagccatatgtgaagcttacgcgtaatttggccagcagcaacgacaacgagtcctagaagaagacgaagaaatgcaacgcgtgcgtgatgcgatgtacgcagacgtgaattcttggttatttagtcaagtcatgaaaccttttaatgacaacgcaaaataggtagagcgctaaagctaggctaccgctaccatcggtggccatacgctgattgtaagctttacagcttatagaaaagaaataatttgtcggtatttacatatgtgtaatttcttaactatgtaaaagctaatgctgaaaaataaataacaaaaaaaatcttaaaatcaacttaaaatttaaattttggcattcgtttataagctactacctccgtcccaacatgtaacaatttttggctatgaattagacacataattgtccagattcatagctaaaattgcttatattttaggacggatggagtacagggcataagatgagagcatttccctgtttttaaaggataatgcataaagcagccatcggcaattatgcacaaagtcctcttcttattttgataatttttaaggtggtttttattggtagcacaatcactctataattcatgatgaatcacgaagtggacgtagctcgattagttagatttttagtggtaaaacctgtctatgtaggttcaagttctagacttaatatggatatgaagatcgtatttatggttaagacgcctgtggtgacttaatttatttggtggtttgtgtatttgatcggaattcagaagtcttaattcttttggccgacgtacgatcgctgcctggatgctggtccagtgaaaataataagttggaattcagagtagtgaaaataataagttggaattcagagtagtgaaaataataagttggaattcagagtattagtgaaaaaaaaggttggaattcagaagtatttgtttgtgagctgaaatgtcaaatttgtcaaatttcaaataacttacgtggtggccttttgctttcccccccaaaaaaaattacactctgagtacctgtatcatcttggaagcatagatatggtgtaaattcaagtaacctctgcaattaagccaagaacagatctactgatgaagcacagcactattaactagcctttcaacaaaagaaaattgatcttcattactaatactccgaaaggtccgaacaaaattgagggaaagatgaacaaaagggcatctacaatctagcagcagcaacttttcctgtcaccatgtcaactacatcgatccatacacatctacgtacggaatactcctactgcacagcacacgtacacaagcaatatactacaagtaatatgcatatcaatctgagtatcagatgatgatgatgttgctgttcgattggatcgattcagttgtagctggcttctctcctgaagctgctgcgatccgctgccttcttcttggagtctgcagcagcagcagcgtcgccgctgctcctcgtcgccggcgccatgaggttgctgagcgtcctcacaatctgccgcttcagctgccccctcttcagcggcggcctcttctccttgccactgatgaaactgccgctgctcttgtactgctggtagtagctgtagcagccgtacccctgctccatggcttctctctctctattttcttcagttcttgctcagttgctcctttctctcttctgaaactgaaattgttttttctctctcgttgcagtagtagcagttgaacaggtagtagttgtgttgtgttgtgaagcaggttctagtttagtgtgtggagatgatttgagaaattgagaaggcaagaagtatttataggcggagtgatctgaagtgtcatgctgttctgttgccgcacatgttaattaatttaatctcggttgtaactttgcatcagccggggcgggtgtgtgtttttttactattctttgaaggaacaacttgaccacttctgggccgggaggtttgtgatgtgatcatggcactaataagggcatctatgccctgaaaacgacagaaatgacaattgattactactacctggagggcaaggttaacgtgcttaattatatcaggcaaaaatttctacctgatgtctaccactgtccgcacatatttgcttctttctgttcgtgctcatcatggacgtgaccaactgaccaaacagtctctccgagacattgctgtcaaaaataggagtcgatttgccatttcatttgctctatcatcgagtgacagatcgattaatcgattgacatcttgattaagctgggttaagaagaagaagaacacgtgctgatcaataactgacggctgcttcttctgacgaattaagagcggtagcagcagctagcttagcttcaaggttcagagaatgtggtcactgtttgacctgaggggggactctgacgatcgagcttgaggtgtcagtgtcactggctctctcgcagcatgcaacccgctcaacgatggacaccttgatcagcaatccgccggccgaaatagctttggctttgctttgattgctttgaccttatcgcatgcttcttctgacgagctagcttgtgcacctattatccatgtgatgcatgttgatcattatcggaaaagaattgtgattgataatcgttttgtcatgtaattaatgttttctgttttttttagagaaaagagctagttgcaaaggcattgtctgaagatgaacaaattaaagagagggattcaggaataacatgtttacttttacatgatgtcgatgtcactcaaaactctggatatctaggagaaagatcagatgccatagatgtttctggcgatctatccaccgttcaaagccttgagttaatgagttctgcctaatgaactagcttaattaattatctatgttatacttttgggaaagataggtatagcattttgttggttgaaaagacattctcagtaactaacaaaagtaaagcactgcgctctctctctatataataagactctaataagagagacatcacagcatctatacattctagcacactgtaatataatttgttagttttcacatatgcttttgctgagtgatacacagtaccctccctgatccacacgcccaacttgcctatatagctaatgatgctcgtattagtgaccaaactcattgcagccgtgagtttttgggcgtaaaattcccaggtttcacacccataaacatcatgggacccggtctttaagtactgaccttaaagcagtcaatttattctcctgcaaaggaaaaacaagaaaaaaattaacagcatgcatgcatcaaattaacctgcaggctatagctagtgaaacttgcactagactgcaagagccctcacctaaaaattccatcctactttccatcacaaagaacatatatactgatatagttatggcagagcaaatcataattaagagggagtttctggaaggaaaaaaaaagaagagctcttaattaaagatagtaattaagagaccatggtggagtgccaccaccagtacaccaacagcatgaaggagaagaggccgccaccgaggagaggtcagctcaagcggcagatcgcgaggaccttgagcaacctcatggtgccgggcggcggcaagcagatcgcagcaggttcagaggagggccaggctgcagcaaaagctcatggatgcttcaggcttagatgatgaattgatggggagagtatggctgattcaggttcaggcttagatgatgttagttgttaatctattttgtactatagtcgttagtttttgctttcagaacctctctttgatatcctatataatgctgtgtttgcaatcttgggttcccaacgtatataggagtagtgcgcacagaaaacggagtgttcattaacacgtgattaattaagtgctccctccgttccaaattagttgtctctttaggattcaaatattgtcccaaaatacttgtcacaatgaagtactgcttgtcccatcaatcacttctaattcaaaattttctcttttttacccccaaccatcctcccacatccaaccatacatcatttaataaaggccactatagtcttctttgtcaaacattaatccatactaaacaacctataaactaatatgggacaaaggttatattagctaattctttttaaaaaaatagatcaatatgatttttttaagtaactttcgtatagaaactttttatgaaaaatgcatcgtttagtagtttgaaaagcgtgcacacagaatacgatggagagggattgggaacccaggattgcaaacacagcatgcattcagcagcttcattatagcaggtataatagcaggctataagctagctataaacacattttgagaagataaaagatgagagagaagggcagtggtctacaaatttgtagccagctgcagtacagactccaaggtgcatgtgtgtataacaggtgggaccagatattaattatgtactatatatttataggtaactattgtataaattagttattaagttgactatagataatttagagccagcgattggctatactattaaacttgctcttaggagagttctgccaagtttagttagtaacatgtactgctgtgcatctctgaataaatgttaaggaggcttcatgtaagaattttttgatgatgatgatatacgatattagagtgaatttgattaactcatatgtgagtatttatggtgaattttgtgtactcaaccatgtttgaggtagcttctttacatcagtgcagctactttaagaaatacagaaatactacagcaggtattatcgttggaacggaatagtttatattaattgctaacgtcgtaataacgttacgaggacttcaacttggtacttctacctagatagagaatcatgattaccatggtacgtcaggacaacgctacgagatactacgctgacttcaaaatagtactactgatgtgtttagtttacacaaaaattagaagtttggttgaaattataacgatgtaatagaaacgttggaagtttatgtgtatagaaaagttttgatgtgatgaaaaagttaaaagtttaaaaaaaaatttagagctaagctcggcctaagtttgtaatacccttatacgggcataccaggtttggcagcatgggcattagatgtagtgccatgttgacgtcagcgatggtaggtgacatcaacacataaggtatcatgttagatcaacaagaacccatcctctagtcttcctcttataaagatatctaaccactacactggccaaggtcacctgtgacaggcccaaaccctcatctttgacggcttcgcgtatggtcagtgattagtggtcactggtgagtccagtcacctttgacgggtggccggccgtcacaggtgacacccacctctgacgggcaagttactataaagccgtcagaggtgttggtctccgctagcctaggacgagttgggacccgtcacaggtgactcatctctgacggccctttaaataaaggccgtcagaggtgatggtctccgtagttagaagctgtcacaggcgatctacctgtgacggccccaaaagtaaaggcccgtcacaggtaggtcacctttgacgggcctttatttgctagtccatacaggtgatgttacctttgacggatttttgttccgacccgtcactgatgagttaattccagaaaaaaaaagctaaatattggctagcctcaggatttgctagccatgccctctgaaacacagatacatcatagatatattccagtcaccccccaatataacatcacagatccatctcaaacatcacagatccccaacaacacagatccatatcaaaaattgacatcattcacatatgcagttcaaatgccacaattttgcacagcaaattcacaccccttgaaagccacaattttggtcgttgctcatataaccgcatatatacttaccaaatggattaaagccataatgtcctcgacctccacaacctgtcaataaggaaaaaaaaggagaaaacagatgaatagtacaacgtaaattgtagttgatcaaatttgatgacaatttagtaaactaccataaatattgcacatatgaaagtaaattacattgcactccataaaaacatattttttttacatcacaagaaattatgaaaacatctttttttacatcacaataaattatctagccaagttcatgagtctatttgacgtgaaaacgtcctttcttattcattatttctgccataatgaaggcgcacacttcgcctctgatagcgcggggaggaggggggagggagggttgatgggtgagatcttgaagccagctctacctttctgtttaataaataagatgttagcacgttttgaatagcaatgttggtattgaaatgagcttattcgccattagcaacaacctcagggtcgaaatctttcacctctcttagacgtgttgacatgttgtggcacacgtggaaaccatattggtctccgatctgttgtgcgcatgcgaacttggtgtcatggtaaagttcgtccttgccctccttgtgcctaccacccttttccacatatgggccccaagccatatttaagaccttggtgatttcagtgaaatcataatctttggacttattggagttaaggtagataaccctactccacttaggtacgatgactagaagaatccaatgtcacctgcgcagttgttatgtagcgttagtactaagaaccttaacttcaaaaataatatacacgaagggtattgtcctcttactcttggttgtgtgcgcacatgatgtactccttgtcttgataggcccataaacactggttgacatagtcaaccacctcagtgaagctctgtcgtaaattaacctcattcaccatggatggatcaaggaacccaacctgattaccaaggcgacgactctcgatccaacacaaccttaaaacatttatgtattagaactaatttaattaggagatatagtccaatcatatcacaagtatagaaggtatgcacttacaaggaatagcattttagaagaccagtgtccaactttcggatcctgaaaagatcgaagaggtcatcaaagcctatagttatataggcaggcgacaataggaactgctggtggtcgtgatgtccaattatggatgactccctcattttccgcttagcattgcttagctccatgtattgcttatgtagctctcggcaagcaatacccatcacggctaacacattgccctccaccaatggcatgcctagctcaaattgggctggcgccctcacgaccttccccgctttgctcaccggcatcgacgtcgtagccttgcccctttttggctccggcgccaactccccgaccttccccttgccgcgttcacgcttctggcccttgacaagtggtggggagctatcggcctttcttgtggtctttattggagccaagctttgagctatatctaccaagtccatatcagctccaccaggagaatgaggtactgacaatgccggtccacagggagcctcaattgatagcttagacttgggaggtgtaagctccgtcggtcgacttggacgaggagtcatcttcacaattatatcttctttgggccattgtatgaacgtcttgcgcgcatcgcccaaagtcatgatttcatcattggggggcacgggcagcggatagcctgaccaggtgtcctttactgtatcgatggacaccttggcatacccagctagcaggtctgtgccgtggaccttgtctgtaaccgagggcttgaaagccatgccctcagcaacttcgggagcgaaagttgggtggaccctcgccagtaggacacactgtgctacgccctgcatatgtgaaagtctgaatttaatattggaacgtgtaaaggtttttttattagatatggattggataacatcaattacctctatgtggtccactgcagctagtggtgtgaccgggagaccaggggacggcacctctgtggatgcacaactactcctatgctgtaacggactcgcgtcgtgttgtgcacgaggagttggatgcacagcaggtgttgtgcctcggggtatattcatgtcggcgaggaccttgttaaccctttcttccaccctagcattcatgctagcttctagttcttgaatgacctcaaccttaagttcggccttcaaacgagcgtccctctcttccttggtgacttttcgtttcctgtattgggagctgtactacgggagtccatgcttcaaggacacattgctaccaattcccctagtccggccaggatgttctttggttccgagcgcctttgtgaggatatcatcttcgcgcctcttcggcgcggactcaacctcgctttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23829 - DNA, 397 bp, Oryza sativa
tgtgtgtccgcatatccgatttgacacgccaaaactttacacccctggatctaaatacagcctaaacctatttaatcttcatctaaagttgtggtaaaaaaattcacgactgttggttctacatccggcatacaagactgttggttctacatccggcatacaagattgaaaaccttatctcatcatacctttgtaatcgggactaaaactgaagctagtaccaacgtataagattaaattgaagttgcataacatatcattcctactatatcaaagagtgcaacatacaacagatagatagatagatagattgtgctacacttgtgatgaccattttgactgcgaaaaagtgcaaaatctttagctatgtggaacacctcacaccccccaccccccc

SEQ ID NO: 23830 - DNA, 896 bp, Oryza sativa
gaggcagcggcgccagccatgctggcgccgccccagggaggagggcgccagcatggctggcgccgctgcctccattcctgtttctctgtatggagttgcaatgtgttatttttattttattttttcggatgttttttcacactcaggatcatgatacaaccaaccacaaaaaaaatttaaactcgaactaccacttagctaagtctgaaaatatctagtataccacttagtctactttgcaccttcactaaaattagaccataactcctttagtaaaaccctttgatcagcatgttaaacataatgcactctaccactatatgaaattacttaatctaattcaaaatataaccacatgaaatgacatatataagttaaacagtacatagagatgcaattttttttttattttatttttttgatatttttttcacacttaggagaacataggaaccaaccgtataaaaaataaactcaaacggataaaatatgtgacatgtagaattttccaaaactctaccgaaacggacaaaatatgccatctattaaaataggcgtaactttctcatacggactcggaatcaggcaaataatatatgcacggacatctacagaaaaatttacatccgattctccccagcttttccgggttcggcgatattaaaacctccaaattccgcttgcaagattgtgttttcgaggagagaagtttttcggtggagctttggaaaattccacatgccacatatttcgtccgtgtgagtttattttttacgtggttggttcctgtgagttcctatgtgtgggagccatatcaaaaaaataaaataaaaataaaaaagttgcacatctctctcctctgcactagttcggagagaggagaggagaggaaaaat

SEQ ID NO: 23831 - DNA, 55 bp, Oryza sativa
tcctgcagccccccaccatggcgaaggacaggaggtgcacggatcgtcgggtacc

SEQ ID NO: 23832 - DNA, 1519 bp, Oryza sativa
tttaaaaaataataagatagataaatcatattcaatttatacaagtaaaaaaaattgactgcacgtgaatagtgttcgtgtgagtactatttgcagtcactaatgagttatataccggccaaaaatatttcaagaatgtgatataccactaattagacgatttaggctgtgttcatgtgttatggttggaaacttctttcttctggacaagtagcaactcattccgtataattagttaagtattagtttaaaattaacttaaaactagattaacgtaatttttaaaaacaacttttctacagatgttttataaaaagaataatatttaacagtttagaaaggatgtgcgggaagatagacttaataatgcagccttaaaaccgtgggtaatacggactatggactatggtaattaaaagcaccttgtgttcttcacgcaacacgtgttcatacttacatatgcagtcatttccaaaggtcaaaagtccagaactatgccgttgaaattcggtgcattccgcgggccagcagagcacacacacaactcaactccgccatgcttgctggctgcggatcagatagccaagttgcaagcccagattgactactgcgatagtttcttgcataggtcagcttttcacacggcttttgtcttggcgtcggcatggttcacaagttctctggaagaagaagaagaagaagcagatgcttcctgcttctgctgctgctgcagctttcagatagatagattccagatggtccggtcagcaaatgccaaagtcgcaggccccggtgagaaaatgttgatagctgggttttgttcagagtagctagctgttgttcggacttcagactttcagaatctgtgaagagagttgtgattcttccacggaataagttcactttaggtgtcgtaggctgtatttagtttctggaattgaagagaagtttgggaaaagttgatagtttagaaaaaaaagttagaagtttatgtgtgtaggaaagttttggatgtgatatgatgtgatggaaagttgggagttggggagaagtttggtgtgaactaaacacacccttaatttattgcctaatttaattttcgtccttgatccgaaaatccagatacaaccatccctcaatttataaaaccgtgcaaacgagatccctcgataatattgtctccagttttggctaacgtggtgtctttgattagatctttgtccaacatagcattgatgtcattgatgtaacgtttacatggcagtttgatccaaaaaaagaacaaaattaaaaactaaaagaataaaacaaaatatgtgggatccgtcgttagccaaaaaaaaaatagtgggacccaaatgtcttccaatactcttcacctctcgattttgctatatatttgtcgacaaattttctcccaaaaattttacagatgtaattacagtacaatcgtagtgtaattacactgtaacttgtatgtaattacactgtaactatagtgtaacttgtatgtaacttt

SEQ ID NO: 23833 - DNA, 1988 bp, Oryza sativa
tcaattcatggggattttagaggattttatacatgaggtcatacctcatgttaatgacctcatggaaaactttcctttggtctatctctctccaaattcttatactttcatatggaacatttgaacaacaatattcgcacaattcttgtattttcaatttataaaataaactagatatgccatctcgattcctacgtttttagggcccctttgatgaatcgcaggattaggaaaacatacgattttgattggaatgtaagtgtaaaacagaggattgtaaaacatagtaaaaacacattaatgaccgtttgattgaaccgtaggacaaacacatgaattggatgagagagatggactcaaaggaacgctaccaagagattgaagctcttggtaaattacctccaaaatctctttaggattctccattccataaggatttcaaaggattaggccccctttgaatcacaggaatgaaaaaacgggggaataggaaaaacataggattctgataggaatacaagtgtaaaacagaggattgcaaaacacaggaaaaacataggaatgaccgtttgattgacccgcaggaaaaacacaggaatttgaggagagagaaagactcaaaagatttttaacatgaggtagaacctcatgttaaatttccttcaaaatttgcatgggaagaggcattccataggaattttataggattccataggattcattcctttgattcaaagggctatataggaaaaattcctataggaattaaatcctttaaaattcctatgaatttcctttgaatcaaagggggccttagataggattcaatcctttgtttcaaagggctttataggaaattttcctataggattgaaatcctcccaaattcttatgttttttctgcaaatcaaatgggccctgaatcgtagtaataaaaaaacgggggaatatgaaaaatataggattctaataggaatgcaagtgcaaaacagaagattgcaaaacgtaggaaaacacaggaataaccgtttgattgaactgcaggaaaaacacaagaattggataagagagatagactcaaaggaaagtttccaagaggtcggagttcttgctaaatttcctccaaaatctctataggattgtccattccatagaaattttcaaaggatactatgggaatcctttgcttcaaatggcttcataggaaatttttctataggattgaaatccttcaaaattcctatgattttccaccaaatcaaaggggcccttactgtttctatgttttttaattcctgcgtttgaaaggagcccaaacatgagctccaaccccatgtttttatttccttggaaaattacaaagcaatttctcactactctcactgaatctaaaggctcatttggaacacatgattcttaaacacactataatcgtaaaaaaacaaacataattgtactaccctagcatctcaaatcgtatgaattaataaagcatgagagaactacagaaatgattgtttagatgaaacacagaaaaacaatagaaatcagaagagaggtaaactaagtattatttttcaacaggttggacctcatgttaaaacttatctagaatccccatgttcatttttttgccaaaccaaaactagactagcatttggttataggcagggcaggctagctagaacgggtgatagtatatactccgtatcattgagccattgccattgctagtcgctgtttgtttgcgtatgattgagccattgcggcattgccaatctctgtttgtttgttacgttcgtgcagtggcatgctagcttgtcagtacatatactagctagctagtagcttccaagtatatatggatgggctccatttctttctccttgattcatggtcatggcctaacttcctctggtttttcgttcaacctgcttccgttcttttccgattgttaatactccctccatcctaaaatgtttgacgcc

SEQ ID NO: 23834 - DNA, 28672 bp, Oryza sativa
  unsure (1)..(28672): unsure at all n locations
tggtgatgcttattctctccgttccaaaacaaattcaatcctcggtgtgaatcgcgcccagattcaaactgaggattggattttttttttttgacagaaggagtacgtagttgctctcgccaagccaagcagcacgcaaccactagctaaataccagtagagaatttttattttaaaaacattttttattccaaaaaagaaccctaaaaacctatttccaaacctattttcaagtgtgacgaaacaacaccatcactcccaccgcatatagtgggcggccacactctaactagcatgaaaaacctcgtcatgcgagtcgtgataaaaaagttcagatttggatataatttgtataggagagttcagttttgaaaataaaaagttccaaaaaaaaattcagattgctttgtgccaacagcttttggccgtacaggggcagtcagtggcgcgtacgatcagtgggtttgggtggcagcgcagcttagctttccctgacgtacccgatcggtttgacttgaaatggtaggcataccgcatacgcatagccattacgtagtacacgtcgtcctaaattgcaatctcatatgcacatgtactgatgtaattacgctaattaaccaggagctacaccctccatctcgtattataagttgtttgatttttttctaatcaaaccttctccaaatttgaccaaatttatagaaaaatataatagtatttttaacataaaataaacaaattatcaaaatatattcaatgttagatttaataaagctaactagatattttagatgtgctatttttttctataaactgatcaaacttgataaattttgactggtaataaagtcaaagctactcactctatcctaaaatatagcagattcatcctataactataaaaattcgtagtaaaatatatctaattccatcctaaattgttacacagtgggacggagaaagtagctagctattgaatcggaaatctctccattcaaccgagatacttggtgctatgtttatatgcgttttgtccccatccaatcgatcgatattttgtgtttcaaaagggcgtggaatgtggatatatagatatgtatgtcactgtagcctagctagcaaaaatcctgctctccataccgtcgacagagaaggggcatcgcgtcccatttgtactcgctatgtctgcttcatctttttactagctctagctccctccttcaattcggtgtcaacactcaacatgcatgccgacagtatgcaaaattacgcccttgtttagttccaaaattttttttcaaactttcaacttttttatcacatcaaaacttttctacacacataaacttctaatttttctgtcatatcattctaatttcaactaaacttctaattttagcgtgaactaaacacaccctcagtgacttcacaattaaaaataaaactgaaactacacgttacttcacactgcctttcgaatatatacattgtcactatatagacactgttcatttttagattttgaccgctcatgttttgtaagaagatcatgtaaatacttaagttaaaagttataagtattgaaactttcacaaaacataatgtatcaattcaaacaaaaaaaaagaagtgttgcaattttaaatctatagtcctttaattaaaagaccccaatgatgatggtgagtgatgaatctcgtcaccatccttcatcatggtcacgtgggatccccaaacagtgatgtaggtaaactttggttccttttccaactccaagtcattagagagaattttcttttgaagtgaggaaaaatgatgacaaataatatgaaccggagattttacaatgacaataattttaattttttagcctttaaagtgtacgacaggtttttcttttttaattgccattgcaatgcacggacatttagttagtgactgaaaaattataaaacaaaaaattacgcgcctaaaatttactccacattgccaatgtgagaaggagtgtttttcatatttcatcgtcaccctttccccaaaaattatcatctgtagattaatcctcagggtcaacaattcaatttatgatgctgctatatctttgagctttgagggcatattagaatattaataaaactgttgcttcgtatctaatcataaatcttatatataaatatttcattttggaaagccttaaattcataaatggtatttagtaaatgtgcactagaaaaatatatagttgtgcataatcgtcctaatagaatactatctccatcctaaaatagttttatttttagcccatcctacatatactacaaaatttaaaagaccgaaatacccttcactcaaacaaatcccaatacatttatcccattttatcaagtaccaatatatttgtccacaacttttatcatgtctcaatgcatttgtcttaactttatcaaaccccaatatatttgtacacaaatttataatgtcttagtgcatttgtcctaactttatcaaatctgaatacgatgtttttgtaggacaaatgagtggaggaaagatgaaattattttgggatggagggagtaatagttacagtcatattatcgatcgtctgcatatataatcatttttacttcttttttttccttttgaagaaatgcgcaaaccattatttcatcaacaagaattttatataaattgatttaatttcccatgggaactgataaaacgaaaattcctgtgttcaaagttgaggtgggaaaactacaaccaagcatggatgtttttccctcatggtacctcttccttggtacgtcatggaaaatttcctaagcaagagtttgaaaggaggagaaacataatgcctaacttgctctaacatgctccccttgtttcctcccccttggactttgaggtttgaacaactccatcccatcctatactaatataatgcaatgctaatactagcactagtagtactatataactaagcttaacaaccatccctttttttaatttctattgtcacacatatatccttttatactactcctctgtccctcctctccctaacccatatatctccacccctcttctcccctcactcaccatttgctctcttctctcttctctcttctccacatcaccacagccacaccacactagctagtgttcatcatcatcatcatcatcatcatcatcttcttcttcttcttcttcttcttcctcgcttcgttttgctagctcgatcgtgtctagctggtcgtcgtcgtcgtcgtcgtcttcgccatggccggctgtttgcagacgagaagcaggaggaggaggaggcggccatggtggtggctggtggtagcggcgctgctgctgctgctgctgcaggcgtcgagctgcgaggcgacgcgaggcatgcagccgttcaaggggaggccgctggagagaggcgtctccaacaacttcttcgggttcttgccccgtggccccgcgccgccgtccggcccgtcccggcagcacaacgccattggagccgaggaccaaggcaacccatgaattcgatacatgtagagagagagagagagagagagagagagagagagagagagagagagagagagagagagagagagatcagagttgcatagatatcatcgaaattaatcttcttggttaattaattgtagctagcactagcagtagcacatgtagtagtagtagtagtacgtagcagtagcagtatatacacttcggcaagaagaagaagaagaagaagaagccgcaggtatagtacagtaggatcaaggatgatgtacatgaagaagcttttttttcttttccttttttttgggtagggctctctgtcaaatgtgttggctgttcatggcattctcttctcttttggaaaaaaaaaacacaaacactgggtgctctgaattttgttcagtcttttggtggtctgaatttcgttggagttatttcatatctttactccactctttggctttgctgccatcccttttcggtgcagagctaggtgtgctgctgtgtgtgtttgatgcctctgctgcaatcactccttttctttctcctttcctgcttttctaaaagctagaagagatcgagtacgagtgtacaacaactacagctatagctgcacacatcagttacgtacatcatgcagctactgcttggctttctgatgatctgcatgcgtagttccgctgctgcttcttctccatgcatgcaagatctgaaatctgatcgatgcgagaacagaggactagactactagagaagagacacagagagagagagagagagagtttgtgtgtctgaaaatgaggcttttttgcagcatgcagatggtttgatgatggatttggttgttgaaaaaaatgtcgaagaagagagtttgggaagggtgtctaaccattgatgtagtactttttgactgccggaccctccttctcttttcttcattccttttgtgtacctccatcttttaatcgccataatttaatccactattgtgttacgtactcatgatctgcatctaggaaaagaaagaattactattaggcattaaggtgtagaactacatgaaaaaagaagtgattttgcgtaacatttgtgatgcaagacacatacagatacagtgtgtatactgctgtttctatggatgctgtctcagtaatcttcaagtttaatttcttcatcgttgtcaagcatcttccggtttatttggtggtaataatggcgattatttgcaacccaagagcctatcagagtagatgctgatgcatgtagtcagattgcattcacatacatacaggctagtactccaatgtaatcttggtcagtcattgactactgctatcacgttgaatccaatccaagattgattatgttagtcgcagtagtgttaggcttccatggaaaaaaatgtgttcagtattcagttcagtaatctgccttgttttcaacgttttctttttgacaattcttgcacgtcattttagagattgagatggagaagaaaaaaacaattaggcagagaaatcacggcggccggccgctacctctcagcagctgaatggacagatcagataagaaaaggggcttcagtgtcaacagcgaaagttcagtgtttgcaatctcgaccaaaagcgacaaccatgtactaaccctttttttagataatggaagtggtaactaaccatgtagtacttactaactaacaacttaattccttttctggactgctaattaagctagtcctaatctagtcttgatcactcttgctacagatactaaatactactaaacgagatgcatgcatgcacgaaaggttcaatcagcttcttgcgcagagcgagagagagagggagagttctgagagtttttgcttgcgaagctagatgaaccaaaggaccattctttatgtcttttgcaagtgatgtgacaagaggatgatattgcatcaatgtgtgtgttctcaaatgggccccttgttttgcgtcctccttttcttcgacgatgacttgctgccaactgcacaattctctctctctgaatctctgaatgtttggttcgtcaggaaacagaaaagcaaggggcggtaggccatgaagcaatccaaaccggcacgcccggttgacttgattgcctgcacagtgaacgtaccacgcactcctgatcaaattactactgtcttggtcatcgggtcgatctgtgatctgacgggcaaggcaaaagtctttgcaagagagtggttgcgaagttggtgaatgagattgtgtgtcgaattgtatctctcttctgaactctctgaagtttcgtttttctcttctcctggtgtaggaagcaacatgttgggattttcttttaagaactgacgacaggagttccaccggatatttaagaagaaaagagtgttgggattgggattgatatgtaggagtattatttttcagtcagattgtgtaaacatgtccgggcttctgatcgtacttacgtacgattctgatatcgaagcttgcttgcaaattgcaatgatgcaatcacaacaatcactatgcttgattgttactagtaagagtaaaaggaaattgattcttaagatcaagagtgatatactagtttgatcactctttcatgttcaggtctattttcgaaagaaacagtctactgtggcaaaagttatgagcacaatgtaggatcaaattacaataactaagccaaccagaggggggtgaatggttggtatacccgaaaaccgaaaacttttagcggaaataaaagttatcctcgaattcgatggatcgcggtctgaccgaagttgtcctgccggtctgaccgcctggttgtcgtcggtctgaccggtgtagatcgattggtccgaccgccaaagtcgcctgcctgtgcctgtcgccgctgccggtctgaccgccgtgtacccgccggtctgaccgccgcgattccgctggtctgaccgccggtgtgtcgccggttagaccgccgaaacccggtgaaacacaaatcgacgaactctcaaagtagatgacgactttattgattctctctgtgtttacaaagtgcaccaacagcactccttacaaaaatttcgactaaactcgaaaccctaactcaactctcaactcaattgctctcaaaagcgataccaggaagcttcacgctccccctctatttatacccgaggtaggcagcctaaagcacgaaccaaactcatattagaagtcctaaacaccttaggaaaccctctagtacaagaaacaaactttacaaaactaataataccaaatttgtactccttccaaattcgactccgcatcccatacgcacacaatacctccatcgtatgccatatatggaatcttcaccaaccacatgcatcaactctagcctaagtatcccgcatgatctctgaccaccacggacgtcgtcttatccccaagccgactcccggtccatcaccgtaaatactctcccgaggcatcgagtcacctacacatgaaataaacaaggaaaccatattccgagaccaagctatctccaacttgactcattagtagcaaacaacaatattacatacgtatagtatccatctagaagccataatcatgaaacaatcacggatatccaaacaaacaacccgaaaccaaaaccgacacagagtcggccagtcagaccgtgggctgcaccggtctaaccgcgcgatacacgccggtctgaccggcaacgactgcccggtctgaccggtcacataaaataacagcacctgtaatttacctgtaaatccaatcatctccaaaaccacttcgtgaataaattccaaatatcaaaaccaataatctccgatgccaattgttcatcacagaataataataaaaagcacctttgattttacacacaacgccgctaaatatatcttttaggagagctattgttggccaaaagctaatcgagtggaacgatttgatcctcgggctaatataactctgtcaaatgaaaagaatagctttgtatggtcgctccataagaatggtcaattttccatcaaatctatgtatgccacgatcatgaactgtaatgttcggatcaaaaagagaattctgtgggacttgaaaattccactaaagatcaaggtctttatgtggtttcttcataagaaagtaattctaacgaaagataataacctggctaaaagaaaatttggggagagggggagggggacaaacattgttctttctgctatgcacaagagacaatccaacatcttttctttgagtgtcatgtcactcagtttgtttggagatgtgtgttttttgcttttaatatcccccaccccgtaacgccaaaaacattttcggtaattggcttagagggatatctaggtccattaaaaagatgattctaattggagctagtgctatatgttggttaatttggtgttgtcgtaatgataaagtttttaatggtaaacaattatctaaccttatacaggttatcttcatatcttcctactagctccacttttggtttacgatgctaccacaggaagagcaggatactatgcgcaatggtgctatactcttggaatcggtagctaagggtctcttgttccactatgggtggcgtagttctattagaattgctagctaaaaaaattttatgtggtttaacgctagtcaataataaaggggagttggagatttgtcccatcaccttatttctcattttgatttacttttaccttacctttttattactattaaacttatggctgtacttatggctgtgtgtcttatgacagaaagccagagatgtaatccattttcattattaaaaaaaaatgttcaggtctattttttctacctagccaaaccgttgcagaaattctggtactgtatatacgcacttgtaaatagtacaagtagtaggagtaagcagctatgagcaagaaggcgacaagatgcaggcgaaaaggccgacacacgagtacgatcgatccctgctcgatcgaatccgacagatcgtaattgcagcaccctgcctgcctgctgccaaaatctagcaaggactccatctgttaccagcagcgaatgttttttcacgaacacacataaagattgaacgcagtggcgtatctagaaaattgattcgttggtgtcataatgtatctactagtgtcatagtatgctaattatgcttagatcatggtgctataatatatgaataagtagtttaactataggttttgccaaaactcgtcagtgtcacctgattccagccgttacactgtatatccaaccctgattgaacgtcagtatataaaaagaaatagagttttagttagtagcaacaaatgttttttccatcgtttaacaaattgttaggagcatcgctcgactaacaaaggaaaaggatttgaattcttaggatgaaattcctctgaaatcatttggaagagaggactgatgcatgaaaatcctacgaaatgaactaatttatatagagatttgaaggaaaacatacatgaggtcctactcctacctcttggtggtattctattctcgtgtctacaattacttcgttttccctgtgtatcacccaaatgactatttttaagaacattcccatgtttctaatttcccgagaaattcacaagatatgatatattaaacctacgtttcttgtgcttatgttttttgaaatcatgtgttgcaaaggagccgtcagttcctgtcaaaaatgaaaggctgcctaccaagcacgaacactgcagttgggccttccacacgatcggtacgaaatgaggacggccgcacgtgcataaaaagaaaaacaaaaaagaggagaaaaacaataaactaaacaaatttactctctcccaattctaccttcctttcccggttcagctgtttctcttcgttaattttctgcctcgaatctatctcagctctattctcaaaccatatatatccaatgaagattgtgatcctctaccgttgctgctcgttatacagtagcgttgaacgtcattgtgtattagctagtagttccttctttttatattataagatgttttgattttttttctacttaaatttttctaagtttaactaaatttatagtgtggagtgccttaaccccgttatagagttgatggcgaacagtcatgtataacggttggctcgatgttagtttatgtcctctaataggtgtgtaggagtcgtcagggtgtggaggtgcgattttttcacttttcctgattatagttttctaggctgtaattttatagttttttctatattaatataaaatctcacatcatctggtgtagttagtttcaaaaaaaaatattgcgcattagctagtagcgttttctatcgcttgatctaaaatgaatggtctaaataaatgtgctacaatgttcctacaacccagaataaaacagcacatcgtggctgcagtagcctagtattgtactatgtactactccctctgtctcaagttatagggcatctcttttttaaaaaaaattaaacttggtaacttttaactaataatcatactaactatgtatatatactaagtattatgcatattatatcccttgattcatactatatatatactaagtatgatgctaattttaaatttttaagaacataatatgaaataaattaaagtcaaaatcaataacaccgtgtaaaaaaatatataggcattataatttgagacggagtgagtaataatcactacgggtaactcattatattgttatcgcagtggtaatttggcaattattttactccgacaaagctgactatagaatttttcaagtcataaaaatcgtggctaggatgaatatagtgacacacaatagccgagctgaaaaaatctactttctccttttcacaatgtaagtcattctagcatttcccatatttatattaatgctaataaatctagatagatatatatgtttagattcattaacatcaatatgaatatgagaaatgctagaatgacttacattgtgaaacggagtgagtatttcaaaactatacctacatgtttatgaatattttgataggtaattagccatcccacgcaatgcatatgatttgataactgaaaatccatcacctccaccaccgctagttaggccggcagcttggcgacttccactaataaatgtaagaataaaacactacagaaagctttgtcatctcgtaattaacctccttttctagcattttgtcggaataaactactggggtgtcacctatccaacgggtgacaccgaactggggtgtctcctatactggggtgtctctctttggagtatacgacatctatcctgataatgaactgctgctagggcaacatgggctcgtggacaacatctgttcccacaagatttataagttgatgtcctaaattgcacaaagttcattcattgacagtgcaatttacataaatcatttcttccacttgaaacctaattatgtgctttgtgctattccgtccatgcccatttctggagcttcaaaaacctgatttcaaaattaatgtacatgtttacactacgtcagaactattcacctctgacagcccagcagtgatgggccaaagtactcatcaaggatagccttacctttgataggttcatcgggagaccgtatcaggtgaggccaccggccgcggcccgtttaaaacactttgggacccctagcatctcgtattctatcgtttttttataacttaaggcagttttgaacaacatatcataaaaattggttactacgccttgcatctactcaataattgctactttgtatctttcaattgttttatcccttttttaaatggcagctcatcgttcttctttaaaaggcatatgctacaagtaatttgggtaagtttacagcttcatgtgcaatgcaagaaattgggtaagtttgtggcttcacaagctcaaaagaaatgtgaggtaagaatgtgcattgggaatatgtgactgtctatgtaatttttatgggattttagaatgcatgtgtagaatgttaattttgggatgcatctgtgataaattgtaaaaatatgtgatattgggtgtggttggaatatctgtaatgtactgttttttagagagcatgcctaccaaatactgaggctagcaaatatttagaaattattttttttccgaaattacctcatcactaaaggtcgtaaataaagaccgtcacaagtaacctcggttgtgacggttttggtatatcactccgttagaggtgggtaacttgtgacaggcgccaaagtagattcgtcagagatggggtcatctctaacgggccgtgaattttgcacccatcacaggtgtctcagctctaacgggttacaaccacatattgatttgtggagatcctcacttttgacgagccaaaaatatacgggcccattagaggtgtctgtcgccattaacggggtgagtgtagtcatcagtaacaattcatctctaatcagggtcaaacccatcaaagatgatggtgcgcgagtccgtcaaaggtgatctaatccggcgtagtgttatgaattttaagagagttagggcatcccaaacaataagggtgtataactgaaaatccacccccatcaactcgttatgccggcaaggaggcaacttggtgacattccacttccatgtcgttgtcggaacatttcaaacgtttgtgccagcaaattagcgacatcttcaccggcatctatcacgatcagtttgtccgacgaccagcaccgcggtgacagccaagatttacggtctgatattatatatcgatatgtgcactgattaattagcttccatgaacattcatgagctccatgattaggcatcgtcctcctctctacagaaaaccgagcaggaataacgtttcaacatgaactactctactatatgcagaataagagagctagctaggtcgaggacctaattcttttctgattaattaagatataaatttttacctcatttttattatcacattttttaaacagctaaccggtatatttcgtacatatattttaatatagaagatgttataaaatatagagtaaatttcacaaaactacatatattctgatcaaattatcacaaaactacagatgtaaagtgatgtatcataaaactacagatttagcactaaatttatcacaaaactacagatttaagatggagtatcgcaaaactacaaatttaataacaaaattacagattttagagtttaaatccttagcattagtgttatgtttgagttataaacgtgcaagttttgtgattaaattatcactaaacctatagttttgtgataattttattactaagtatatagttttacgatattctaccttaaatttgtagttttgtgagaaatttagtgttaaatctgtagttttgtgatatatcaccctaaatctgtagtttgtgataatttggtcaaagtatctgtagttttgtgaagtttactctaaaatatgaagtaaatctaatttttagagtttgaaataattaaagtttaataaaccatggagaaacaccaggggtgttccggctaactccacaaagtggtaggctaggcgacctgggttcgaagcctcaccccttctaattattgatattaggttttttcctaacattcacgtcttatttgtaggatcgaatcacaataactaagccaaccagagaggggtgaatggttggtatacccaaaaaccaaaaacttttagcggaaataaaacttaccctcaaattcgacggagatcggtctgaccgagattgatctgccggtctgaccgtgtggatgccgtcggtctgaccgatatagatcaatcggtccgatcgccgaagtctcctgccgcgcctgttgccgtcgccggtctgaccgcctcgctcccgccggtctgaccgtcgccttgtaaggtgtttagaacttttagtatgagtttggttcgtgactttaggctgcctacctcgggtataaatagagggggagcatgaggcttcccggtatcgctttggagagcaattgagttgagttttaagttagggtttcgagtttagtcgaaatttttgtaaggagtgttgttggtgcactttgtaaacacagagagaatcaataaagtcgtcatctactactctaagagttcttcgatttatgttttaccgggctttagcggtctaaccaacgactcaccgatggtaagaccggcggcaagctaggaaaccctctagtacaagaaacaaactttacataaccaatcatactaaatttggactccttccaaattcgacttcgcatcccatacgcacacaatacctccatcgtatgccatatggaatctccatcaaccacgtgcatcaactctagcctaagtatcccgcatgatctagaacgtgtattttaagtgtgcattgacacatctagaacaagtggttcaagtggtaagacacattcctactcctagctaagtgtgggttcaaatcccatatgctgcagataaaaacccatgctcaccgtatttttttagtttgccatattctgcatcatatacatgtaacatattaacaaaattattttattcaaattgaacaaatcgtcttttgggtttgattcttcttgcaatcacattttttatttttctttgcactaaatatgtttattttttattgtttttaacatattaacaaaattattttgttcaaatttaacaaattgtcttatgggtttgattcttgttgcaatcacatttttcatttttctttgcactaaatatgttttatttttttattgttttgggcaaactagcgtatgatgaatttaaaatcatacattgtgacagtcgtgataaaaatgtcacgagttagcgggctgtgaatatccactgggctcatctgtgacgaaaaacaaaatatcgtcacggtgtatgtttgtcagtgatgatatgtaaatccgtcaccgagaatccgtcacggattaacaagtttcttgtagttaggaaaccctctagtacaagaaacaaattttacataaccaatcatactaaatttggactccttcaaaattcgactccgcatcccatacgcacacaatacctccatcgtatgccatatggaatctccatcaaccacgtgcatcaactctagcctaagtatcccgcatgatctctgaccaccacggacgtcgtcttatccccgagccgactcccggtccatcaccgcaaatactctcccgaggcatcgagtcacctacacatgaaataaacaaagaaaccatattccgagaccaagctatctccaacttgactcattagtagcaaacaacagtattacatacgtatagtatccatctaaaagccataatcatgaaataatcacggatatccaaacaaacaacccgaaaccgaaaccgacacagcgtcggccggtcagaccgcgggctgcgccggtctgaccgcgcgatacacgccggtctgaccggcaacacctgctcggtctgaccagacccaattccagcagtacctgtagattcacctgtgaaatccaatcatctccaaaaccacttcgtgaataaattccaaatatcaaaaccaataatctccgatgccaattgttcatcacagaataataatcaaaaacacatttgattttacattattaaccatgtgttttttctcgttttgtgtatgtcaacacttaatcttcatccgttatgttattgtcgaacggggctatagctagcaggaggaggaagggagtggtctatattgccatcaatcgatgctactatgttgcttaaaggcgaaataaagctcgatcgatcgattggcagctgtggacaacatgattgatcattctcttgtgtgcgacaacacaaaccaaaagctagctaattaaatcgatggacgagggacaaatcatacgtatatatatgctcgtgcatttgcgagagccttgtgaaactgttgtctacgatggatgtacgtgcagtgccagtgagttgacacttgatagagaattctcgatcgccctttccagggtctctgcatcatgcacgagactaattaaaataatggttcgatttactggaaataataaaggtagaatatacgtgtgtattaaaaaagatgagcatacatatatttatattatgagtgagtgtgtttgtactacaatatttctaagaaaaattaatcaccatacatgcacgctgaagcttctgaatctcagaacctgagaggagacggaggcgcatgtgaaaatttaaaattcatcaaactactaccgccatttttaatatatgaggttcgaaataaccaatatgacatatagaataacagagagaaattcacatccagacaccataacacatacggatatatggctctatcaaatctcacaagaaagtgtcatataactcataaattacattgctactcttatcaattgcatcataataatcgttctcaaaacaggtacttcctctgtttcatattatgttaatgaatataaatatatatgtgcgtctagatttattaacatctatataaatgtggacaatgttaaaaaatcttataacctgaaacctgaaatggaggtagtagtacaattccttcaaaggaatagtactcaatgaagaaaggaaagacgtctctaaaaatattttgaatatcacaatgaatattttaataataattctaatttttatatgctaaaacttcgtaaatggaaacgtagagagtactattatattttttctcttaaaatcatgagagtgctactatatatcggaagcaccaaagagggagaggataaacacggaataagttcgcttcgtgatccttaaatgtgatcgaaatctaatccatgaccctaaactacaaaaccggatatctcgacctccaaacttctaaaaccggtgcaatttgactccctcagtggttttggaggatggttttgctgacatggcgccacgtggcgcttacatggcgatattgaccgagtcttcgttccacgtggcacttacgtggcagcagaattaaaaaatatgtgtgggacccattagtcattcacacaaaaaaaaaaaatgtgggcccactgacatgtgggggccacatagcagtcctcttccttcttcctccttctctcccttctctctctttctctccccttctctcccatgctatgcataggcgctccgccctgtagctcacacaacggcgccaccgcttgcgcacggtcgcgacacgccactgcctcagcgcaggcgaccagcaactactgcccaagccgcatccggtcagctcctcctcctctgccaccgcagctgtcaccatcaaccagacaacatcgacggcggcctgcgtcggcggccatgatgggtcgatggctgatacatcaagctgaagccatcatggtggccttgcagacccttggagacgagctctacatgtctacctcattgccatcaaacgttgcctcgtcctggaggctgaggctctgcatctgttgcgcggcggcaacgtacgccggggaggtcggtgttgttgatgtggttggtgcggttgcaggagatgtgcggccaggcggcgttggggtcccatcccagatgaggagctcgccagccggacggcagcgccgcgcgcgaggaggaggttgccggccgtctgcatgctagggaggtagacgtcggccatccgcgcggggggaggagcggcacgcgcggacgcgcggaggccgccgctgctcgttctcatcgcccgccgcaggccaaaggggaagaaggggagagagagaagggagagagggaggaggaagaaggaagatgattgacatgtggaccccatatttcttttttatgaatgactaatgggtcccataaatatttttttaattctgctgccacgtaaatgccacgtcaacgtcacgtggaacgaagactcggtcaatatcgccacgtcagcaaaaccaccctccaaaaccatcgagggagtcaaattgcaccggtcttaggagtttgggggtcgagatatctggttttgtagtttagggtcatggatttcgatcacatttgagggttacgaagtgaacttattccggataaacacacacaccgacacacacgcagaaataagccgatcagcggcagatagggcaggtactagcaagtgttgccttttgaggcccacatgcacaagttcatgggtttcgtcgccatgttgttgcgttttaagcccattttgtaccttgatggcctttaactagtcgggccgagctagtgcatcattgttaaaaggaggaataagttcaccagcatccctcaactttacgttgagtttgtgtgacatccctaatcctcagtatcagaaatcttcacccctaaactatataaaaccgtgaaatttatgtcccatggtattatagatgtctggtttcgctgacgtggcattctagtcaacaaaaagaatagaaaaaaatatgtgtgcccacatgacagcggccctcttctttcttctcttttcttcccaagccacacggccagccggagagggtgggagaggcaaccgacgggagatgggcgaggggagaggcggtcggcgtgacattggcgatgggccatcgcatgggctactgctgcaggcggtgtgctggatctacggccggcggcgcctcctctactcccaagagcgggggtcgctgaatccgcacaccggcagcacccgccccctaagccgctgccgctcgcgagggcgggggagctggatctgtccgccccaaggccgcctccacctccacctcttccaccgtgaccggctgctacgagcacatacaaggtgatgtaggtggcgataagcggtggtgttggcaaagtagaggtcctggctcccaccggtgatggggatgaagacggcggcatttgagttgaggtggccacctgggacaggtacgactacgcaatcgaagagaatgtcgaggtcgaggtcatcgtgatagtcctcctcaccatcgtggttgttggggacgacgacgtcgtggctgcaggatccctcctcttggccgctgctggggatgtggcggtggctgttgtcgatgtagtgcccctcatcctgcgcaaacctgtcctccaccatgctgctggttggaagagtaccaaaaccagccgcagcaagggtctggtcgcgccggtgctgaccttggagcccgacctaagtccaaggtaggcttgccggctgcccctctcccgccggctaccgccctctccctcgaggctttggaagaaaagagaataaagaaaagggcgctgacatgtgagcctcacattgttttaatttcttttgctaactaggatgccacatcaacgaaaccagacatatatattgctatagcacctagattgtacggttttgtatagtttacgatgaagatttatggtattggaaataagggatgacaaacaaactcgatgtaaagtttaggaaccgcaggtgaacttattcctaaaagaaaaaaaattttgggcttcagttccaattgaccagctcacaccttccatgttttccgtcgacccacacggtttaaattaaattaagggactacctatatgggtgtcgttctataaattgttaactaaaaaacgctaaaaaactgtcgatgtaactaggatgtaacatcgtagttacactgtaactacacattctaagcagaagtacaatgtaattgtatatttggatatggttaaattcttatatttgagtaattgtatattcggatatggttaaattcttacatttgaattattatggtgttaaattaggtataaatatagattgtatgttgaaatagaagagaatgagaaacgagggctgagaaatgaacgcctttggtgccagcttgtaaagggtcataggtgccggtttttcatgcaacactaattcaacaatgcgtactggcaccaatgataaatttagaatcagcacctttatgttccaggagccttaaaaaaggccgactctcaaccagctcgaattgagtcgattcgttgaaccctcatgtccttaagatatcatatcccccaaaatgatgcctcagatccctgaaataaagatgaatacatgaacaaccatcaatattctatataggactttgtatatggtgagcccgcctagccataatacataagtataaggtatctcatatctagaacattgacacaatcaatcctttgttttaaaatgcttcataattatttcccatatataggatttaaatcctctacaacttttatgtttttctgttttgttctagaagggacctaagtagtagcatgccatgcatgggaccaactgaattactagtagaccaagaagaaacaaagcttctgtactcctttttgcctttgccacaaccacaaagacggccgttttcgtttttaggctgaccgaattggctttttggaagcttgatagggtttcagattgctagctagtgctgcatttagataggggagaagaaattgcagtgtgtagagtagtagtagataggaacaattgtactagtacatgttaaattggtcctagattgttcgtttttctccctggagtggtagggatgctgagattttgggggcatatgcttttggaatggctggaatggaagggatgaagtgtgtctgctagctgctgccacccatcttctctgctgtgatgtgaagacaaactaacaaaagggctaaaggcataaagattacggatatttaactaactaattaattaagtttattctttgtcaattactcacttcgttctaaaatataagaatttttgttatttaaattttgtgtcacaataagcattcaagcactggcatcttcattttgtgtgtgtgtggggggggggggggttgttatgcaaataataaaaaacatcttggtaaaataacgattttgtaggccatggtgctgaaaatatactgcatgcgacgatgtggcaaccaagcattttccataaatagccaattatgtacaatttaactgtgacaattaaatggggacggcctatacaactttagcaagaaaatcctctcccatctcaatctattttatcatccctcaaataaagattattcaacgggctagatcaactctcaaacactgatacacatatataaagagagaaaacctaatcctcttgttttcccacattccagtcacatcaccccaatccccgctgcccagccccttctatgcgcctccttcctcaacaccgatagccaacgccggcgatgccgggctccccaaaccgtcactaccgccacccaccaaaaccttttgtcgctccctggtgccggtatcctcttctctgtaatcaaccacccttctccacaaccacggtcatgaagcagctctctagtaaggttccccaacatcgtcgatctctcctacctccagcagctctcttactaccatctaaccagttggccaagatgcctctactgcttgcaccatcctccaccgactatgctgctttggcggcaccaccgctggcttgctaacgacaccccctccccccaacccgtattcaccactatcattgggatctttcccccttggccccaaccccaaccctaaccccggaagctaatgagtggatggagaagatcccatgctccataaattacaatattgctctaattttttttatcaaatgccaattagcaaaatctgatttaaatatgttactaccccttgtggttagaaaagtgaagccagaacaattgatctgtttttcaaggaaacaaacgtgtacatatatatatggaatcaagagtgtcttcagaaaattctttttccaaaactgtgtgcagaatgtattccctactatttaattgtacttcttctgcaatccatgttgtttggctactattaattggtccattcactgaagtagatgcttaatgcatttattgttagaataaatttctatggggggcattaacatattatggctattatgactagttgacctaaaaacaaagcgatcaactagagttgtattgagatctaagcatctaattaattatatggaagcgtacttttatatatgtgtagagaccggatattggtttcctattatgtgatgtgttagaatagaaatccagcaacttattggggcacacgcaccaatccactatgcctcgtcaatagtttaagaaattaggtgtgcctaatgttttggtgttattcaactcatgattatggctacagattttggcacgctttcgcatcttaactaacttataaggtggatttattatgacgttttagttcttcatgtaagatcctaggttgataattccgacatgcatggtgcacttagcatcagagccatcgtttaaggtatatttcgcggaataagagaaaggcatatttgcaaatgaaaagtaatttgtgaataaaatttttatatatgtgttcttagcgatctaaaagcaaaggctgaaacataaatttcgatgaaaaaaaaactcaaaatcagcttcaaatttaaggttgaaaaatttaaattttggctgataagtataagaaaaagataaggctgcatattagatggagcatggaacacatatttctcttgatataggtttgtgataaggttggaggtactctatattaactattgcaattaattagttatatttgttgccggaacgaaacatgtgtttgtacaagttaatattccaagctagtcgttcttttgttgcatgcacacataatcttgtttgacaaaatgaaaagagagatcgagacgaagtagcctcaaataaggaaaagaatttggcatttgcaagatcctgtgcatccatccattgtgcacttcaaatttaccgtgcgaattaaccgtacgtccaacacgaccctgaaactgtataacaactgtcaactattaccataataaattctcagatcaatcaacggtacatcgtatgtatgtacgactttacacggcataactctttgctagtagctatagtatacagcgtgcgtcactggagatggcgttttggagtgatctagcttaggccagaggctgtcaccgtggcagacatgaaacaaaatatatgactcacttttttattattttttctgggaaaataaacctcgatcactttggtcgccatcacgtacgtatacgctccgtatgtcatgccagccagaagttttcttgcttatgaaacatgcatgcatctttaaattttataataaatagcaaaaataccagtgcgttgcaacggataaaaataatttacatactccaattataatgactttcaagtttcaatgttagattgttagatcatatatatctggctcaaatcataattatattgatacatattgattgaatatggtgcttctgcatggggaagcgatgcagatgagaaaaaaacatgtcctaagcgcaccagctgcgttctcatgcatgcacgacgtattaccgagtcagaatcggatggctacattatcatgcacgaacgacacgtcgctttattgagtcagacgactcggactcggacgacgctttgccttgatatgccagtaaagcgcttgcggcagccccctctgctcgagccatattctaccctaatacgggcatggaatttttccactgcgttcccaaaagatgtataaattttccccaattagacccttgataagcatgtgagaattcgcaataacacatgagaagctgagatgacatagaagcgatgtaacatggacctgtgaacaagattgaggatggagattgatgagttaaaaaccggccaaatagagaaaagttttttaagaaaacaataaccacattgctctggtggctagatgagcgcagcatgtagtatgtaccctaggagaccggagtttgaatcccacacacacatgcatgtatccctgatttttgcatagtatatagtccacgtcaccggtagatggttttcccagtctttttcttgccggtagacagtttttttccggtccaacagtcgtatcgctactatatggtttttttagtccgatccgggttttatatgtgtttaactcggatgacggacgaaagctaaggtgagtatggaatcatcctcaatttttataataggtaaagattattattattattattattattattattattattattattatttggactgggcttcttttattattggagtcaacaagtaaccgtccatgcagatatgaggaggtcactgttggtgtcgtacatgtcgtccattccaattcttttatacactttaaatccgttactccctccgtcccgttttgtttgacgttgtagttcattttaaaaggagtctaaatgtttgacgctgcagtacaatcagaaaaaccgtttccatctttacccctctgttcgacggcgacagtcaccttcctcgccggagacggcgtggagaagcaggggatggcggcagcaggcgcgggacgacttcgggagcgccgccaacgacgacgctagcgtgaagagtggcagctgcgagatgagccgctccatgtccgccgcgtgctccaccaacgcgggacgcaccacgacgggaagcaccggcgcagcagaggaagacgccgacgacgcggcggagaaggccgacgagccccgggcggcggcgtggcggcacatgtggcagatgaagtagtggatggagacggacgccaccatctcgtcccatgtcctccacctccgtcgtcggccaccatcggcaccctcctctccggcgacggcggcggaatcacagccgaagacgacatcaattcctccggttcttgaatctcctcctctctcgctgcgttcttgcgttcttggtggtgaagaggaaggtgagctagcttagctgctgcacttgtctgtggcttataaataaggtttttggcatgattcatccagcacacagtggatgcccttgctcatctttgctgttgtcagggacagggaggaactgagaagttcagaaatgaaaaagggaaatgtaggttggttgtgagatgatgagttcttcagacctttgtttgcctgagaatggtagttgtctgctttgatgaagctgtaacctaaggtttcagcaaggagtgctactactgtcctgcgaattcacagtgaaatgctgaattcataagaactgtcataaattctgctaaggggacaaaaaaactgaagtaaattcaagatttaaaaatgaacagtactattacaaaatctgaatgtaggtctgaaagtcacatcctaattgctcttggattcttcctctccaacattatcacaaaatctgaatttcaacatgcacaaaatctgaccatattgtcacttttcaggcctattatcacctcacaaaatctgaccatattgtcactttttagtcctattatcacctcacagcaatgacgcacaaaatattgctctactaggagatgaagccaggaaggttcaagcagcccagcggcaaacatggtttctactgaaggattaattcagattttgtaaataaaatgaaactcaagaactgagtacactcaatacatactcttccagttgaactgcaactgaacaagtctgaagacactgtcagcctttctttgtctgtccgagcatatctgcccactgaaaattactgagccaaattcaacataagatgatctttgtctgtctgagcattatataactcacttgtttgcatagctcaggagttactgtcctgttgcattagatgatgaatgcacttcttctggcagatgatggtctgaatcttcttttcccagaagattggacgttgaaatttgataaactagtgtactactgcaaaagagagtttttctgagtgggcaatgaagggagtaaatcatcagaactgctatgaaatttcagccgaaaaactggcaatccaagagcagctctgaaaatactgtaaaaacacaaacttttaaagtaaaatctgaatattgtaaacacaactgattcattcttccttattcatctttagaaaaggagatttgaatgttctactgctcacctgcccggccgagtcaatctatagctatttcttgcacaggataagcacaatttggcagatgcagcagttgcagcgtgcctgaacctgataaatgataaggttttacagtgttcatagatcagtggcaaatggcaaatggctcaggtgatcgatcgatgccgttgtaggtgaaaaggagggcatgagatcttactacaagtgttgtaaaattttgtccaaagattctgctgggtctcaggcctggggtgcccaattatgagtagcggcgtcgggagagagcgccggcggctccggcaaagaggggtggcggcgacggttccagcgagtacgggtggcggcggcatcttggaggtgagccccggcggctgggcgtagcggccggcgtttccggcgttgggggtggcggcgtttccgcctctttcttccgtcgcgggctcgcggcggcgactcacgcgttgagaggagaaggcccagggcaaatatgtaatttcacacgttccttaattttcacgatctggtcggaaacgtcaaatataacgggacggagggagtactgtatacatgaaaaatataactctgaccatcgtcctatgttttaggccatcaaatgatctgagcttcacattatatatgctattgtgtgtgccccctccatttttctatatagtgttggttagtacaatattttgaaccaaaccaatgtcacatataaaagaatagagggaatatatactaattatttaacgaaaaacattattatgttagcggttaactcgcttgtttcccgttataacatgaaaatttattgttatatctattggagatggtaagaatattgtcttgcactcttggtggtacgtagagtgaaatcatatttggctgtttccttttattgtcctttatttataagatatggaatgatatctaacaattgtattgataaataggaataaaagttagaagaacaagaggtggagaaaaatatttgtgttggaaacaaaatagatcctagcttctttcttaatttttgccactttttgtttggtttgttggcggttcttttttgaagttgtgggaatttcagactttctaaactaagccttaaatatttcgaggttactaaccatgatgttgagtgaaactttatagatctatccgtttcagattaaaaaacaaaacggacatatataaaaataaatattatatgccgtaatcatattatggcccaattaaacaattcttaaaacgatagcccaggttgccttaatttgttgtccgtccagatgtattggtaaattatggcccaccaatctttagtatcaagatgtcgtacaagtcttgtccttcgctcaactatagccatgctcctatttaattttctagtatccgttatgctttgctcgcttctatcgaagcttctatttaattgtgcatccgtcatcgtgctaagcttagacctactcaaattagcttttttaaattttgtggcatatatccgcaatgcttcgctcagccctttctagacacctattaatttgctcccgcgcttttttgaaatggcaactttatatggctagtacacagagaactgtttttgcaccaaaattattgcaaaacaatgaaactagaagtatggtgatcatcctcagactatcaatttagaattgaatgctacgactacaacgtgattgtacggtaagaaatttcgatgaataatttcattgtctattctttagtttctgcatatatcggtgtcaacctatttcaatgtgtttgctctgaaaattttccaaccggtttttcccgttccacatctccaaatctgatgcttaattagatttgaaattccaatacacattttgaaggcaaatttttggtgaaccgacgatcgagaacgaccattattcctcggaatcactacgtacaggtacgttttgatagattggtttgcttcctggaacaagaaatatagtggctagctagctagctttttggatcgtttacgaaattctttgctttgccgatgattattgtgcatcgcgtgtggagggctccagccatacgaaaagccgggcccacatgccagcggcgaacagtgcaaaaaaaaaaattgcaaacaacatcccccatcacatcacatgtacagcagcaaagcatacggtcagtttgcatgcttatgcatgggaaagtccagaaaaagaccacctggtggaagggggataccggggcgtgcacgtccacgtggagggaggaggcgagtgccacctgtcagcggcggcaaaaccatggcggaattggcccacaggatatgcaataccgggcgtgcgtggggggcgagaggggcaccggacacgacgtatttaagcgtcggattcgtcggtctccttcttcttcttcagagtccacaccatttcagagttcagagttcagttcagttcgctgatcgacgccaagaaccctcccgaccaccgggaaaccgacctgagaattcttcttcttcttctagctgctgtttcttggctccggaagagaacgatcatgaatgcctcaggtgagcgatctgctgttggtttgagactttgagctaataagctgtggtgttagttcttcttctgcatcatttctgtctgaatttgttttgttttctttctttctttttttttttttggttctcctctcgcttcttgatgtgcttagcgatggatagagttgtgagatgatcgttgcatttttggtcgttcgaatggaacagtagtagtactctctgaacaattcagtctctttgataagaatttctgcttcttatgcttgctgtctgcgactctctatcttgcggtagaaaactaagtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23835 - DNA, 19771 bp, Oryza sativa
  unsure (1)..(19771): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaggcctatactggtatgatatttcagcttttccaagaagaatacgaagagtttcagtcagcttacattgtgactcgtgatgaaagtggtcccagccgtgaatatattgttgccattcttgagaaagaaagacggtataaagttcatggaaacccttgtgagcagacagttacatgctcatgtaggaagtttgagacacttggtttcctgtgtagccatgctttgaaagttttagatacaatggacataaagtatatgcctgataggtacatcctgaagcgatggaccaaatatggaaggtgtttgactgcaccgcaggttgaaggtcgaaaggttcaggcagataccacattagaattttctagccgctatgaatacttgtgcccagtatatgttaggcttgttgctcgagcatcagaatgcgaggagtcgtacagagtattagatcaatgttcagtagaactgggtaagaaaattgaagaaatcctgcagaaacaaacaagcattgatgcgtcagctcctcagtctgatattgaggatgtaacaatatccttgtctgcgaatggtactgacaatgaatcagaaagagcactggattattcaagcagcacaagaccgaagcgacgaaaaaagaaaggtcgtaatgctaaaagccaacgaaaaagttgtattgagaaaggtttacaaaaaaccaagaaagtgcaaccagaacaatccccaatacaatataccatgttggatgctgctcaacctggaaatgttctatttcaggtaatttcagcattgttgttcattatatggtgatggcataacgtgatagtaatcacaaactgatattattctaaacggtagccagttggtggtgacatcaagaacctttgctttatgtaaactcccaacaatcctatattgctacagtcatttcaattgagaattcctgtcagattgttctttttaatgtgatatgaactccatgcaaaattggaatcagtcacaaaaacctgtaacgtcaggttgtttctttttctattaaaattttatattgaacaagttatttttcatctcaattttgtagttcctaaggccttctacagcttttaagttctgcaatgcagaggttttctatttaaaatcctatgccataccaccatggactgtggtcataactgatagtagctcaaaggactatgattatgggtattttgggctggagaatcttgaattcactatagttcatgcctcagcaacgttttagtccaacattccaatgccgggccaattcatcacgccatctggattcttttcaatatatatgctgggcatggatgttagatgtacctgaagttgtgtagcctgttctaaccctgaggttagttattgtatgtaacatggttaatttttagttccctttttcattttcagggtcttgacatttctaatccatttccaatggggcaactgaattatggaggagtgcagtcacaaccaggcctatgcccaagcttacctactgtatcaagagtattgtcaattgcctgttactctctttttgataagaaatggtgccccttgcgccgtatctgaatattgaaaaaattacttacacggtcattgctttcaggaacttggttttgctgcatacctttctcagccatcaagtaacaatcaacataatcagcaggtataaattggtaaagtttcacagttgtctctttcctcactttcatgttgatgaagctttgaagttgccacctccttactttctaatttaataaagtgtttagattttttaactctcgtgtagctccatccactttggattttgcacttggcaatttagattctgaaaaaaactatacatatagagcattttaaggtacgtttacatgcagatatgatcaatttgtgctatacgagaaagaaaactaaatcgtcttatctttcatcaaagaaagaaagctgatctatctttacataatttttgttgcacacctatacatgattatatctttacataattttgtgtgtgaatataggtcaacatgctataaatgtttttattttcagaatttcctaaagtcacaatgtgcaagaattgaaaaatggctgtagctacacatgggtatagcaggatctttatctttaattaaactcagctttttgttaatcatggcccacgtcactgctctgttggccattaagcagttaatggatgaagttgctagtttatttctgctgtttattgtccatcttttcagggtttgtagaaatcaacagctctgttgaaaatcatagtgcacatttgtttcaatcttcaatataactcttgggacagaactggccctctgttgaagatcaaatcaacttctcaaattcatatcagtcagtaattgaggctaccaagaacagccatttacctgggtacatccatcagcagcatgttcaagccatgctacgcagcatgactagctgacgattagcagtgatagcgctcaccaagttccagagtgacagccacttggtgttgtgttgattagcaatttgaatgttaaattctcccgcatatcgctcatcaattgtgacataccaagccaccaaggacattcagagcacatccatgatctatcgtcagtagccaacgaagtgttagctctcttgcaatcgtcggatggtggatggtgcagaactgtagactattttgtagcctgtatgtgaacatgattacatgaaccatgtaggactagtctgtagaacagagtagagaactagagatgatatctttggaaggattagatttcatgccactcttagagttgcaggtttagaaatatgccattatgatggggatatgtcaatagcataagctcatttgtacaagcttgtcacacttgtgctttgattgtataaatgctaggagatgtgtctattttgtcaaattagtatctcttgctgactttcctaaatgttcgcaatttgatgaaatgcaagtaaaacgaattcatgaaacaagtttctgcatagcatacggtccctggaatgtaaacatgtaagcctaaatttcaagggttaatttcaacccctgcggaaacttttttttcagttcagagcaaaatgtcagttcgcaagatccaacatttcaaaaaatttcaacatattagcacaaaacaaaatgaaacattccactttgaagcattcattcagttcagaaataccaaacggcatagcatttccattaagattagcaaaccacaacgattacagcatcacatctcccaacctacagactgaaatctggaaaaaaaaaaacgtgccagtttgccaggaacacggaagaagcctccaggcaaggcaagggctaggcccctcttgcctctgatgcggcgcgcgagctggatgtccttggggcgcagaggttggttggtgtcctcgaagagacccatgaggtataggcctcggcggccggcctcctgcagggcggcgaccggccggagctctggaagcggaggtgctgcatgcgttggaaggggagcttgctgcggggatcatggagctagctccgtgctcttctggtctcgcggagcgcgacggtgcccgggcggaagcggtgcggcttcttcgtcgccagcgcgctgcttcctcgatcggcgccttgccgccggtggagacttggcgcgccgtctgcttcgttcggcgccatctctcgccttacttgaattatgtttaggctctgttcagttcccttcaaacttccaacttttccgtcacatcaaatatttggacatatgcacgaagcattaaatgtgaacgaaagaaacccaattgcacggtttgcatgtaaattgcaagacgaatcttttgaacataattacgccatgatttgataacgtggtgctacagtaaatatttgctaatgacggtttaattaggcttaatagatttgtctcgccgtttacatgcgaaatatataatttcttttgttattagtctatatttaatacttcaaatgtgtattcatatacgttaattttctttttgccaaaacaactaaacacggccttaattagcactcatcaatttgagctctcttgaagtttcaatacgtgcagtgcagtgcaggcttgagagagtcagcctgggcttctctttctttagtgcaagctacttcgctctctaccattgctaacggatttaagttgtatgtagtcgacacaagacagtacgggtgtgtttggcacccttttttctaacccctcctcgttttccgcgcgcacgtttatcaaaccgttaaacggtatgtttttttaaaagtttttatacaaaagttacttataaaaataaaattaatctatttttgaaaataaattagctaatacttaattaatcatatgataatggatcgctctgttttccgtgattactgtccttgatggaaacaaggatgcccgaacagtctcttcgattcactcccaaaaaaaaggccaaagatgccaaaagttacgtcaaaatttttgtttattcgctccaaaacattattagcatgctactttttttacaagccaaatcaatctataactataaatactttgttattactatttcttttggtatagtaaagtacactattcaagagcccatacgttacaatggaaaacaaattgtgtttatagcttattaaatcaattaagcatatatttagtctaagtagtacttttatgattttccttattaaacaagtagttgattttaaaatttggggaaagccaactgcgaaacgagagataaatcattaaaggatggtgtaatagtatagactgtggaacccaaataataatggtaggggtggtgtgacaaaacgaataataccactataccactatagtatagacatagcttggcatgcaaatactctgtagaggtatatctagttgtgttggcgaaccctttagatttacgtcatggtcaaaattatggcatatggcaacatctatctgtatgtttgtctatctatcatacataactaatattaattgattgctttcattgagctattaatgtgttcgttcatcttatggcaatataccggtagccaacgtcatggagtttctatacagtacatccacagattacctgtggatgatgcaccctagtaggagacgtcatgcgtaactgtgacgagcacgagggaaaggtgctcctcattctacgtgatggttgcatcctcctcattctaaatgatggttacaacatcattctacgaagacagtagggcaggggcactgtgaatttttttctttcgtgatgaactgtcggcaccagtcctccatttttttctcagtggtccacgccggcgcctttgacctcaacccaccagctgacgaggcagggtgtcaatgccacatgaggcagagaagcgtacatgagcatatgaaagcggcggcggtgagcgggactaaggatgggaaggaggaaaaaaagataggtttttggttgttgtacaaatctcaaagcgatcaaatagaccagaatttataaaatttagttttttttctaacaaaagccgcaatcccttataataattagatgtattagtgttcagcataacccacatcctgggagaaagttataataaaccttttgtagtgcaatgcattttgaagtaataaaagcaagtttaattatacacagttcttaattacattgcaaggcagcgaaagggtcatttgttgttaggtagagtacaaatcaggccaaaagctagcaacaatggagtgatatggaccgagctcagcacttcatcccatagggtccctcgacacatttcttgaagatggttccgggcggcaggcggccgtaggtgtggatgaagtagaacatatcgtccccacacccattgttgaggtcgttgagcaggtgttgtgtgggcacgcgatctccttgaacgcgtcgcaacactccgtcaccgatgccgccttgcacttctttcctagctcggtgaatggccccttcatctcgtcgaaccgcactgggcacatccctgtgttgtgtgccacatgccacaccatgcacgcacgcgttagatcacccatatatatcgccaagctattaaccacacatacatggacgcggtagtatggttcagggttttcaattttgatttcaccggaaatttcggtcattttggtacaaccaaaattcttgaaattttgggatttttgacaccttttggattgattatttaactaaattttaatctaattcgtagaaaattgagaaaaactgaaaatttcggtcgagataatcacttgtactggggggtccgaaattttgaaccaaaattgcaactactagtatggtcgattacctagcggcgccggcgccggcgcgttagcggcgcccatcagcttgcgcgaggtcaacttgtccgccttcaggtcggaggacgcgaactctgccgctggaatgcatgtccacaagagtgtgcgtgatcaatatgtgcaccaaaaggaaaggcgatatgtgcggagttagttattagctgatcagtatttatttatttttttgcaggagtcatgcatgtgctactacctgctacagagtctgcttcggtggggggcaattgggtcatcacgatgaccatggacaatgcgacgcagtagaaaatagtggcaccgacggaagaacccatgcctgtcaaatttaattacgagagaaaatttaatgggaggaagaagggaacgctttttattgattggttagtgaaaactgaccaaccatggagtgtttttataggctgtgaatatatggtgataaaatgtggttaatcctggtttagtgtctatcgtggacctcattgttttgagggcaaggagaagtagtttttttttttggcaaatacagaaacaacagcacctataattagtttgcagttctcgatggtttctaagtatacaatgaaggagattttaccatctttgagaagtaccaagcaccaccaaatcttgcttgctttagatggtgaagtgaaaactatgaagttacttcaaatgaagtaattgctaattgagtctattattaagttttcaaattgaatcattgctatagaaaaccctttcggtgtcggttgtcaaccccacgtgggtgtaggatttggcaatttgcacccgtcaggctgcaccgttgactagagtctcggctcgatttgtaaaaaaaaaaaagtggctcaacacgattcgagccaatgatccaaatccactaaaaataaatcgaaaagcaagtcacaagttcatcatagaaattaagccatgattggaattcctcaaaaaataaatgaaatagatacgcaacaaaaaaaaaatcataaaataaaacatcacagaaccaatattgaattcatcacatggatttggaaattcaagaccactcgctaccgctggtcaccgtgaagaagtacgatcacccactgccccgcaggacaactgctggtggcaagatgagagggatagaggatgggaggagggagaagacaaaatggggagggtgcactgacctttagcgtcgaggacgatgcctgccatggagccatcgccaatatgttggacattaagatataaaaagtaacctggacaaggtcaaggtaatggctattgaatgccattcaccctcagcttcgcactcttcccattgccatggacttcacctctgtagcatgagcatgtccaatgacaatgggaagagtgcaatcacaggcatcgcttcctatctaagtacacgacctcagggcccttcctaaccagcttcagtgaattctgcgccactggctcctgcttttcctcgtctcatttcctcttaccgtcctgttgccgaccggcactctccttgggctcctcctgctccccataagtggatggctcatcatgttcaagcaccgagcgctgcggctttggcaccggcaaataggggtgggcgttcggtctgaccgaaaaattcggtctcggtcttcggcctttcggtcatttcggtctttgaaaagtgaggaccgaatttcttccaaaaaaactcaggaccgacaaattcggtctcggtctcggtctaaccgaattttgacagagggggaccggctcaaacgcgaacgcatcgaatcccccaccgcagtctggctggagacggaggcgacgtggtggtggcgttgaggcagaggcgggttcgtggaggacggaccggcggaggcggcgtctgcacgatggaggtcgaggacggaccgacagaggcggcgccggcgtgatggaggtcgaggacgggctggcgcccggcggaggtggcgcgatggaggcagacgggcggagcgtggagggcggagagtggaggcggcgccgtggaggcggaaggcgaagctgcggaggtggaggcggcgccgccgcagtggaggcggaaaggcagagtcggtattgtggaggcggaaggcagaggcggcggaggcaccgtggaagcggaggcgacgcggtggaggcagaaggcggagacggtgtgaccgagccgagtgcgacgtgatggggagaggcggcgctgcgtgaggctggtgggaggagggattggatgtgtggttgcctctagggtttagtagtttattgggcttattgggcctcctaggcttattgggccaaaattcggttttctcggttaattcggttaaccgagggcaatgaccgaattacccgaataaattttggtcttttaatggccaagaccgaactactaaccgaatttctcggtctcggtctcggtcttttcggttcggttcttcggttcggtctttgcccacccctacaggcaaaacctctatcatggccaccaaatccatcatttccattcataggagctatgcaaaacctacccaagctgcatcagccactctgctctcacatcgcttgttcggattccacaccatcgctaacaaattgcactatacccaaaaccccacaaaaaaaaaaccctcctaaaagatcgcacaccaaatgaacaaatgcccattctctcaccaactccaccaaatcaacccaacaaaagtaagaaataaaccaaggagatgaaaggcacaagagccaaaacctcaccgttggcaactatgtggaaggtgacagcgacagggggagagatggacaagctcccgcactatgggctcgccggcgctggttcaggagacgggtcaagtagacgtcgctgcattggagaatacgcaagcagccaagcaggggaaacaaagaggagaagcccttatctgtggtggcgaggtgacaggatggcaagaatgaagaccgaggatactgatcattgatgctggggatggaaaggcaacttatgcggtgagacggtgatgcatcgtgcgtagggtgacaataatgtgggagccacgcgatgaggggaggagattgtaggacttcttttccgaaggacatgacattttgggaaaggtaggaggggaagggagcagatctgagatgttggatgtgatgcgttggatgattttaggatgttggatttgatgaatgaagtatgaagtatgtaggaccgtgttggtgaactatatggtagaataagctataccaatgtaagatgagtgcaattaagtcacttatttttcaaattgctcaaacgagtcacccattttgtttctgagatgcaaataacataaaacatatgttgtgtgggacgttaatcttctaaattagatgtcatattaatttctttcataaagatgactacaaataagccaatggtgtaatagtattgatagtaaaatctagtttaagatgaattcagttttttattgctaagcactatgcaattttgttgaccagaaatcatatgcatataggagctcatgtaagaatatggaatttaatttgcattttctaaacttgaaacttgcaaccttgttctacccatacggttcacaagtgcatcatcttataccaatagggtttttaatttagcaacaaatattccatgtgacatgtattctataatatttgcaccctcagcacacaagttgagcgatttacttgagcaatttacaagattaacgactaatgtgcactcaccttacaagttaaagttatagtaccaatggtacatgcattttactgcgtttggtatgctaggtttagacattctcttcttttcatggtggttgcccatacatggtccaacaaccggccaaccatagccgaaatatcttggtattagttgatacttaggtttgttgcggaatatgtggatgaatgtatgctatacattatagaaatggtagatgtatatatctaaataatgtaaaaatgatgtgaatataataatttgatattctttcatattgagttctaaaaattaaaaaaaaatgtaaatgatatgtcatatttgtatgatatttaaaatactctagataataattgcgagtgggtgatgatgcagcatacttgcatttgatttaatgtactctagataataactgctagtggatgataatacgacacagttgcatgttaaattttaggagttagtgaacatcatcaaattcataataagatagatttcggtttagggaccgttttggaactcgacgaagaaatgagggatctcttgcgaacgtttcctacctttgtggctctcctacgggcctactaatcggcccatctcagcagcttcctccccacgcctgcccacagggcccggcccggcccggcccacccaagggtccggaatcttcttctcctcctcctcctcacccctcacctcatccctccctcgcctccccaccatcctccgccgccgccgccctccgccctcgccgccgctccggtaatccttcctgtctactagatccgaccgatccccctcccccgccgccgtcgtattctgctgatcagcgcgctgtttatttttctctctctctttcctttccccgctttctctgatcgccgccgttttctgcagttggaatccggatcttccttcgtcgagggggtcgcgtcgcctcgccggcggccgtcgcgagcatgtgagtctctcacctgatcccgtccccttcaattttttctgtcttgcttggtagtcgatcggtcggtcggtcggtctcctgtttggttggaacggatcgggcgtgctgcattggccatgcgtttgggggattgattggttttgatttggaacgattcgggcgccatgatcgtagggggattcagtgaacttgcatcgcggttgctccgaccgaattttcacggccgtatttttctgtcggtggatggcttttgtgtcgtggggagttgcagcgaatggatgcgatgtagccacgcgtgattcttgcgaggtcgcagggcagagtgatatggatctagtaaaaaaagtgagagttttcctatctgattatctcgtcctccatatgtttttgtttatgctgtgctaattctggttgcccagcacccatatccaattcccatgtcattcatgaagcctagcattggctataattgattaggttccttctacatctgcattatgatgctgacgcttgaagttcttttgattcatactttagcaaagcacacctgcaatgcaaacacttatagtcttatgtgatgataccttcagtgcaaaacttattctgaagaccgaaagcatcaaactatggtgcttaccgtttcatagtttagcaaagcacattagcaaactctcctgtgtgctgttaacttagtaggaactgattctgaagattgaaagcgtcaaatatttatactagtgcccatgcagaagtcagttttgattgtttcagttctattgttttctaacagctggatatgaaagctcctcctttcatatcgatgtaattaagagagagtttaacacacacgctgactgccgatggggatcgaatgggtgtgagcacacactccagcgccttgccatctgcattacacctatacagcttctttttattgttgcggttttatcgttttctcatctttgtgcaccatgcgtggacacatcaagtaactctagattgaccaaaatgcaacttgcttgtttctgaaaaaaaggttgacttgctttaaactatagctttactgtgtacaatctcattagattaaaccggtgtatcatattttgcgtttgcatccatgttttatgcactggtggttaaggcgctattgggaaaaagagagtactgcataatattgtgattactctttccaaatttagatcttattgtttgatttattgaaatgcatggcaagtacccggtattgcatttggaaacttgtcctgcattttatggttttccatcaaagatatttgtggtagttatataacaaatagtgcgactttttgttattatattcctgagcttgtagccttgcactctaattcaggtcggatgaggaggtatctgacccgaaggcactcctagaggatcgatcgaaggctaagtgtgtgtaccagtggtatgaatatcaggtatatgctgtttttttttttctgttggtgaactctcattttgtttttatggtctatgtgcccagctatctcaactagatagcagtattaatttgctattaatatccaaccgatacatttggcgttttgtgcttagttttcaacttcacaatattaatgtatcagtactgttatctaaatgtagtcaatccgagcattatttggagaagctccatgctatctatattgctgtacattattgctttctgaatagctattcttctgcacctttggtactgctgggcctggatcttatcttatgctactctatgttgtgcacacagaaatgtgtcaagagaattgaagatgatgagactggtcagaagcattgtactggtcaatacttcgattactggaaatgtgtcgacaaaaatgtgagtgcttgttgccatatatacacttatatttgagtgaattgttgatccaaagaaaccacttgtctctattttctattttaaccttccgaaaatcccagccaactaagtgaacaggtatgggtacttagtactcacatcaaagagatgtactagccatgaaatgtcaatatctacttcaatcttgactggcaccttaataagatccaccaaaattggcgacctagatattctgtttttcttctgattccttgtggatcatggtaaaaactatcttgctcatgttggttatgttttaccatgcaggttgccgagaagctttttgatagcttaaaatgacaaggaaaatgttctctcttgctaccgtttacgcaacagtgagaataatcatatcgtttctgcgccctgtagacatgtcaggtgcttaatatctgtaagaaaaaaagttttgcctgtcggataatacgacagtttttcaaccgccactttacttttatttctgccagaggcattgaactctctacatctgggttcgtactgcgttattggctcatgctttttccctttcggttcataattgatatatccccagattgtgaatgagcacggaatgctgtcatttgccttttccatattgcttctgtcttgttttttgcacgtatgccagtgtctggatttgtgtatcgggttaaaaaaaccacgagctggtaataacgatttcttatctttggtgtctacataatccgagtagaatgctccaagatgttgtgattttgtggagtatatttcaaactgttgtgccatgatgtgtactctatgtgggactatgaatccattttgcacttccattattgactgttggggttcaaattctcgcaagatactgattgggttcaagttctcggatgacgaggcccatctggtatgtcatagaggaggctggttgaactgcttgcagcttgtgcaaatggcgacgcagcgacagctcatttgctgacaaaagagaccacttcgatccgattttcttcagcagatgtgcaacgttaaaccagtttgtcccaggtgaattctccatctggatgctggatgcgtcgcacacatattgtttctgacctttcccttcagtttcagtggtgtaacgttgtggatcatatggtaagtggccggtgtgccctgctcacacgttacaaaaagagagattctgattctctggtgctcgtccaactcgtgcgatgatgcacgctaacatctttcgtgtacgacagtacgaatgaaaatgccaggacatggacgctgccgaagctccttttggcagtgcgataaggtgtggcaccttttaggtgtttgggtgcttggtttactgtttttcatttttgatctaatttgcattgtattactgtgtgtccaaagagtgaaaatgttgcgagggacacgatggtaggataacatacatacattcgtgaaacaaaattttgagcacaaataagggctcaaatgttgtattgatcatcattgttgttttgtttcacaaatgttagacaatatacgttatccaaccattgtgttcttcaccttagtggagtcgtgcaaccactactagtatacatcaatgctgattgctcggctaattgcatcccataactgtgaaagtcagaaaggaattgaagaagaacaagatccgtgggaaaatcaaagacggcttatgtgctatcctccaaagtgagatttcctacaccattatttggtagttttgccacagtaccggaatgtccctttcatctgaaaaggcaggcaggtgccatgagcaattgaaaactatcaccataacacaggccattttcccttggtcagtagcttgattggttaactgggccgagatctttttgttaaagttttaactcaaccttttcctttttcaggtgcatgttttcaaactattaaaaagtacgtttttttaaaaaaaaattatatatgaaaattgttttaaaaaaccatattaattattttttaaaaatatctaatacttaattaatcatatattaacgagtcactccattctacatgcgcgagggatgagttcccaccaacaagcaacaaaattagcctaagccagtggtgatcctctcagttgttctgtattcacctcgctattgtatactacttcctctatcccataatataagagattttgacattttgcttgcactgtttgaccactcatcttattcaaaaaatttgtgcaaatataaaaaatgaaaagatgtgcttaaagtactttggataataaagtaagtaaaaaaataataattccaaattttttttgaataagatgaatggtaaaatgttaaaaatcctttatattagggggtgaagggagtagcttttatgatgacatccccggacattgctattggctaatgcaacttttaagcatgcacacactgcacctgctctcagaagtaaccattctattcatccaataccggagattatgatttgtttcaaggaatcccatgttttgtggtaaaatgtttcaataaacctcatattttattttttattgatatgattattttgacatagattcacatcagttgactcaaagtagacatcccatttctactcatctttttttttctcaattttgcactacacaaaaaattgtcataatcctaacctgataatgataggataatcggttaaatatgtacgtaaacaatcaaacaacgatgtgataatgatcaatgcttgttgaaaagtatatacgtggatatgcacttaaaaaaatgtcattcaacttttttcattaattatagaaaaacttattagttaaatggaacaatataaacttcgtatccaggattttatgaaatattttgtcccaaaatgtggggttccatgaaacaaattataaaacctaaggatttgtgtcatggacaccccaaaatttggggttggggttttgtgaaactccctcttgaagaaacgttggaaaaaatgtaggaataaccatttgaatgaagcacagggaaaaaaatgcagggatcagaaaatagagatagaccaaaaaagatatttttgttcctaagaaattagacttcatgttaaaatttctctaaaatcccttttttttttagccaatccaaagggaatttcatacaattttttgtagctatttcttttatccaaatgaccacatatgcgtaggattaaaaacctccaaaattcaagaatcctttgttccaaaggaatctttattccttattttttacccatcaccatcctcaaaaaacttatggctcctttaaattaaaggaattttataggaattctagaggattcaaatcctaaggaattttttcctaagtaggttattaggagcataggattgcatattgccaaattcatttggagtgcattcctatacccttaagtaaataaggtcaaaccccattttatttttcctttaagaagttcaatgcatcttctatctttatctctcctatctctctctaaaatccttccatattcatgtgttattttcctttcagctctccagacatatcatctttcaattttttttgtgttttcaatttctacgggattcgtttacattgcattccaatcttatgtttttttctattatcgtatttaaaaaaaatcaaccttccaaaaagtagcccttaacttgaagaacatcagtatatttttaatgaaaaagtatattagatacgtaagaaaaatatggtagatttttcttaaatagtacttgtagaacattataatatatcattagaaatatcaaatagtttacaatagatagtagtgttcaaagtttttccggtaaggtatgggatataccataggttctggaactgatgaatggtcacaaattagtcaaaatttgggaaagagttgcggctaagagcaggtacaatagcagatgctataagccaactataaatacatattgggaagataaaagaaaagagtgaagagtagtaggctacatatttataactagatgcagcacggactctaagacacaatgtttgtatgacagatgagaccatgtattaatagtgtagtatatattcatagataactattgtatgaattggctattaagttgactataggtgatttggagctaacagtaggctatactattaaacttgctctaaagggtgtattcgagacgagaggttgggaacctctcacatgcacggaaaacaggataaaagattagcacataattaattaagtatttagtttaaaataacttaaaatggattaataagtaactttcctatagactttctttggaaacaattttagaaagtgtgcgcgtggaaaacaaggttgtaaaagttgagaaaggatagaacacataataatggaaactagggtgatgacatgcaaaaactctagtttcggttgattaaatcggttgtaattgacagatctagtacttgtcaccctctaaactaaaataccattcacccaatgatctatagattaaagtatcttccctctgttttaaaaatataactatatagatttcgtagtaataggatacgtctcatccaactaaaatctcttatattttagagaggttttacagtgtttgtgaggtacttagaggtattaagaggtagagtaatatgcaccgttgatcaaaagaggggcaatgtatggaataaaaattatcataaccaatgaaaatgaagtaattaactagtgaaatattgccattattgtcgaatatattgaataccttgcttcgttgatcattactgtacgatagagaaaatgtaaatctacctaggcatcaattagatctacacggaaaaaaaatcaggttgtgtcttctttctcgtctcccacatcgctttgttcttactagggtttgaattggttcactagaaaaaaaacaaagggagaactatcaacatggttgaggattgaagcggagatgaggtcgaccgatcaatggcaaggcgaagcgcatccgctaagattccatttacacagttgattactgatttacatagctcacaatttcattcagagttctcccctgttcttcttccagggtttgaataagtgcactcgcaaggagacacggtcgtcatggttgagtatttgtgcaatctacaacgaatatatctctggatatttggcatgtggtgcggacgttgcggcaattgcatgccttctaaagtggcatgcaatccgtggatgcatgcatgcacatatatgcccaataaatggacatgcaatcgggggtggtttccattttatcatatatgaggtaaatcagggagatggttattttcaggtcagtattaaaatctaagtgtatggatgacattataaaataagttatttaattccctaagacataaaattttgttaattagtgaattctacaaaacttgtaaaaaacgaaatgaatgattactgtgcgaatctattcttaaggaaaaaatgtaaatctcaaaaagaacacgtaaataatgtcatggagatgacaactaccagtaccaatgcggtacctatataccaagaactagacaattatacccttctctatctactagaatattatctttttacccttactacctaagtacatgtgccaatattaaaatactttttaagtggtaccttttattgtggagcgtggatctttgcctttttagaatgcaaacacagtaaaaccggaaaaaattttggtgaagaccggatgtaaccggccgcatctatagccctgctccggatggatgccacgtgaatgacctaaggatcaaacggttagctcggcccggctcccggcgctgcgtgacgaggacacacgcacgcagcttggctccacgagcaaccgtgtctttcaggctctccgtcggcttgattcgacacatatatatcgcgcgcatctcctttgcctggtgagcagtgacctgggtcttcctccggtgctgcagggatcgtcatcttcctcctcctccagcaccgcggaaaccatggccaatgtgccgagcaccacggctccaccaccgacattgcttctgaccagctagaggtagaggctacagcgcttgaacaccgtttagactcgaggagggtcaggtgctgtcgccggccgcttctccatggcatgagaagaaaacatgcaaattaaaacgcgctgcagggtcatcgtcgaagccgtaatcgatcaaaattaaagtgcatccaaacgcgccgcggctcaccggcggcggccgcctggaacgggaacggagaaagacggtcgtcgatgtagccgatatccaggcgaagagacgcgatatgtgttgaatcgagccgtcggcgaggctgaaagccgcgtcttcgctacgcctggagccaagccatctgcatcctcctcgcacagcgcctagagccgatcgggccacgtgacccgttcgattcttagctagtccacgtggcaatcatccagtgcggggctgcagatgaggccgattacacccggtctccaccaaatttttttccgtaaaacctctatttcttggtactgagagagtaccacttaaaagacagaac

SEQ ID NO: 23836 - DNA, 4256 bp, Oryza sativa
tgcgaaaagcagacagataaaatctggatatcaagatgggatagatggatctggatttttcacaattagatccttttgaaaaacttatttcgcaaatagacccctgaaaaaacttatcctagaaatggtcccttttggggcgccagagtggccggcgccgtcatcaggcgccctcctcctgccacgtcggttcgcgtacgccacggtggcaggaggacggcgccagatgacggcgccagccactctggcgccccaaaaaggaccatttctaggataagttttttcaggggtctattgcgaaataagtttttcaaaaggatcaaaatgtgaaaaatccagatccatctatcacatcttgatatccagattttatctgtctgcttttcgcaaagattgtacaaaactaaaatattcagattggaatggatgatcgggctaaactatcttaattacttccttggttttaaattacttatcgttctatgttatactgagtcgaacatgtccatctttaactattaattcttataaatctgtgtagtttaataccatatgaactgtatattataaaattatttctcatagtgaatctaaaatataaattttataatattaaactgtatgagtttagaaattgatggttaaagattaaaatgtttaacgtaagataaatatagaacaataaataatttgaaatggagaaagtatatattattgtaagatccaatgttgttcatatctaatcctttacccaccgcattgtatcagctacttcattcatgcattgcttgttcagcaaatttaagttgacatgcacactttaaaaaagattatccttccaatacttgtgacttggccaacaacgaggaggagagcaaatggaggataaatggagacgcactcagcagtttgatggtggctgtagctggccccacaagctcagaatttcagctaaaaacgaatggatatagccacattacgtgcaggaaactaataacgactgtcactaatcatgagtgttactagatcagaaggcaacagagcaaccaaataatgaaagtgatagatgccattagaatttcttctttttttttatctggcatttcaatactgcaaaataatgtctgattgttagcaactagtatatattttataataattgctgtaaaaaaggccacaatcctaatattagtagacttcaattaaaaatctacacgttggggtctcatatgacaattgtctccgaaaaaaagggctaatcttgctcctaaatctcaagccatccctctgaataaacaactaatattaacatgcaaagctaatccaatcagtgaagcatatccagaaaatcatctgcttttgttgagctttcaagatcgagtagtccaggataacgatgaagtaatatattagtgcttgcaaagcctccccagtcttatctgatacttgttgaaagattgctctttttcgctacttgttggcaggtcaggatctcaatgtggatacagcacgttgtgccaactacggcctagaagattgaggattagcagtaacccactttctttccacattaggcctaattaaacttttcaactcgcttgactctagacagcgaaatctgctgggagcctggaaaatgaaggtatgactgtaagaggtcaaagttactactaccaagttaccatcaggagcagtaaaaagtttcttcttgaaaaaaagatgcaaaagttaacttccacagttagacgtacttagttttttttgttaaaaaaaaactgatctggccacttaatacaaagtaaagtaatcatgtcttgcttgcaaccttccactttaattaaaggaactacggctaagatgtggcaggcaggtgtagcgtcagtcacaatctgtttcccttctatcactaaggccttgtttagatctcaaacaattttaagtcaaaaacatcacattaaatatttggacatatgtatgaaacattaaatatagaaaaaaaacaattacacagtttgcatgtaaattacgagacgaatcttttgagtctaattacgccataatttgacaatgtgatgctacaataaacatttactaatgatggattaattagacttaataaatttatctcgtagttcatacgaggaatctgtaatttattttgttattagtctatgtttaatacttcaaatgtgtgtccgtatacttcaaaaactttacacccaaaatactaaacacaccctaagtttcagcaaagccagcaaagcaccagcagcatctgaagttctacagattttacagtctttgcagaagcatcgaagaatatagcaaatggaaccatcacatcaggtagagaacagaagaggtaaagatgatgcaattttcatcccatcaattttaacttaactgtaatatcctgacgataacaacattataagctgcactgactgcataacgcattattacatacagaaggcatcggggtacaacacaacgcattaggagtactaacttcaggccacgacaacaacacaaagctacactgcaacatggctccttgttataatatataagctcctcttcacttcttgtggatgctgcagaggcagttctcctcgcctacgtctttggcgaggcagggaggctggcatgatccgtcctggtaccaggtcgcccgcttctccgtcagctcgttcaggaagtagtccagcttgtcgatggtcacactgggcatcaccacgacatgagcgatgttgccctcgcaggcgagctgccacctccggacgaactcctcgtccttgggcctttcgaacaccacggtgctgctcagctcgttgagcatggcgccgattccagcttccttgaggcggtccttcaggtagtgagcgttcctcaggcacttctggacctccttctggaagcccctgtagcctttcctgttcagggtgtaccagaggaagatcggagcatggccgttcctacttcccatgatcgtcgcatctcttgatgccagatattcaacattgctagaaagacgatttatgtgctccagtcttgttatctggacaccacatggcatgggacatcctacaaacttgtgcccggaaacgctcacactcccgataggcttcttaaatgataccttaggtgcctagtgaacaaatttacatatataccacatcaggggaatgaactatttgaaaccattaaggatagctgtgcaacagataaggcacaggagggactcagcgggaagaaatggaaattaccttcttgacaaatggtatcatcagtccaaaaagagcaccgtcacaatggatataaaaccgatctttaaagccaccttcttcaagtgttttaataaccaagtcaagatcatcgacagcccccttaacagttgttcctgcatgttaaattcgttttaaaacagtccatatgtgctacaaaagcactaagctgggacatggaggaatgagaccaagctcaccaatgttaacattaataatggcaggtttgtctctgtttagcaataactttctctgaaaatcttcacaatctatttccccagaaataagggtgtccaccttaacacaatccatcctatacatccttgctgccttgaatactgaatagtgagactcacgggaagcatacaggattccatcagggaatacctctctcctgaaaaacaatttgttgagaaagattcagtacagattttacagaaatgacattttgacaggaaaaaatgcactttgcagtcaatagaatagggtcttttcgactactaacccaacaagaataccatgcaggtttccttctgtgccacagtttgtaatgtacccccagtactcattcttttccaactcccagatgcgagcaaaccaatccaatactcccacctcaaactgcctggaatgtacaccatagttgctctcgatgaagggatcaccaaggttgttgatggagaagtgttgcagctggccaagtgcaccatagtcgaagtccaggttatacgggtaaccttcatcagaacaaatggacatgtgagattagcttccaaaggaagaaggattatgtgatatttgaatgggtcaatttatcccactggattccatgtttatgtctatgctacccttttctaattgatgaattgttcacattacacagtattgtttttattccgaaaacatgagttgcagctagcagcaagtgattgagttctgtaatcctcagaaaattattgactagagatatgg

SEQ ID NO: 23837 - DNA, 963 bp, Oryza sativa
aaaaattttgtaaaaggggttcatgtgcagcattgtaagagtttcatcaattggcatgcacattaaatttgtagttactaatccaacatggacatacctaattacatatgcaaaaacctctgaataaataaacagtcaataaatattggcacatgcctaagttgacactggcaaaccaattgcaatttgctttcattaaaaaagggtcaagagcaagctactgataaaaaatgccaccttcttatccctgtaaacaaaaacatgtgatgctcaattgcatacagcgcgtgcttactgctacagtgtgttgtctgtcagtgctcgcgtatgcaacctcatcccaatcataaaattcgattccacgacgaatgttgtggaaattgagcacatagcgcttgtgtaatcttacacgttgcgcgagtgaacttttaaccattccttataagtataggtggcaatcaaattaagcaacaaaaatgaagcatgccgatgatgtccaattcgattacgcacgaaagaatcgcgcgattaccacctgattgaaggttcccctgttcggttcacgagtacacgacgaggcatttgcagagcagagccgaattttgtgaaggcgtcatttacttcataatttcttttagaaaaaaaaaatgtaacatcacaagacgacaacctgaatgtcacgatctggacagcaacagcaaagggcagcgccaatccgcccccaaatcgccgcgcccacacgcacacgtcacccagatcggggccgccgcgaaccagatcgggggggagggagaaggaggtcgggtagtagcaggggagggaggggggcggggcgtacataccaaggtggtgcttggtgcgctcgacgaggttgcggcggtagagcgcgaggacgctggccatggcggcctcccgctccccggtctcctcgtcgtccgcgtcgggctccttcaccgcgaacga

SEQ ID NO: 23838 - DNA, 583 bp, Oryza sativa
accgaacacccagagaagcaagtaactcacaagttcgccctaatacaaatcttgtatatctacaattacgccaaacaccacaaaactaacctgcataataataatgcagccaataattattgtctagtttaaaaatcgtacggcgtgacgaagccttccggccggagaggcgcgaggaacggccggaccggcggcgtggcgaacagcggctgccggcacgtcgggcaggtggagcgcgcgaggagccagcggtcgacgcagcggacgtggaagccgtggttgcacttgggcagcacgcgcacgcgctcgccgggctccaggtcggcgaggcagatggcgcacgccgggctcggcccgcccgccgccgagtacaccatcgtcggcatcgcccgcagcgccttccgccgcaccccggcggcctgcgccgccgccgacggacccagctcgccgtcatctcccgccgccggcgacgacgacgaagacatcatcatccggccgccgctcgagcaccggagcgcgcaccgcacgatcgagttgagccccagcgcgcagatgagcgcgcacaggagcacggccaggatca

SEQ ID NO: 23839 - DNA, 1587 bp, Oryza sativa
ccagtaagcagtatcgccctgctctacggcttcgcttgcaatttgcaatactgtggtgtcttttttttgttttgttttgtcgcgacaagtcagtagcgcgctgtagcggagtaaactactacagtagtatctcttcggcccacatgtctgacaggtgggcccggcggggtgtgcgggccatggaaaaggggaaaatatcgagattcctgaatccggtggtggggccgagcccgtgggaggcgaggccgccaccacgaccacgcagccagcgtgggaatcttctgggcccacctctggtcacgccacggacgcgcctcgtccacgtgacgtggcgccaagcgtgtggggtttgcttttgccgttgcccgttcacgcgcgccaacggctgcctcctcatgtctgtctttccctgtcttcctctatggtggggcactgctcttctacctacctactccctccgttttttaaaaaaaattcctaatattccaatgtaaatttaatagtgagtaaaaatgactaaaatacccccttattattaaataaaatagtaatagtgatagataggtaaagggtatttaagagataaaacttcttatttaatgtgcagacagtaggtaagatggtgaaagttgtttcctgtgagacaaaattcaaaccacataagttgagtattttttggatgggggaatgctccatccgttcgcggtacttcatccgttctaaaatgctaaatcaaactggataaattttaacaaatattacactagcaatatagttttgttaagtattacgtatattatatcattatatttgtattttaaaatacttttatgtgatattaatttttttagttgtttaataacatactataaaataaagtagtgatcaaagtatattagtaaaggccgtgtaaaaactatatgccttacaatttagaatgaatggagtataatacaaaagattatgtcattttctgtatattaagaaagtaacaacatttaatagttcaaaagaaaataggtaagagggtataaatgggaaataaaataatacaaagaagttgatatgtgaataaaataggtaaaatttgcttcagaacgctcaaagtttatgatttttattgtataatacccaaatagcttgtatttgttataggaatcacgaaaatatggtaattagctgttagacactgagcgtattgctttattgtatccggtccaaatggagagaatctttcaagaaagacaagtttgcccatagtgtatctttctttataaaccgatcaggtttagttcgctaacaactacaccagtgagaatgactgcatcgaggaagtgggaatggactgagcctggttcgaatgagaccgagccatcttacaagccgatggacacaagggcaaatatgtacttttcgtactgtttatctctctattgcaccggatataataaaataatgcattcacgcatccaacaattaattaccatgctttcatggtattctacagtaaatacatgttatttaggtgtcttgcaacgaaaatcgtgaactttgagtgctgctccctccgtcccataatataaggga

SEQ ID NO: 23840 - DNA, 16092 bp, Oryza sativa
gcactgtttgaccactcgttttattaaaaaaatttggaattattatttttttgacttactttattatccaaagtactttaagcacaacttttcgttttttatatttgcataaatattttgaataagacgagtgatcaaacagtacaagcaaaaactcaaaatcccttatattatgggacagagggagtatatagcaaattttattaaattataataatacaagaatagatgaaaactaatatgttgtgttgggaacacaaaatctcaaactcgtatattatgggtcaaactacataggtaaaatctcttacattatgccacaaatgagggagaatttttttaaccttttaattttaaaaataaactctccaaaaattagttctaaatgtgaagatattttttaaaaagaaaatcaaaaggttcaaaattaatgaaaattcacctacctgccacctcactctcgtcgacgtcagatcactggtgcacgataacgtccgagaatcaaaatatcaatgtgttttcactcgagattttggtccacgtgcttttctgttgttttacatactctggcctgctagcacaacatatcacaaggaaaaaaaaatcgtatcctccatttcaaacaataagaggtgcatttccaaaatataataacctacgaccgcacgtactataaatctgggataggctaaaaaatgactcatcctattctagattcttatattttgtaatggagagagtatattacatttaaactgtatttaaagggtccatggttttagtctaaagaatatgtgtttaattctcaacagactcatatttttttctaattatttgatagccaagttttttcttggttatctttaatattacactttgatggttaacttgttataatgtattacaaaaatattaacatcatatggaataatctcctaatatgatacataacgctgaactacatacacttatttagcttaattattacaaattgttgactttttaaaatcatgtgcttgacagggccgaaccgaagacggaaaccaaatctcccgtgtcgctctctccagggcaacccgggaggcgaggcgaccgtcaccaaggccagccgttcccacgcgtacaccgcctcgtcgccaccggcgacgctacgcccgttggggcggtgccgccgccggcgccccccctccccccacccaaacaccacgacctccttccaccgtcgccttcttcctttctctcttttccttttccacatccaaaactcttctactcggtgtcttgtctcccagccctgttgcagcctccggcgacggcagccggccgtggtggtgggtgggggatccgcctcctaccacgctcctcctccccttcggtcccgtcggagttggagcttgccgacggcttgctgcttccgccttctggcgaggttgtgcggtggggatgggccggacggcttgctacctgcaatgtcgtgcggtgggttgcgactccgcgtgtcgccggtggccagattcaccttccccgttttggttggatcagcagcgaccgaggggctgtgtgtagggcggcagtggatgaactcgggctgctccactgtggagtcgttgggtgtgtgctgccgatgtggtcgccttagtgacaacgctgccgtctttgccaatgtctgctcaattcccttttcttcttgtctacccggcggttggaagcattttgagccttgccacgaccagctcagcccaaaattgcatgtctaggagttcgctggtgcttgttgcctcctctaaatctcctcaattctagcatgcttctcattcgtttacttgggtctgtcttttcgttggcacacatgcttctccagcggttgtgatgctcccgatctaggttcttctctcatattgatgttccatccaccagtaagatccccatctgtttcatttctcttttgttcagcccccggatcgccttcaccctctccgcttgggtgtccctaactgcaatgttcagcggcccttcctcctttggggcttccttccctcgaagggcgttaaactggctagcaatttgttaaagcccgattgaagacgacttcttgagggtggcctatgaccccatccttcagtggcctagcctcctttggggcttctttccccaattgtcgttagtgggcattgattcaagcagcgacatgactaagtcgtatttctgacggcttgatgtggatggtcttggataaccacagtctttcgactgccagagaaccgagccggcatgcgcgtggcagtgatgccctctggcaccttcgattcctggtgtttcaagtctgcatgcgaattggatgatgtcgaattagggttctagcattagtttgatttggaatttggttgggtgttcttgcaggtggcaaacgtcaaagcttctccgcttatatctatgcatttgtgtgtgtacttagtagggatgttgtgatgcatttgtattctcttctctgtatatctccgtgtattttttttattatcctccagcgcttctgtgcttgcgcagacgaatctgccctgtgtaagatcgttggaagtaatatattcaggtgggcattaattcgcccctagtgaccagtaaaaaaatcatgtgctttcacattttaggagagaaaaagggagagtatataacagtatagtaaacagctaagcatctgtgaccgaatattttgggacatagggaatacgcagttaggcatgtgtgcgcgcatatatgcggatgctattccagaatattttcgaattttacttagtaccaaccaattttaagctgcctagattttaacaacatagcaaataaaggaagcatcctgcgaagattttggtatatatgttgcccatgtgtttctctcccatggacatgaatacttttaattaacgtcaaatcaaacaatcaactttaactctacattctcaaaacgttggttaccagttttggcatgacatcaaaaaacaaaatggcccatcatgatttttttttgcctttgtttcttaggcctctcaagtgctcctagctggagcgttcatcagtagtgccacggaggattcgcgtcgacgtggagcgggcgaccgcgtcttagataggtttctcgcccccaagttgagcgacgcgaaacttcgttgcggcgagggcgcgagtggaaggggaaaagcaaggcacgcgcgctgtgggcagcgtttcttcgctgcctcgtgccctcgcgagcctgtgggggggtaaatccccaaatcaccctccaaaatccccacgacatcagagatgctagcaatttcagattgaaaaaacatccatctcgaaagaataatcaagaatagaaacagattgaatcacaattattcttcattaaaatctgagaaagagaacatagatgataaaacaagaaagcacaaaatcctttctctttcccagccggcggtggaggagctggagtgcggcgaagaaaccaagcagaaaacacaaaaacgccgccaagaacgctgtcgaccgcgcgccctttcttgacccgccaccaagaacaccgaggacgagcatgccctcctcccgaccaccgccttggccaggtcgatgccgagctccaccgccacgcgagcggccgacggcgaggcgaggcggcgccatcgaccccgccgccctttcttgagccgctgccaagaacgctgaggacgagcgcgccctcctcccggccgctgccttggccaggtcgacgccgagcggtcggcggcggcggctgccgcgcaccctcctcctcctcgcggcagcggcggttgctgccatgctcgccgtgtccacgtgcttagggtagagagcggtcctcccatcacggtcgcgcgcttccagcggatggagtcggtggagaggaggctcggcggtggaggggaggattaggagcggcagaagaggaggaggaggaagaaacgcgaatgaatcgagaggaggggaggataggagcggcagaagaagaggaggaggaagaaacgcggaccgctcgagggtagttgaggaataaattcgttccgcagacccgtgtccatgcgcttggggttccgcccactgtgggccctgtttccccacagtaacttcatccaattaagccacacatatatgggtgtttgcactgtggggtgaatgtatttggaccaattttttgaactaggggtacgagccccatagcttgcactgtgagaggccttagcattagcaactgaaattatgttgccctctaattcacggcactatatacttactgtacctacttatgtacctacatcttaataaatggcacgctagctaggatgtgtatatacgtgccctcaatctactatctctccgtcctaaagtatcgattacctctgcgttttaaaatatactcctcgtctctgacacgatgtcgttgatttttttaaacatatttaaccgttcgtcttatttaaaaatttaaataattattaatttgttttctattatttgatttattattaaatatacttttatgtatacatatagttttacatatttcataaaaatttttaaattagacgaatagtcaaatatgtttagaaaagtcaacggcgtcaaatatttagggatggatacagtaaaagattttgaatggatattttattatatattttaagacgaaatgagtatataacaatattagcgtgtaatgaagtaccgaacttttgtgtaagcggagggagtataggattataatgaaaagtacggcttcagcagacgatttacttaaactctaagcgtacgaatacgattcaggctgaaaactaaaaagatgttttgtatagctgcccttgatattgagtcatgtatatacattgttcgattacaactactccattccaaaatataataattttagcatttggaattgatcaaaaaatataacaatttctacactaacattctattctcaactaattacaacaccctccactattcaatttttacatatttaatttcacctactttctcaataactgtgttcacctttaaaaattcttatccaattacaatcttcacatatttaattccacttactttctcaataactgtattcacctttaaaaattcttatattctgggaaaggataatactagattactttctcatcataaaatatatcaacttttaacatttataatctatttcaaaatataacaacttcacttctccaaaccaactataaccatctctaatttattacttcacatacgttatcatctcaacaaatcacggtgattatcaatttaactttcacagccaaataaattatacttacaaagtagtactttttaacaagaaaaatgtttaaatgtcattctaaaagttagggacggtatggtacgtcgtatatttattgtaagttttttttaacttttaaataaaaatatgatataattatactacaattacactataaatgtactataattacagtacaattatatatataagttgtatgtaactaataaaaacatgtgtatcttattcgaaaaaaaaataaaaaacctgtgtacgatcgggtggatacggctgatgcatctgtacgggcagctaccgtcccaaaatacggagtataaagaacagggcgaggtggaagggggtactgatcgtataaacattcgtatttaaaagggaattaatagcttggaacgtacatacgttaaatgtaggcagccaaggacgtacagataccgtcccaaaatataaagaatatgattagagatggatatgaagaaaacatgtagaattatattgaaaaatattatgagtggttgagatgatgaagcatatggagaaattaaacagagaaaaaattgtgattgattaaaaagagaacatagatagatactacctccgtattttaatgtatgacgccgttgacttttcgatcaacgtttgaccattgtttttttcaaaatttttgtgtaaatataaaaatatttatgtcatacttaaagaacatttgatgatgaatcaagtcacattaaaataaatgataattacataaatttttttaataagacgaatggttaaacgttgaaaaaaaagtcaacaacgttatacattaaaatatggagggagtaagttattatattttagaacaaacttttgaacagaggaagttgtctatatactactataaaaagccactagtggtgatggtggctggttttgttaccaccacttttatactgtttacatatatttatcgatactgtacaataatttaatatttattttgaatcaaataaagtaaacaagtaataccatgatatttgataagaaatactccctccgtattttaatgtatgacaccgttgactttttaataaacgtttgaccactcgtcttattcaaaatttttatgcaaatataaaaatacttatatcatgcttaaagaacatttgatgataaatcaaatcacaataaaataaattataattacataattttttaaataagacgaaatgtcaaacatttgtcaaaaagtcaacggcgttatacattaaaatacggagggagtagtatattttgcttatgctattattatatatatatatttttcttttaaccatagtaaagtatgccattttgttactccctccatttcatattataaatcgttctatttgttaatttttttaagtttggctaagtttatagaaaaaatgacaacattgacaacactacattaatttcattaaatctaaaattaaatatattttaatgatatatttagcgttaaaaatagtactatgtttctctataaatttaattaagctaaaaaggtttaactagttagaaaattaaaacgacttataatataaaaatcaagggagcaatacagtactccatgaaagtaggcatgagcaaaatcagtcacatggatggaagtacagtttggtttgtctttccttggcaaggtaggcatggaactcgtacacatggatggacgtacagtttggtttgtctttccttggcaaggtaggcatggaactcgtacactcgtactaaagtagtaataataaaattagtagtacaagtagagtagagttgtattttctttatttttaaaatataagagattttaattggatatgatacatatagtactactcaattttcaattttcagtacagatttatagatttatagtatcaaagatatgtctcaactattcaaaatatcttatatttaagacgtagggaatatgtgagaccgggggttgctgttggcgcgcgtgcgccggcggcacgcgcgccaactgcttccggcccatcaagcccatcaaaccatcagccattttttccttttctcacgatttgtttttcctttttcttttgcgatatttttttctttttttctgattactttttttaatctttagcacacttattttttaaaaaaaatgttttgagctgaaagtttttaaatcttaaattgaaaaatttttaaatctgatttgaaagtattcaaatctcgagttgaaagttttggaatctgagttgaaaattttcgagtctgagttgaaagttttcaaatcttgagtcgaaagtttttgaattggactcgaaagttttcaaatctcgagtcgaaagtttttaaatctgagtcgaaagttttcatattttttcaaatcttaacttaaaaatttcaaatctgtacttgaaagttttcaaatctcaaattgaaagttttcaaatctgagttgaaagtttttaaatctgagttgaaagttttcaaatctcaatctggacaaactttcaagtccagatttgaaaaatttgaaaactttcaatttgagattcgaaaactttcagatcgagattcgaaaactttcaaatcaagatttgaaaaaaattgaaaattttcaaatcaagatttgaaaacattcaagtccagattcaaaaattttcaactcaaaatttaaaaactttcaaactcaagacatgctaaaagattaaaaaaataatcagaaaaaagtgtgaaaaaaaacgaaaaaatcggtaaataaaagaaaaaaaaaggtgggatgacgcgagcgcgcgtcggcgctgggccctttgggccgaaacgcgcaccgccggcacgcgcgtgcattagcgattccggtgagaccgtgagggtgcagggcacgaggagtccaggatcgagtaggcagtgttgtgaaacaaatctcttggagataagtttcttgtgggccaatccgaaccggagtagagataagatctatctcctcctaagacccctatatatacaggggcagggtgtgacatctatagctgatggctggcttgtacttcagatgagatctataatgaagagatagctccaccctatatctatgtttattgtctacttctgcaatgttcttgagtgcaaagggatgggcgtgggtgttctacatcatctcacgcctctactgctgtgggagggacagggaacggatccggtgatccgctaataggcgcgttggtttacaacatgttatcagcagctctccgttcaccggtttgtcgttccaatctgttgttgttgttgttagattaatttctaattacagattgatctgctatggtattgcttttgtctacagtaccatcgacgttgtcgatctgatcggtcgtaaactcgtagccacgccgccttgtgtgctcgtgcggcagctgcgcggccggccgatctcctccacgccacgtgcacgagaggaggcgccgcccaggccaatcgccaacacagcgagtacgtgaagcgatgtggtccgctgcaccacgcccgcagtcggcgggcatacgacgcgatttgcgggctctccacgtacgtgcatgcagctgcggcctgcgggcacgcctcggaggcgtgcgcaccgccggcctgggagttcgaccgtctgacattggttcatgccatcgatcggttgtgtgtgtatgcacgccggtcacaaggaccaaacggcgagccagccgcaaaagcccagcgcctcgcatgcatgaatgaattggtttgcatgcacgttggacaagcagatcgatcgacatgcatctcacatctacttagttgaagttaatttgttgatgctaattaaagattgattttttttttgcctgtttacatgtccggccggagctacgacgcgtgcggtcgtactgaccacgcgcacacatgtgcccaggactgcgcgcttggactcgccagatggctggccgcgtatgtggtacgcgcgcactacgcccagtaggagccttgcgatgcaggtgtacgtgcatatttttttggcgagcacgtaaactgaggtaattagtaagattagtttctaaactaatttactaatatatagatgcatccgggcatgtgtctattaaggtatgcggtctatatatatgtttttatgattgattatattttctcgtttttatcatattatggatgctttgcttgcagtagatttgatcctgctcttgatctagcggtagattaatttcctgcttttgatctatatatgcatctattttatttgatgaaaactagagaaaaccgtgtgagagaaatcactaaaattgatgggaaaccctagactggagacgtacctaattcggctaggccaaatcggccgtctcgcccgcctccctcgcatctctctgtttctctctttctctgatgatgccacaccgggaacacggtgacataatctcagtccgttttgctagacttggagacgtgtaaaccgtcgttcgctgtcgctgttgggtatgccgtcgaccttgtgtcgatgccgccgcaggaaaccgccgtttcggagaaagccctaaacccatgtcgttgttgccgctggagttaatgctgaagcgatgtgccgccatcgttgacctcccatcaacgctgccgtcgagccgtggtgggaggatgatgggtcgtcgcctgcctgctaccggattaacctccaccgagacgatatggccggatgcaatttggttgccgttgttgaggtctcagttgccgtcgttgaattcgcctcgccgccgtcatgaggatgcgcgggtcgacgcgaaactccgtcgtgtgccaccgagccgccaccgcaccaaattgccacacgggagtgatgtcgttgccgccgtcctgccaatcggggtagtggatgggtcgtcgatgacctcctcgccgtgcgccggcctaaatcccttcaaagtcgacagtcgacggcctccaacgccgccgccgtgcccgaggggcctgtgtgccaggaggtggacgccgttgcggacaatgaatgggaaaggggaaaccctaattccccccttccctctctcggtcacttaggcgaaccggctgggtcggtctgccttcgccataccgaataaagcccaatagtaacgagacagcccaaacaaattaataaaaataataaacctggaaatcctcatgggcctagagtttcggaaattcggcccattaggcattttgggctacactgtgcttgctagcccaaataagatcgtggcctgaacggtaattcggcctgattaatttcagtttattgacaacttgcgtttaagcccccggagtgttgggtttttatgctatagttcactgtttaaatgtcttgttgcttaggccctgtatagtttggttttgcatgtgggtcttcggactcgtaaataaccatgtaatggtgttttttaagcattgctttgcttttaaaattgatgcaattccaactaaataatctagagatggttctctaggttatgatgcttccataaattgtgttcacatagtgtagaatcccccattggaagcattatgatgggtttattttcctgcatttatgtgtgatggttttctgtgtggcataaatattgggaatataatgccaaataagaccaagtaaataatagaaaatcacctaatgcatggaaattctgggaaattaaatatccatggctatggataagaccactctttactgatacactcctccatacataaatggtgatatcgatgtgtctacaagatggagtcacgtatacttgttgtacgagatccatgcttttgccgaattcactgtgcaaatcgtccgtttgcgtgttgcgttctctaagaaccgcatgaaacgattcggatgatagtgtgggtgatttcacgtaaaggccctcaatgactattgtctggctttgggcattaatgtagatcactctatccctatgatcacactcaagaatgggattttgagtcgttgaaatatgtggaattagacaatgtgtttgggattcattgtgcctttcctctagtggcttaacatctcaatcagagtatggtcggactacggtcgacattttgctttcccaatggttgagagcatgcttttctgatttggagataaatgattatacctcaatttctggcaacgtggagttgcgaggttcaataatttgagatatttttcactcggtccggtgaaagatgtaaagtgttttccatgtggtggaacgacactgttcatatggttgcccctggtgtgcacatatcttctcaatattatttggaacctattgtcttgcgaggacaccggaaaattggaggcaaatctagcggaataagcccgagggtagatgctgtgaataggcgtgattcccactccactatagcgtcaacagctaaacttgggtgttgacccagtcttgtcctcgcgtggatctagcgctaatgaccacctttggttgatgtcgatggttggtggtgtctgtctaataagttgttctgacaacgggagttgtattgctagttttgagcatgtcctaggaggacattggccgctatactattgccaagcagtttatcttttgcttagtttggaactttgcattagatcgatatttctcagataaataacgttcttggtctttcatgttctattctaaagcttatcttcatgctggaattgataaaatgctttagtttagaagaacaattagtgtataatccgaggagttacaaccactcacacagtccgatgtaactgtatttcagacaaatgttggctatgcactattgcgttttatcgcgctctcgtagtcgatgactactccctagttgtgttggttgatcatccacgggttgatgaccatgcttgtcgcacactggcgtttttcgcttgtggacatgtgcaagcgatgcaaaggttcgtcgtgttgcatgcgttgagctcgttatgccaacgacggttgcaccgacacattccactatttttgtggatatgtctgaatataatggttttattatgaatattaccattgtcagaggtattgattatctcttgatggctatgtccaggggacattagcaaatgtggtttgataattcgctcatggatcgtacctaatacatgctgcttaactatgacccaattctagagtttggtatgagtaattggggtcaaacttgggcattaaacgagatggactttaaaacaactctgcaccacaaaaatcttcttggcagcgcaggctagtggccgcgcattttgctatcatactccttgttgagcgcatcagaatgcgttttgccaccataggttgccttcttaagcatatgacatgcgatgtctaacgcacgtcgatccggaatcgattgtgagtttgagtggcactaggtgagcattaatccatggagagtgcatttggctaaagtatttgcatgttggttgcatatacatttggtagcaatggtggtttttgcagacctgtatatcctaactaggaggttggggataacccttcggaagaaggaagaaaacagtattcatgccactgtattggtatatgtccaggctcactgcatataatggaaaaatctctcctattaaagtgtgtaatatttcccaaatatatcaccaccgtagcatacattcgtgggagaacatttgtgatcgaggtgaaattccttaatcctatgccacgatatggggattggtagtatgctattgtaagatatctcggcattagggggagagaattgcccattttggaatgcctggagatttctttgagtgaacgcactaaatgagctgaacttgtatgtttagttcatactcctggttgcttggtgcacggaatttttgccaacaaaatcatatgaggaacaactagatagttgtcaaaaatagtaatgctcccaattgtggtaaatgtggatagacccgggaataatatcgtgtccatataagacttatggcatttgatcatgttatgcggggacgcctgctaacacagtccgtaggcctcagtcagagcattagagttctcactggatgtgagcagactcctctaattctccgaaaggagaactcacctttggaaggtgacatacctcacaatgatgttcgtcatggagatgacattcctagcaatgcgcgcatattatggtgctaggaatacggaacaaccatggatcgatcgttttgggaaatgacgaagatctagttaaatgtgtaagtggggataaatgtgtcgacactatgtcgcctcttgctaataattctctgtgagagaacccggatccggaaaaagtccttggcatgagcatgcgatgctcaaatcgggtcaaatggaaatgcaattgaggctgaaccgaatcgctaagtaaaagtcgcgaatgttgttcagatttttacgggtcattattgagataatgaggtggtgatgtgcgatggttcaagtaggccctagatgagacatctcccacgttagttgaatgttctgctaaataaaggtattggcaaaatggcatgaaattaaatatgcagttagcggatttaggaaatccatgaggtcttgaatagactccatagtgaaattgcggcatgcaaatcttgtaccaatgggtattccggtaagagtaccatctcccgttgggagaaaatctcattgacagaattttctctaagggggagaccttattgatgaattttcctctgagatacaaaataattagtaagtctgaacacaccatattgtataatcccttggagggatgatgacccatttatgacccggtaagattgaaatgaggaacctgataagatcacagacggggtctataggcacatgtgcatctcgcgattatcattggagtgtgtacactcgtgaaatctgttccacctgatggttggaatggtggtgtcctctaatacctattgaggtatacttggtgttgttggctgtgtgttatcccccacagtgcttaaatttttagactagctagttactctgattgttacagcatgtctttggaaggcttatggttgatcttgtggatccccaattgttgttgacatcatcagagaaagttgcaatgatcaagacctagttcttgatggagtcacgccgagaaggtgcgtaccgttgtgacttatttatccccataatccttctgaaggatgaaacagattgcgttgcacaacactgtggtattgtggtatatgatagtgatggaatgcattactctctatgttccctattctcgttttagcggtgaaatgagacaagtcttttaagactaatggtttgaggatctgaaggattcttgcgtacgcatacatctgagagatgtttaatgctatgggaacatggtctgtgacaaaggttgtcatcagggggagtatgtgctatgtgttgattgtcatttgcgagacattgaaatgtcttagagtatgctcagggtattgactcgatgatgatcacttagacctgtttctaaggtcctatcataggaagacctgtctttattgaccgacaccagatacaagtgggctacctcagactactgaggcgaggtgaggtgagtagcaatttaagttgagtgataatctagagtattgatcacctagtctctcccaactgttagttctcgaaagcttttccggagaattgggataagaagactttgatgtttgctaggttcagggggagagcaccctagaacatgacccacagtatggaccgtgtagtctatagtgttgtactctttttccttgagtgagtggagctgttgttcctcacataaggtttttaacgaggcaacaacgtgcaatgcatgagcgataactatgtactctttctcctagcctttttcccactaggttttggtaggagttttgacgaggcatgagttagtcgcggattagcccaagggggagtgttgcgaaacaaatctcttagagataagtttcttgtgggccaatccgaaccggagtagagataagatctatctccttctaagacccctatatatacaggggcagggtgtgacatctatggctgatggctggcttgtacttcagatgagatctataatgaagagagagctccaccctatatctgtgttcattgtctacttctgcaatgttcttgagggcaaagggatgggcgcaagtgttctacatcatctcacgtctctattgctgtgggagggacagggaacggatccggtgattcgctaataggcgtgttggtttacaacaggcagattctccacggcatgaatctcaccgtagggctaggctgagcctggggagatcagccagcctagcccaccagacgccaaagatctcatagtccacaaactagagtcttcaggcctcatctcttgattgacctttagccgagaacaaatcagctcaaattacgaataagttcactttaagtccatcatgttaacgttgagtttgaatcatatccctcaaccgcaaaaacaagtataacgcatccctcatttttccaaactggtacaaatgtagtcccaagatagtattgaagccattttcacagacgtggaaacagaagcaaaattttattaaaaaaaatcatgtagaacccatatgtcagtgaaacatcatcttttcccttgtccctctccctccgtcggtagcgatggcgggcggagcagcatggacgcttcgagcagggagcaacgcagcaagtagagcggagcggcggcaggcatgctctgagcaaggagcagcaaagcaggca

SEQ ID NO: 23841 - DNA, 6889 bp, Oryza sativa
ggccttctcgcttcctcactcttcgcctcagtgggggcgtcgagctccctctctcttcggtggtacagcaatggaatagcttgcaggggatgaaagaaaggcaccgctatagccaccttcttgacctcccccaccattgcggtgaggaacgtggttcggtggcagctgcatgagctccaccgcccgatgacctcctgtgccacaaacgccgtagacgcggtaacccccaccataatcccctctgctgacattgtcgccgtcgctttcgccgtagcggcctccgccgcctccgctactagggcaagatccgccaaagagcgtgccactgccaccgctaggtttggagagatgtgagctgactgtcggcacgcgccagccctcatgtgaagagcttaaaagagagataggggaagagagggatagtgatgtttttttgtctaacatatggaccccattgttgtatatttctttttgtggactgtaatagccacggcacctaaaaccggtctcaataccgcttatgactacacttacaccggttttaaaagatcatggatgcattttaccctgtttttcggttgagtgataagattcaaactaggccttttgataggggacctagagtggacttattccccgaatcatttacagtgtgcggcaaacctcacttccagcttattagcaacgtgtagtccgtttgcacccattaaaaagctggcccaatttaaaagaccaaaccgttagcgttagcaggctttagctcctcctcgttcacgcaggcctgaaaattgtatgggcaaccacgcaacggatgaccacatgtgagttccaaagtaacgtgattttaaaaagagatctcaatccctccgcaacaaggaagaaaattgcttagaaaaagaaaaaaaatgtcgtaatttctttttaagttttttttttaaaatataactataataaataattctcgctgtcaacagagcaaaatggcttggcttggctggagcctggagcaagaagcatcaaccaccggcagccagctcgatcaaaatcagctcaacgtacctcgttgtcttccttcaaaacttgtttggttaatcctaaaagaaaacgaaattccacatcaatacatattaaataaaccatcaacaaatcaccctcaatctccttctgacatgattaaccaaaaaagatcttatggttctaattgtagagctccaacttctaaatttagcttcagaagttagggtttgaaatggagttgtggagctgcctaaacccaactccacttttctagttcattttgtcatgtgagagagctctattcagctccgctcctattttaagtggagctgaaactgtgtggctgaactctaactccagaagaaatagaactggagctggagttgtaccaagcccgtacgtacgctacatgcgcgatcaggatcgccttgcctcctccatcaaccgttctgtctggcctcctctactctcctatcccctttcttgaggaagaccggccacattcgaccaatccatctatcatcaccatcacaaaacaccacagctaatccagcaatattctagttgctgcactgcagtactacaccctaagtacgcagtcgcacacatgatttagctagttagcatgttttttttaattgttaaatgtcacgttttgtacataaaaaacaaaataaataaattgattattgtttgataattaacaatccattaattatatgctaatcataactctcgtgtgactaataaaatattttcaacctttgtctagaaggacctttaatcaagtgtcaatttaaagatgtgagatctcaatgtagtgactagtgaaacgaaaggaaattggaaagaagaaagaaaaccggcgatcgatgatcgaatgcaaaagtcaatcgcgtggctagcaagtgattgattcaacctcatcatcttaattcatttcctccatccattttcctcctctctgtagcatcttccgtctctgcttgcgtacccttctcttttaactactgtcttcaccgtacttctaggtcggtagccatatattggctgtgtttgggttaaaattggtatgatgtgactgaaaaatagtgtgtgtatgacaggttgatgtgatgaaaaaagttgaaagtttggattcaaagtttggatctaaacacagtcattgtcagcagcaagtcgcattaacagccaaacaacaatgtcacacattgaccttttaccctgctaataaagattcagcctaattcattctctccttttctcaatcagcatatgaagtaattaaccagcaggttaataatctcctcctgctgaaataatgcccttgtcatcaggaagtctcttggtccttggagcgttgcgctcttccagaagtagcacacgttcggtttgacgctgtcaatcttcggtgatgccactaggaaacaggtggtcacggacaatttcttttctggacaaggaaaaacgagagacatcggtgttcagttcaaccgagcgagcagaagctacggtgacctaacatttgttcgccgatgcaatgtgtatttgagagagagagaggggaaaagaagaagattgagaagatatataaaacaaggtgagatattagttagtacatgatttgactataaattattggggatggttaattggttggcgacatatttttgggtcaaaaatcttgcagaattcttactatgggatttgcttcgtgattcaggtttcagcgacctcttctccagcagctctaaggacacattcttctctagctccgatagctccaacggtcctgacataggcaaattaataaattcgagtttagagtcctagtttggggcggagatggaagggggtacatcgcttggcttatagggatgaccgcgggagacggtgaccgatggtggacatagacgagtgatgaagcggcggtggcggtggcgatgccaaagccgtgaggatataggagagcaggagagcagtgggccattgttgatggagagggcaaaaacaagcttatacttaaaaggtggctgctgatggtgatggatccgatgatggggagtcactagagacagggaaaatagcggagcgggggagagaagggaagaggatgagggaaggggaaggaggctggccagggaagggggggaggtgggggctcaccggtgctgttgatgccttttagccagccgacatggctggacggcagcacattgaggaggtgtcacggtcgagtgctcgagtcgtgtatcgcacgtggtggggctaggagggagaagtgaacaagggaggagaggatgtgtagggttagtttagaggttgtgtacaaagctcatagctatcaggcgatgtaaaattcacctgattaattcttagaggtgttttctttcaattggtagatagacaacctttaattattttgaacatgaaaaataaataaatatgactttttaaaacaattttcttatagatttttttttaaaaaaaacatactccatccgtcctaaaatataagcatttatggaccctgacacggtatccgagatgttattttgaccaataatatctataaaaataagatgttttaaataaaaagagttgtatattatgatagattgtttaatgataaatctagtaacatcaattttacatgattaattttttttactttaatggtaaaagttataaaagtttgacttgtcattacgctaaaaatgcttatatttttgtacggagggagtattatttatcggttcgataaacgtggacatgaataacaacggatttcttctctttgtccgctgcaaaagaacgcagccaaatcaagcgtgggtaacaacggatatgcttcgatctcgatcgcttgagtttgttgaatcgaacagccaaatgatggcgccgcgcggcgtgcaaaatcccagtccagtcaaaggattcatcaaggatgcctttgccgggcagaaataaagaaagatttgaggtgagatctgatgattcccggaggcaaagtaaacagtggccaacttgctttgcgatgcgtaggggcatatgcagtcaagcaggggcatcaatgccggcacgcacctcctctaccaaccttaatcctcctccctcacattcctttccttcctgcgcatcatggtgaaatcacgttttcttgacgaaataacgtgacaatcttgaggtatcgacgtgggacgaaagcggatttcggtgcgattttcgaatggttttctataaattcaagtttgaaacagtgaattctcgatcgaaatttgccgataactttcatacctcttaaggtcaagatcaccctagtccatcatataggtaaatcccattgccattgtcaaatgatagtccgtcaatagctaagatcctactgcgataatacaaggatatacgtctagatgtaatatagagagagtgagactcacgttttttatataggttcgagccccaaaagagtaatagcactacaccaatttatatggattggctagaaatatcagaccattgccaagtatgaggtgggttctataatctaatctagccaacacaactaatctcaacagaacataaatcggagattaagtcagcgaccagtcgtgggctcctataatcatagctttaaaccctgtcactgaacaccggattactaccagatatggttctgctgactatcacacgtcgatagcaatgacaaatgtcagtgaggtaataaactgataacattttcaaccattagcactttaccaaaatttgaaaactctaaacttctacttgaaatcctctaccttcaaacaaaaaaaaaaattctcatcctaccaaattgtggcaacgccaccaaaaaaaaaaaaaaagctcttactctcaaaattgatttttcatcattgttccggttaacacgcaatcgacttattagccacaacgtacaaatgtcttccaaaacatggcttgtatctaaagaattttgctaactagagtactactactcctaataattaacaagggtaccattttgtaccacgagctgctccatttaataagcagtatatatatatatactactccattgcttaagaatcaagacagctactaccattaccgtgtttcttcttagctgtactgagatacaagtgagagtgggcagaggagccgcgttgccggcgtgagcgcaccgcaaaattgcatgtggtcgtcgacctgcttcctcttccttccactcatcccatctaatccatccattcatcggaacgtacacgctttgccgcctccttttagagccccatcgattagcctaataaaccaaagcaaatgctaaaatttaaatttttaaacttaattttgatattgactttaagatattgttaacataattttttattaatgttggcttttaagtcgctacgaataaatatataagttttacctataaattaatttttatttcctgataaaatgtttcgagttattagaaaatataggtaactgataaagctctcaatcctctctttatggctgtgtttagatccaaacttctaattttttctatcacatcaacatatcatacacacacaaagtcacatcgtatcaatttcaaaccaaactttcaactttgaaaaggtgctcggcagctggttttctttctcttttctcaggtcaaaaaggcactagtctacaaatcctgcaatttttaggatagccatgcagagaagatggatgctgctgagtcagatgaataatgcccttttgtgcctgcatgtattatggtgaaggagatttcaatgactctcgttgacttttgtgtgatctcataatctttcggtccacctgtcaggatccggtcatcagatcatggtcagcggtcaatactccctactccagtatcatagcgtgtgtagctggataatctttctttatcctgatgaaacatgctccaagatggagcaaagaaccatgctggatgtgcacctaatgcatagtatttttttttataagctcttgttttgaccgattttaatggagaatcgaatcgttttggtgtttttttttcccaaacgatggtttgtgcgatgtgaatcgtgtgattgatgcaaagatgaaagtcattctgcccttcccttgcaacactgaatttgtttgaacacatcatggcagtactgaattttggccaaagaacaaagaaaaaatttgatctgtttctttctaggaaaaatttctctaaccatgtacaagtttgtctttctccagtctcgattcttttcctctctatcgaacgaagctgacaaattaatggagaatttgaatttctctttttttttttgggttttagaaaggcatgatgtgggtggtcttggagtcgtagccggcgaggcagctcttggcgttcaccttgaacatcttgaggagctccgacgccatctgcctcgccgccggcgagcacccgctctgcatcagcaggaggagcttcgtcagcccgccctccgacgccgccgccgcctccaccgcgcgccggtccctgtaccggtggcacaccgcccacagcaccgacaccgccgcctccgcgccgcccatcccgccgcacctcatcatcctcgacaccaccgccgggatcgccgcctccgccacctcgcacaccgccgcgcgcccctccgcgcaccccacggcggcctccagcacgcgcagcgcctgggcgtgcgacccgccgtggtggtccgtggccaggacgcgcacggcggccgggacggcgccgagacggaccatctcggcgcgcgcgcgccgcgtcgcggcgactatggcggcgaggcaggagaggccggcgtccacggcctgcgcgtcgaggctgcccttctcgttcgtggggccg

SEQ ID NO: 23842 - DNA, 2887 bp, Oryza sativa
gagcgcggcggcgacgcccctcctgttttcctcctcgatgcagtccgacgtggcgagcaccgcgagcacccggacggccgcctcgacggcttccacgccgccatcatcatcatcacccttccccctcctcctgagcaccgacgccacggtttccgccgcgccaccggccctcgcgagcgcgttcttgtcgaactcgtcgacgtcgtcgtcagacaggaacgccgcgagcttgcgcagcgccgggcacgggtccaccccgggcgccgcgacccggcggaggagctccgccgccgcagcagccggggtggggccaacagccgatggcgccgccggcgacgacggcgcggccgtggaggcccagagcgcgatgaggcggcggagggtgaggttggggacgaggtcggtggaggggagcgggagcatggtggcggggcaggtggtgttgccggagtcgatccagcgctggatggaggcgcggtcgtaggtgacgccggtgcagaggctcaccggcgagcgcatgacgtcgagggagatggggcaccggaagaacgtgggtaccttcacctccaggccctggtactccgccgcgagcctgccgccgccgccgcccatctccttcctcaccatggatggctgctgctcgatctcgttccgaccacaaacacttggtgttgcaacaatggcgatggcgagctgaggcctgagggtggaagtggaggagatggaatggaatggagtagaaaagggagaggaggaggaggaggaggatgaggggtccatgtggggggaggaggctagtattataggcagtggtggccttttcgtttcacaccctgactaaggaaacaatttacgaaacgctccttggattgtacaagtactctacctggaaatgaaatgcagaaatggcagctcagttcgtcctcacgcgctattttcaatgctagctttttttaaaaaagaaagaaatttatcacccacacgctattttaatgttagcttggaaatggacttctatgagaaatatagccaattaaatgtagaaagcatacggcagatcacccttttgaatgaaaaaggatatcattgaaagtagtttaatggtagttattcatcttcctatattattttgtactatcattggggattttttttctttaaaaataatgttagatttgttcctaacaatctgaaacatttacccttcgaagatatgcatgcaaattacaatatcgaatcataaatacatctacaataactctattatggaagcactcccaaaagcttgagtatgaacactttatatcttttgtcgtcatgccagctctaagaaacggtagcgaaaaatccgtggacatattttgaccgtgataactagcaagaaacaagccaaccttttatattcttaaaaaaaatatcagacttaaaattcttttgtgctgggctgcgagtagctttgtatagctttcttttgtctttttgttgacaccaaaataaaaaaaagggctatccaaacttgatgctacacaaagctatacactctctttgaaattcttaggatctcctaattacagacaaaaaattaattttgcaatgcactacatccaacaaaaattggagtgctcaaagctaccacagctacctagtacaaatctaaaaataacaaaaaaaaaacagtggacccactacaacaaaaaactcgtatagaggcacttttgtagaggcattttgtaaattgcttctacaatcagaagttttatagtgtagagacactttaaaaattgcctagaaaacttttactctagagacatttttatatcagtttgttagattttatcttgtagaggcattctttcggcactataaaatgcgtctaatatgtaaaggcattttgttgagacattttaaactatgtagagacactttttagaatgataatgtgtactaaacgactaaatataagtaattaaaggaacaaatatacaagtaatgacatggagttgagttggttagtgtatcgaagattaaaatgatttaaccaaaagatcatgagttcaagacttatcaaaagcaaggaaactattttattctcttttttgactggttttatatgtttgcggtacaatttagtctctaaaaaatgcctctaccatcttatagacattttataaaatgtctcttcgtttgtagagacaattcaccataagacacttattggacattttttaaaatgcctctacattgttgtaaaggcatttgataagtgcctctacagtactagaaaaatgtctatacagagtatttttcttgtagtgaccgtagatgaacgtccaagcaccaagttgtaattttggggctttgcagggtggccaacggaaggcagtgagaaactgaggtgtggaacgaggaaagctgggcagaggagaaagatggtcaaaggggaggaaacgaggatgacgtatggacggggcgccgaggaggtcgctgtcgtcgtcgacgctgctgctgcttttttgtggtcgtttttctcggcattgtttttcccgttttgccagttgtttttgctgccactcgaggcgaggcgacagctgcgtgagatgctgaaattccattctcattttctttcacctgtttaattatacgctctcgttaaggcttcattcttttttcacaaggagacagattttatcttgatttttgttattccgttttttaaactgctaaatagaggcattaaaaaactgctaaatagtatatttcatataaaatctttttatatagaaattgcttaaaaataatgctaaataaattattttttaaatctgtaataatcaaaatttaattattgatgcggtgacagcttttcttgtttatttttcatatccta

SEQ ID NO: 23843 - DNA, 1931 bp, Oryza sativa
tcgcataacgaaaattgtgctgtgatagtgctatttaaactatggtttatgcaatttgggcggtgactcgcatgatgcgtacgtagcacgtcgctagtgttcccatttggggtgagatagatttaatttgttgtccaggcttgctgaatgcagtcaactccctcatgcatgggttgtttttttttttttttatagaagtagggaaacagaatttgtgcatgagaagttgcctggacgtcctgttcctaaacggaaactaaggctctgtttattccaactttttttaaaaaaacttttaacttttttatcacatcgaactttcctatacacataaactttcaactttttcgttacatcgttccaatttcttcaatcttctaattttggcgtggaataaacgcaacctaaagtataaactttcagcttttccgttacatcgttctaatttcttcaatcttctaatttggcgtggaataaacgcaacctaaagtagtagttgaacgttctgacaacgagggcccatttttagcaagctttataaatatagctatggattatttgcttcacgtttctaaaaaaaaatatttttgtaaagaacctttatgtatcgtattaattagaccatatgttctaaattatttattaattattaaatttatttctaaaaatatgtattattattttactaaaataatctagcgaataagaagttttaaacaggcctcatatgcatgcgagggatcatgaatttcaaggggagagagaagaaatctgtttaactagaagcagattaatcactagtactactcatttcatcccaaaatataagactcaaccatccctaacataaagatcaaggaaaaaaattaatcaccttctttattgaatcatattcatacatactcccttcgtcccctaatataatggatttagacattttgcttgtactgtttgaccactcgtcttattcaaaaaatttgtgcaaatataaacaacgaaaagttgtgcttaaagtactttggataacaaagtaagtaaaaaataattttaaattttttaaataagatgaatggtaaaacagtgtaaacaaaatgtcaaaatcccttatattagagagcggagggagtacaagcaatggagcccatcgtttcgaaataagcgaaacgacatatttacaaacgaaaaatgatttgtgaataaaacttttatatacgtgttcttagcgatttaaaagcaaatgctgaaaaacaaacttcgatgaaaaaacccaaaatcaactccaaatttaaggttgaaaattcaaattttagctgataagcataagcataagcgaaaagatgaggccaattgggggggtctgatggtaaaggatttaaaataaaccaaatttaaatgattaagaagtgatagttaatgtatgcatgtatgcacgtcttatattatgagacatgagagaaaagtggttgtgtattatattttgggacagagggagtagtagagcatcaccaagagtatcccaataatcaattcctaaaactatatattttggatcttcaaaactgaatataggaagtgagaaaacctatctccaagagaaagcctaaaattgatttcctataatgaaaaataggctctccctttaactaccaagtaccaacggacaaaattaatttttctcttcctccttcattttgttaattttctctgtgcgcgcgcgagagagcgattgggaaaaaaaatcgctcccttgagcgggaatgacatatccagagttgggaatctggattattggaagacatgctagggattctgttggatgcgacttttaaccaaaattttctaaatttaaggatagggaatagaataagaaagctactggtgatgctcacccttaatttgttgagtactccctccgtattttaatgtatgac

SEQ ID NO: 23844 - DNA, 6580 bp, Oryza sativa
tatgtaattataatttattttattgtgacttgatttattattaaatgttctttaaacatgacataagtatttttttatttgcataaaaattttgaataagacgagtggtcaaacgttggttaaaaagtcaacggcgtcatacattaaaatacggagggtatattatacagcacgtatatacgtagaatggagcatgcatatggtacgtacgtataataccggtggatgtgaagtacgtactggtagcgtaaatgatggggactagccctagtccagccgttaatcggttgtttttagtggagagtcgatggcgcgtaagtaggtacgtaattagagcaggtacagtagcatactattaactagctataaatatattttaatgtgataaacaatgagagagaaaagtagcgggctacatatctgtagctagctgcagcacggactccaaaacacaatatatgtataatatgtgggaccatatattaatagcaactattgtatcaattggctattagattggttatagatgaccagtagtgggctatactattaaacttgctctttatgggggtgcattagagcaggtacaatagcaggctattagccggctataaacatattttaatgatataaacgatgagagagaagagcagcaggctacagatctgtagccagctgcagcacggactccaagacacactgtgtgtataacaggtggggccatatactaatagtatagtaaacaactattgtatgaattggctattagattggctataaatgaatggagctggtagtaggctgtactataagacttgctcttagccattagcaacagtgaacagggatcgaggtcggccaacgccaagctggaagaggacgttagctggtgccaccgcccccgcccgccgcccaagtacgcaggcacgcgccgtgtggcgccgtttactcgatcgtatatacgctgatacgcgcagacagctcagggagtgtactccaatatacgtctacgtctacgtctacgcgggggatttgactgcgcctggccccccgcggtaaaacacaaccatttggctgcgcctgtgcctgcgcctgcgcgcgcggaagtttctagacttgctacgaccactacacgacgccgtttgcctacgtggatccagtccgagacgcccgcggccggaagcaactgccaacggccaactggcacatggtagtaacggtttttctcggcattgtttttcccgttgccagttgtttttgctgccactggaggcgagatgagagatactgaaattcccttctcattttcttcacctgtttaattataccctctcgttaagaccatgttcttttttctctttaattaacatagtagtatactactagtccttacctcaatttttattagcatgtttttcaaactgctaaacggtgtgtttggtacgaaagctatatatacgaaagtcgctttaaaatataaatctattttccaagtttgtaataatgaaaactcaattaattttatactgatggcattcttgtttttcgtacctcaactttatcttcatcttcatactactcactccatctcaaattatacaacaacaaccttatctttagaaaaaccaaacttggtaacttttaactaataattacgctagcaagccaaaatctacatcaagtattgtgtatgttatattattattcgcaggggtgtgcttggacctgtgcgggctgtgctactgaacatggcccccaaattttaagggcccctaaaatattaagtatgtcccatatataataatattagaggctttaattttattaatttgcagtctaaatagtagtaaaacaaggcccaaaacgttgcagaaggtgaaccgatccatcttccatcgtactcccgtccaggcatcagcgtcgtcgcgtatcgccgaagtcccgacaccgcagccgcttcgtctcctctccccaatcccctccggcctccgcttctacttcatcgctgatgatcggctgatcgccacgcccgttttaaattttactataaaaaatttactaggctactaggaccccattttaatattttatatgggaacccgatttgaccgggacgcccctgattattcgtattttaaaatgttttcatgtgatatatactaaatttatacatcctgatgatacaatataaaatgaattaataatcaaaatataccattgaatatcgtataaaaaaatatatacttataatttagtaaagaggagtagaattttagatggaccggttttggtgccttggccccgttggcaatagtcaatttgcatactacagtactctccagtctccagcgatgttgcttaacgaaattgtgctgtgatagctctagttaaactttggtttatgcaatttgggcggtgacttgcatgatgcgtacgtaccacgtcgctagtgttcccatttgggtttttgttgtcttcgtcttgctgaatatagttgttcttttttttagaagtagtgaaacaaattaaattgcacaactatataatcaaacacatatataatgcgtgtgaagttgcctaggcgtcctgctcctaaacgcaaactaaagtggtaggtgaaaactctgaccacggtttcttttttttttaagaaaaaaaagcaaacttcattatagaaattaatactagattatttgctctacgcttctaaaaaatattttttaaaaaagctatcttgtactccctccgtcccaaaaaaaggcaaaccctggatttccgtgtccaacttcgactgtccgtcttatatgaaatctttttataattcatattttcattattgttagatgataaaatatgattaatattctatgcgtgacttgtctttttaatttttttcataattttttcaaataagacggacggtcaaatgttgggcacggaaaccagggtttgtctttttttttgggacggagggagtattgtattagttagactatatgttctgaattatttattaagtttatttctaaaaatatttattacatttatctcactaaaataatcaagtgagtaatcagttttaaatcacagaccctagatcatttgcgtagggtcatgaatttcaaaggggacacagaagaaaaaactgttgaactagatgagtctagaagcatattattactcattaatttgtttgttaacccctccagagaagacggctagctcagacctggtgagaagctaattaagcaatcggcggccttgtggacttattaccggcccggcgatttgttgactttatcgtgtacagaatgtacagtggaccatgcatatggtaccgtaatattgatcgatgacgaagtagcgtaatcgatggggactagctagctagtccagccgttaatcggttgtttttactccaaccgatcgatcgatcgatcggttttgacccgcacgcccggcccggccagtcgatcgagatgtacgtggagagtccacggcgcgtacgtacgctacgtacgtatcgggcggcgtcaaggtcggtgtagcaacgtacgcatgcatgcggccaaacgccaagctggcgccaccgcccacgcaggcaaaacgccgtgccgtttaataggatagccgactactatctccaaatcatcttatataatagttacttactatacaattaatatttggtcctacctacaatacacatagtacgtcttaaaatccgtgctacagctggctacagatctgtatcccgctgttctcctctcttttatcttatctctttaaaatatatttatagatggattatagtctgctactgtacctgctctcagtgtctccaaatacgtgtactactagtacgcgactacgcgggggcgggatttgactgcggctggccccgcggtgaaggtgagaagcatctatctatcgccgtcgatatccaacgcttggctagctagctgcgacgttaaccgtggccacctacctgaatgcttctcttcgaacgtccgaagcaagttgaaaaatcggatagcatcctctgacacatatacacatctctaaccatataacatgcacctttaacgatatttaaaacgaattttctcttaaattatttatctaatgtacaatccgatcacaccgttgtattcgttgtaattaaatctttacaacaagatgtctcatgattatatttcgataaaaaataatcatatgtttcaatccattaacacttttttgttttataggtgatagggacatgtttcaatatgtgtcttcagcgtgtttcacaaaattcacaaaataactgttactactctctctcctctctctctctccaccacatgcatgatgcatgcattttagctagtttcaaaacgatttttctcttaaactaattattcaatctacgattcgatcacaccgttgtattctttgtaattaaatctttacaacaagatatcacatgattatattttgatgaaagaaaaacatatgtttcaatccattaacattggttgttttatttgtgatagcgatatgttttaacgtgtatcttcatcatgtttcataatttttttaaatgtttcagttgctgattttttgtttcaccctatataacttgatgtttcactcgttagttaactggaacatttaactgactgattctttttttgcatgctgcatacgtaggtggtgtaatgacgtgtaaacagttgggcgtccgatattcggtggaatatcggagttccgaagcagagtcgtctccctacctgctgtgtgttggtcgatcgatcggcgcgcgcggaagtttctagatcttgactagcgctacgcgacgccgttttgttccgtatccctcccgaaggtacgtacgtacgtcgtcgtccaggtacagagtcgatcgactcctacgcggatcgagtccgagacgggcggctggaagctagctagctagtgccagctgccaactggcaaaactggcacgtactctagcttacgtgtgatgctcgcggctccaacgcagctcgctccatcggggtcacgccactgtttgcctccgccgcgctcttggatatttttctctctcattctctgcctacttaaactaaaatatatagcaatctacactgattaaacatatagtaataaaatgtattacatctgttatattctaaaacacgaaagtagctagctaaccccgtgacggagccaaaatgtactcaagagtaaggctgaactactataatctacataaatttgtcttttatttttcaatttttgaagtataatttctatggatatttgggcataagagtaagactctactcctatatatccgccccttagctaactatcgcgtctctacaattgttacgttaatgatttttttccccaagactaataatgttgctacgatatgctatactgagtgtacacgtacactgcattcgcacaagtggaaccaggatttttctaagtctaagactcaactaatgtataatttacatagttttgttttttgaagttttaaagtactacaattctaatggattaaagtagaagattagaattgttattcctgtctccgctcctgattcgcattacttcatcaccccatatctactactacttaaaaaataagaggtgcttccatcgtccgtcaaaaaaaccgggtgaaaaaaaaaccggaacgaatccgattcatcaacgcggtaaaagaaaaatcgggaaaaaaaaagaatatgtccgattccacgaaaataggaaacaaactcccatctgttataccaagtcctattcggttagcatcaccaggagaaccgacaccattcacagagagagagaaagagacgacgccgccacctctcccgcccccgtcggaccgcagccgcctccatgccgccgaatctggcggaggcgaggtccggcccgccgcccctcccacccccgccgggctgcagctgcctccacaccgccggatctggcggaggcgaggcccgaccggcgttccatgacgtccgccaccaccaccactgccgcacctccccaccatgcacagagagagagaaagagacgacgccgccgcctctcctgccctcgccggaccacagccgcttccatgccgccagatctggcggaggcgaggtccgggccgccgcccctcccgctcccgccgggccgcagccgcctccacgccgccgttgttcggggagagggcgccgcgccgttggttgtgggggagggcgccgccgccgccgctcgcgggaagaggggcgccgtcgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaa

SEQ ID NO: 23845 - DNA, 929 bp, Oryza sativa
cgtagagatttttgaaagttatatacaagttacattatagttacagtataattacatgcaagttacaatataattacactacgattgtattgtaattacatctgtcaaatttttgagagaaaatttatcgacaaatatatagtaaaatcgaaaccagatataactagtcccccaacttacaaaactagtgcaaacgaggtccatctgcggtttggatggtggttttggctgacgtgacgcatacgtaactagtttgacttggtcctcatcctacgtaacggtgatgtggcgctagagcaaaatataaaaattaaaacaaaaaatgtggaactcacatgtcagtcagatctggagggaaagaagagcggcctctccgctctcaccacgcgtcgcgtgccactcctctcacgctgctcgccgcgcccgctgtcctcgttgcgttcctctccctcttgatctgctgccatcggcgttcttggagcccgcaagccacaggtggccggctgtcacccgcttggatgacgcagccgtgggagcgggggaggatggaagagtcccatctggtttttgggtgcaaggacgaaaataagactgggctacaaattgaaggatctcaagtgaacttattccttctaaggttcttccactatactaaggtttttggaccaacaacaaaccgaaggcccaatacaataatgtttgacatgcagtgcctttatgggctataattagttgggctgatgtaatattcaggccaataaattaactcgagcttcctgtaaaaaaaaagaaaaaaaggaagaaactatttcacctacttgagctcccagttgctcgctttagctgttacatcaggctctctaccgataattgtttttccattcctttgtttataaaactattgaaaaaaaaactgccaacgagtagaa

SEQ ID NO: 23846 - DNA, 15729 bp, Oryza sativa
  unsure (1)..(15729): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtaaaaagtacatgaatcggggttgcatcctgaaagaaaaaggaatcgatgatttagttgtccgctccagccggtaggagtagtgtagtacgaagaaaagatgaaataataaagcagaagctgcattctgcgagaaaacgggacagcgagatgtcatccacaaaaaagctttgctaactgccatcttttcttaattagcagagtggaataatgttgattagtttaagcttgagcctcagatggacatcgacatctcatattctcatgctttaatatgtggtaatggcattggtggtagtcatgaagctagaacactcttgcattgtgtggttttttttatgaatatataataaaatacgtacattgaaaactatgtcaaagtcttagaccacgagtaaaaaagaatccagggagcaggaggttcagatggtttgatttgctaaatatatgtagtagtacttcgttgacaataatactcgatcgtataaagggttaaaaggctattttggagaactgagacttactatatactccatccgtttcacaatataagtcattctagtatttcctatattcatattgatactaatgaatctagatatatatatctatttagaatgacttacattatgaaacggaggaagtatatacagctagcactgcatcatgggctcatggcaataaaagagctcgatcacatcgaccaagatacaaaatacacgaaaatctcatacactggaatggttatctggataacaaacttgcatgagttcgatcgatctggccagggtccaatgatcccatcgcattcgctagctagctagctaagcccatgtttatatgaaatccattttaagaagaaggcagcaactaccagctgaaacggtagttaatcaccaaacatgcgtatctacatcatgcatgatgctactatgttagcgaagaatttaatattattattattggtaggaagtagtacgaaggaagaaatggaagctagggagggctccacagagacacaggtggtggatgtggttgcaaacagaaacagaaagtgtcgcgcactgccatggttgatggaactcttgataacttcattctttaaccatatagtataagctactccccctccaaaatataagcatttttagctatgaatctagataactgtgtgttcagattcacagctaaaacttgttatattttgaaacggaggtagtaatatatcttcttttcaatttacactggaatgttatataaatggtcccttcataacttcacataaaaactatcgtgggctcgtcgactctatgtatctgttatggagacccacatcgtttagagctttttatttgaaaaatgcagaattttgttttttaccgaattcagttcgattacttaaagaatgctttaaaaatcctattttacaaaggctctatgagtttctaaaatctatttatttgtacgtgactctaccatacctactatactgagatagtccacaaaactagtaatccaacggttctcgaggaagacaatagcggggaactagttttcaatcggtgccaacggtggctgcggcgttacctctccacataatcccactcctgacggggcaagaaacgatcgggttggcacaacaaggctggagagcgacgacgagtaggcgaggcgagaggatgaggaaggcatcagcggactgacaacatctcctccctttggatctgaatctggattggtggcatctcctctctttggatctagatcggcggctgttgatgaaaaaaatcgaacacaccggcctaggagatctgcttagctcctgtgcaggtccaaaagttgttgagatgagggcgtgccagtcagtttgatcctgcaactgacaagatatgcaaatagtagatcaaacagccgatcggctaacaaaccgatggagtagttccagccgatagtgataatagccgatgccgataccagccgatagcgatagcgtttaagcaatcggctatatgtccaatgtagataataatataaaggcaatcggctgatgatgatgtaataaaataacaatataatccagtataaaccaatcggcaaataatgatatgataaataagtatcgatccgaaagttaaagcacacatcggctggaggtccgatgtcatgaaatgcacaagattagattaaacagtgaaacctttgttgtcatcggctaaattcaacttatatgtatatgcaatccttatgagccgatgcaacgtccagataatttactggctgaaaccccgatgaacccttattggcagtcaaaaagcaggctagagattatggttctaagcacgacttagtagatcaaacttaactgatgcagcactaagtatgaaaagaaacacaatatctagacaatcaagccgatgactgattttcagggtggtagatgcctaagctaatctaatctaacaacgcgatttagccgataccggtagaaaccctaaagcgagaagcaaccgatagagctaaattgatatgctaagactagattaacagagacatatgataaataggtaggcaaatatatcatccaaaccagagcaatccaagaggtcgaatgtactgatgcagccttgaacgacgccgacgtagacgatacaattgcctgggccgacggaacattggacttaccccttcgccagagatcgaacatcgatgcagccccgcgtcaggtagggatgaaaacggagcggatacggacggataatgctcataccatattcgttttcatattttttgccggatacggaaacaaatacggatagctcgaatacggaaacaaatacggactatctcgaatacgaataagaatcgaatatgatcggacacgaatacggaaacaaatttttcttggaacacgaaaaccaattcaacttctaatagaaacaaatatcaacatatataattagctcattttatataaaatgtagtataatttataaatatttttaaaattttaaataatattaataatgtggactagtgttaagagatgaactactattaaaatctaaaaaggtatattgaaggtcatagagttataaagaaatggggtatgtcttgtggcttctgcggatatccgaattattattcgtatccgacggaaaccctgataccatattcgtattcgtatcgagagaaaataccgtattcgtatccgtatccgaactatccgatccgaaaggtatccgtattcgtttttatccggagcggacggaaactatccgctccgttttcatccctagcgtcaggtgccaagtcccgccggacgataaaataaagtagaaaagataaaaggtggcgatgcgccgaattgtattaatcgtgaagatagattacatagaccccgggtgtacatatttgtacccatgggttgatacaagttcttgtccgacaagaaataaactttcctaaagataaaaggcaagataaagtctttataggacactaaacacactttcctaaagataaaaggaaactaacgaactattcctaattaatagataacttgccatgccgcattctctttgaactcggtctcttctggataagctttctttagtatatcaatttccttaactgaatatagcaagaatccgacaactgacgacttgacaattctcatcggctaatctcaggacttcaaagccaatgctgactctaagccaataactattccgggcttaccaaatttcactgttaacagcggcatgcacgatttagatctggagcagtggcgaggtggctcgagcaccgacatagtgacacatgtgagagtcacacatcttcttggaggtgatgttctgacaccctctcggcctcttcctcattagtgcttggtagtgaactcttcggatgaaattctttgttctggatgccaggaattgcaccaatggcattctagatgttgcaaccttctcaaggatattgcattggaagtatcctattggtgtcgcgtctcgtgccagcatccccgtaggttgggtttggtggctatggcgatggcatgatctatatgaatgactgacttatagcttagttgctcttagtattttccgtgttggttcaacgttagttatcgactgtgatgatagcgaaatatgactgacaaggaaacaaatacagaacaaatgagtgtggcggttgccattttctgttgaactctataagagagtcagggagaccttttggaaaactacagaatgaacaaccacattatctctataattgtcatcttgtggtccaatcaatccatgtattttcttcaatattttacaatcttcagtgtttgcacttgaattcatcccatagttatatttttttccttatacattccctttttaatcattgtttcaaatagttgttctttaccacctcttcctaactttcacttgcttgtttttcatgtccacacttcccaactcattaaatagtttgttttttgaaagaaaatgcatatgaaagtttttttaataaatatattgatttatttttaagtttattttaactaataattaattaattatacagtaatccctccatcccattttgatcactctctaaaattgctgaggtattcccaaattgattgtcatctaactggtgtctatccatttacatgtgtaagagtaaatgtgttgcgtttctatccgtttatgtgtgtaggagtaaatgctatagttacatatccgtttgtttatttgtgcatgagtaaattgtattattgcatcctcacgtgcatgtctaacataatattttgatcgataaggtttaatttaagaaagaatgatgttttttttcttgatcacgataacacttatgaatatgatgatgaagaggtgtgtaaaacatagttgaagatgtggaaatgggtggttgtctctccctctcctcctttcttctccaagtcaacagttcctacgctaccaaacccgatcggacgcggacactgacagagccgacgccgacggacaccaaacttcctttcaaatcaagggttttagaaccccaccacccggttaaccttaagaaaaggaaggggccaattccgcccgcctctcccttgtccaaccacacaaaccattggcccctttcaacaacaacaacttaacttcttcaacaacggccttcaattcggcccccggctttttcttccggttccttcttttcgcgctgtgccggttcccggtcaccaccctcgtcgccgccttcttcctcctctcccttttcatgtacggcgaggaagttcgcaccctcgccgagctttccatcgacgactacctttaccccgacgccgatttttacaaagtttccggccttccccctttcctcctccccccggccacctgggaccttttccgcggccgaaggggaattgacaacaccttcctcccggcctacagggagaaggaatgcaccttcctcaccaagcaggtctcctgcctcgccaatggccgccccgacgacctatggcagtactggcgctggcaacccaacaactgctcgctccccacgtacttcccattccttctagttctagatctgccatttcatttcttccaaatggatcgatttgagttgattcgattgcaggttcgacgcgcggcggttcatggagaagatgcgggggaagaggatgatgttcgtgggggactcgctgaatcggaaccagtgggagtcgctggtgtgcctggtgcagcccatcctatccaagggcaggaagaagatcgtcaagcgcggttccttcaacatcttctacgccaaggagtatcgcgccaccctcgagttctactgggctccattcctcgtcgagtccaactccgacaaccccaatttccaccacatcgaccagcgcatcatcagccctgagcggatcgagagccatgccaacaactggaaggacgttgattacctcatcttcaacacctacatctggtggatgaacaacgaagacatcaaagtcaggtctgtacccaccaactttgatgttactacttcatttaaccaatttttagtttagctgggatttctagtgtgtttaaaatttctttcattttttttttatttttgcaggaggccaaattcaacttcttggtcagatcacgacgaggtgccaaggatcgagacctatggccgtgtgttcaagacttggtcgacctggctggaacagaatgttgatcctgccaggacttcggtgttcttcatgacaatttctcctcttcacaacaggtgatcataaaacttgcatttctgatttctctatctcttacctcctctctacttcctctctagttcaagcaatggcggttcgttacgaacatcaattagttcctccagggcagggcctaggaaaacttaatttggtaccttgaaatctttaatgttgtggaccactgtcggtttgcaataggacaccctacctatccctgataaagtggtttgttactcctaattacgttctgtacaagcaagcttcctcttgttccagtctgcagagcacagccactatgtcattgtccaccagaaaatgaggtcagttggacccgtttgttaggtttgcacgtgataaactaggaacaaatttgcctgactttctggggttttagagtctttcaaattccatagttcactagttggtcttggaataattccacactagttcactagtaggtcttggaataatcactcctgtatccgtatatgcatcagaatgacagaaagtatggtgctatgcacaaactagttacttcggaacataccaatgtctgaaatcagaaggcgtggtgctatgaacttactggattaacgcacctcattcctcaccttttatatatattatttccaaatatttaagaacaagtgaaccaattttaagtactttagtttggaaccactagtattatttcttgttttgtgtgattctcaaaggctctttgttcttttctggtttgttgcttgtgaagcacaaggtgccacaccattccatcacactatgcacgcacccatgtgaaaacaaccctccttttgttgttgtaccagatggtccaccaagaaatttgttgggttcttatattgtatatagacacacatatatatagactgggagtgcacccttggtgattcttttagtgagttttcatggtttcttcaaacaaaaatgcttctgtgcttgtgggtgtgggcaagcaatttaaatttcaaatggaacatttgggataggcacagtatagcctacaagattttgcatgctttagtgattctggcccattttgacaagacaattttcagcaaacataaaacgacgtaatgttcgaaatgttgtacctcaaggaaactgttcaccaatctcagagaaactgcaatgatgtggataactaccatacccacatacacaaatctcactattaaaaaatattgatattggctttgcctgaaagaagagtttctactgttaagaataatgatctgcaaaactaaatgcagtgtaaaaataggcttaatatgcttcttaaataagtctttgtttgatactccctctgtttcatattataagttgctttgacttcttttctagtcaaacttttttaagtttaatcaagtttatagaaaaatgtagcaacatctttaatacaaaataaacatattatcaaaatatatttaatgtttcatttaataaaactaatttggtgttgtaaattttgctaaatttttctacaatttggtcaaacttaaagaagtttgactaagaaaaaatcaaaatgacctataatatgaaacggatggagtacatgtattgggtagccatttttggaaagttgaatttgcaatcttttgagttaggttggtagttggtagatggcaaaaaatttgggggagtgttacttccaacaaaactctgatgcttttgctaggagaatttacatagaaagattagtctatgtcgatgtcacctagaccagccagaaaaaagaagctgtggtagtagattctatataaacagtaacatgaaactctcatgtatgctctttgatgtcaaaatctgatgtttgcagtagtaagatcggtataggtggccgttggttcaacactgatgctgtcatcaccttttgccaatttaatatagacgagccctgcagtgagcttcatagtcgcactctgttcagatccattgctaagacattttaaaaccaccttactgttgaagttagtgctactggaagtctggaactgtggaatatactaaaatataggcatcgtgtgaggtggttgtgagccttgtgcgtcatgacctgtgcaaagcaaagtactatgtgtactactagtatactttgtgaagttagtgtcggtgtcaaataatagtaatatttcatcttcatctgacatcttgaccccaatcctttcaaccatgagacaaagcatacatcatttggtgctttaggctttgattttattccacatcatttgtacagatattgatttgcaaatgatttgagcacagttgcttataaatcaagtcgctttcttgacatgttgggacatttacattctgatgcactcatgtaccggttgaaattaaggatagaatttaaatcaatcgtgtgtttgtgtcagcaaaagacctgctactgtttgttgttgtattgaactaatgatatctgctcttgaattaacattatggtacatgcatttctaatttatttacatcgctgaagcattttttcccctcttgtgatgctatcttaaaaacagcccagcacaatgggggaacccgaacgggatcaaatgcgtaaaggagacacttccagtcctcaactacaccaagccactggatctcaaccatgacatgcggatgtacgacctggtagcaaaagttgctaaaaacatgaagaatgttccagtgtcgttgatcgacatcacaaggatgtcagattacaggaaggatgcccacacatcattgtattccatccgtcagggtaaactgttgacaccggagcagaagggctgacccacagaagtacgctgactgcatccattggtgccttcctggggtaccagacgtctggaaccagatactctacaccaggatcctctccaaatcctcccctccatccacacatccctctctccctccacaatgacaagcagggagcatgatttttttttgccccatcgtatactatataggaaatgtatcattactattcaatttttttggtagtttggtgaagaaaatcaagctagagagagaaaggatggagtgggctgtttactggtggcatgtaaaatcgttcaattgaattgtaaattagttttgagctaaccaattgagcaaacagcactgttgtagacactcggtactctggactgtgaaatcagctggcaatacatatatacaggggggcacagtgattaatctgagatcaatttgttagtattatgtgttgatggcgtgatgcttttgtctgagaagagcagtcggtgtgagattggcccagatggccttccttttgtgtttgggccgtatgtgtgcatacgccaccttaacttccatttattcactcatcgaaataattaatttcacgtcgatcctactcctgagaaaaatatagctccttgagaaatcttttatgtattctgaagttcatgataaatcttgtctcagaaattacccatttcagttaaccgaagaaatcacctacaacgagacgataaatctttgtcttggaatcagctaactcctaacttatcagttgccattagcgaccttagcaaggtaatgtatttttaacccggagagtttaactaactcacaagaaaaaaaaaacagtcaacctcaaaacaagtctctgtataatccaaactatttctcctaatgcattttcgttgctctataagcaacaactcgcagcagcctgcctgcatctctttccagatcatacctacgttcacatgggcttaacagctcagcttcaccttatgcggctgagatttgctctaataagtgttatcagatctaagtgaagtagcagtagtagtgctaaaccaagaagatgaggccaactcccatgttgtacgaatacttaccgctagcatgtatctttgcagtggagcacccttaaatgttggtatttgcaaattgccctctaatggtagttggctagttgaagagcatagcagcgtcgtgctctttttttaaggcatataatcacttacaagccgaaaagtctaagcctaaatacataagcgtttttttcgtttggctttttaaaaactataagtcactttacactaacactattaagtcaaaagctatgtccggaaagttttttttggcttatatgagatagagatataactctaccactaaactaaggatttcaaatctatttgcttataaattatataaactaaaaaaactgacttaaaagtctaaacctaaacaatgagacccttatacatatgcttataagccaaaatttagtttattttacatcatttgcttttaatcgttaaatttatgcatataaaagttttactctcttattttttgcttgctaataagccatacggataagaaagcattggtgaaactatgagccgctaggtgttattaggcacaaatcattttgaaacaaccttttttctatgttcttttattcttaacggatttatagataaatatgcatgattttcgaacccttagacaatgtgactttgaaaaaaactttctatatatgaattttttagaaaaccatttaaacactatttttaactttataatatttaatttgtttgtttgtaaaatttataattaccacaaatcatccatccaatcagccatttagcacaaaagaaatctagcttggacaatatttagttggctacatcaatagtgacggggcaactctaaatattattgatggtagtatatcaccccttaaataaattaaacaatctagcttggacaacatttagttaactatatcaagaggcaccagaacttttgaccctttgaccatgagtttcatattataataactttagatgagaaagttaaggacctgtttagttcccaaacaaaatttctcacgttgtcacttcaaatgtttggacacatgtatggagtattaaatgtagagaaaaaccaattacacagttcaccaggaatttgcgagacaaatctttaaagcctaattgcgccatgattgacaatacggtgctacagtaaacatttgctaatgatggattaattaggtttaattaattcgtctcatagattcctgtgagtctgaaatttgttttgttattagattacgtttaatatttcaaatgtgtgtccgtatatccgatataacatgcatgggtaaattttttttgccaactaaacaaggcctaaaatgtacaaatccctttgagatgcttttaggaaactaataacttgggtgtgaagtagttaagggtgatttatgtcatcaagtaaacctgtgttagtaataaaattgatgggagtagtgggtgagagagtgaatacagggatgatggggggttattaaggaaaaagaggccatatgtttgttgcaaagcaatagagaagccaagcaggcagccactaaattgggttggggtgcctcctcctccctttctttctttcatctgcttcgtcctcagatccgatctctcttctcttgttctggggttggggtctcacgacccgccgcctttttcgtccccgtcgctctagaggggatctcaccgccagccgtctctcgccatggcggcggccaacgcccccatcgccatgcgcgaggcgctcacggtatcctcttctcctcttactcctccccgcgagatctcactcgtaaccaaggcggagctaatggcgcctgactcgtatctcttctcctcgctcgatgcagctcaccagcctggggatcgcgccccagttcgtcaccttcacccacgtcaccatggagtcggagaaatacatctgcgtccgcgagacctccccgcagaacagcgtcgtcatcgtcgacatggccatgcccgcgcagcccctccgcaggcccatcaccgccgactccgccctcatgaaccccaacacccgcatcctcgccctcaaaggttccttcctacctagatctacctgctatctactctttcggatcttcacttatttcctagcgatctactctcctactccctaatctttctactatttgcttaattcaaggagccatagactacctagcacattcattttgccatcctaccatagctggaaaccatactgttattcttaccatttgcttcatcttgttcaattcatcagaaatgtgtatgctaattgtggtttacctctataatttcgcgcacatgtataatttccagtaacaatatgttaaggactgacaaattatttagcttcgtgatctactatcaaaaaattcacgatgaatctcgatcaactgtgcattttacaacttcaagagtacttactccatagtaaaccaacagttttcatattctcatgctgctcattcctagtcacagtttccatgcccttgctagttgctactgactaggagtcgactatcatttcggttttcgcttatatttgtagccatggccacaacatcaacttattctcccataactccataagttaagcttaattttaacctcggattgggcttacatggatatttccacgctgttcttcctaattgaatacatgacgtacagatcatctggtcttgcacttgatgtttataatatatcctctccaggcaattgttcacttgttatactgtttcataccattgtcacgatttgttcatgcttcatgcttttgtatgtctatttttaggttgcttcagattggattcatactggcaataaatttttctaatgtttaccatcaccagtgtttgtctgacattcaacattcaatttaaaatgcctagtttatacattgacatcatggtgtctggctagcttactaattgcttacgtagaagcagaatgatatgtctttacttttgcaactttccagctgtttaacttttttttgttgctggaatttgcagctcaaatacctgggacaacacaggatcacctgcaaatcttcaacattgaggctaaaacaaaaattaagtcccaccagatgcctgagcaggtacaaaatttgaagttttgccaaagtatgcgtaaccactttgtttaaattgtatcctataatcttaatgtattctttgcatattttattttcttttcacaatcacaggttgtgttttggaaatggatcaccccaaagttgttgggtttggtaacacaaacatcagtttatcactggtcaattgagggtattgaactattgatctgaacttttgtccaattattattcgctgctttgcattatttggatcatatccatacaaaccaatgattttttttgcatgtatttgttgtaatacaggagattctgaaccggccaagatgttcgataggacggctaatttggccaacaatcaaattatcaactatcgatgtgatccatctgagaagtggcttgtgcttattggaattgcacctggtgctccagaggtatgtttgttaataagtgccgatataacaggctgcaatggtgtaaagatcaaaatccttttgggcatagtgtaaaagactacatatattttcgaaagttgtaggaaatatgctacacctatgctggagcagttcttaaaagtttattacgtaatgctttgttctatatcatcctaacattgatgtgctctctttttcacccatcagaggccacaactggtgaagggaaatatgcaacttttttctgtggatcagcaacgtagtcaggcacttgaagcccatgcagcatcctttgcatcatttaaggtaatgtccggtactccagttatatttgtgctggttacatattctttgttctactatttgccaaattttccttttatttttcctccacaggtcgtgggcaacgagaacccttcaactctcatctgctttgcctcaaagacaactaatgctgggcagatcacttctaagttgcatgttattgaattgggtgcccagccaggtttgtctctggaaattttcaagatttgttttgtttctattttcaagtttgtagcagagtaagaaataagtagaatgccttttatcaaacacacatttgtcatttagtgtagtcagtgctattctgcaaatggttctatattccaccccattcttctccttgtaggccattaacagtgaataaatgttcatggataaatcattcctctgttcactcgttcttcctatcatttatttcagggaaaccagggttttccaagaagcaagctgatctcttcttccccccagattttcaggatgattttcctgtggccatgcaggtgaatatcttgcactctaaaggaagtataccctgttagataccgcatagatctaatttttttaaattttctgtcaattacagatctctcagaagtatggccttatctatgtaattacgaagcttggccttttatttgtatatgacttggaaacagctgcagcggtctatagaaatagaattagtccagatcctatattcttgacagcagagtcttctgcaagtggtggtttttatgccatcaataggagaggacaggttttacatgccacagttaatgatgcaaccattgtgccttttgtcagcagtcaagtatgttctcctgcccttaaattacttggcttatgtgcttgctattatcgtttttaacacattttgttttatgcagttaaataaccttgaactagctgtaaatcttgccaaaagagctaatcttcctggggcagagaacttggtaagttccattacttctatgcttttgttgtgatgctgttacaattgcaatttacgcttgttacctatgctggttttatcagtggcatatattttcctgcaagatatgatagcgagtttaatgttttatattgcaggttgtgcaaaggtttcaagaattgtttgcacaaacaaaatacaaggaagcagctgagttggctgcagaatctcctcaaggtcttctccgaactcctgatactgttgcaaaatttcaggtgcatttctgctcttgattacagagctattaacacttcttcacctccattttacagctatttttcacattctgtactgttaaaagcttaaaattatgtgaactgatggatgatgcatcatgtttactatgctggccctagattatagagattagtgtgactcttaccatagcaatttcagcaatgcgactactatggtgacttctttataaaatcattgggctttatgaataaaaaaaatgttccttctgttttactgcataatggaaacacctggtaactacttaccgttactttcttgaggttttatttgataaatgcttcaaacatagtgaatgcattactattattattttcatttactttcctgtgttgggactgtacaactaatctttaaggcttaggttcttctgcttgactaagctttttcgtttctgtgctttaaaa

SEQ ID NO: 23847 - DNA, 5333 bp, Oryza sativa
tgtttcaggttggatacacccctgactacctcttcctcctccagaccattttacgtacggatccacaggtaatttattggttaagctattttgtgctagggtgaaatattctgctttgttctgtgggttgttgatttttatttgcaaaatttattatttactgtatatctcttttaccagggagctgtcaactttgcgctcatgatgtcacaaatggaggggggctgtccagttgattacaatactataactgatctcttccttcaggtatccttttaattcatttcaatgcatagtcggtatgtaatacctttgcttttttaccatgaaattcagttgtgtcttgccttaccatgcccattttttaacagagaaacatgatacgtgaggcaacagctttcctgctggatgttttaaagccaaacttgccggagcatgcttttcttcaaaccaaggttagcagttttttcccaataagttcggccttttacctttgcattgccatgttgctcagtggcttcttttacctttatactgttgtgttgctcagtagtttctgtttgaattgattgtaggttttggagatcaacttggtcacttacccaaatgttgctgatgccatccttgctaatggtatgttcagtcattatgatcgccctcgtgttgctcagctttgtgaaaaggctggcttgtacttgcgagctctccaggtcagtacctttttggtgttttggtttacttttttttttctttgcctgtctgtttaattaacattatattgtgatgcagcattacacagaattaccagatatcaagcgtgtcatggtgaatacccatgccattgagccacaggtttgttatcttaagttatgctttgttgcctgtctattattactggctggggtggtccatttacaccattattgaacaggcacttgttgagttctttggcactctttcaagagagtgggctttggagtgcatgaaggaccttctgctggtcaatctaagagggaatcttcaaattgttgtacaggtatttttgctacgtttagtttgaccttcccttttttgtcacttctcacattggttctgattattatcgaaacatgtgtcatatctgcaggctgccaaagaatactctgagcagctaggggttgatgcttgcataaaactgtttgagcaattcaaatcttacgagggcctttactttttcttgggagcttatttgagttccaggtagttaactacacctgatgttgatatgtgcgaagcaattttgtccttaacgtggcgcaccttaatatcgttctttacattcaacagtgaggatccagatattcatttcaaatacatagaagcagctgctaggactggacagatcaaagaagttgaacgtgtaaccagggaatccaacttttatgatgcggagaagacaaagaactttttaatggaagcgaaactgcctgatgcccgtccgctgattaatgtctgcgaccgctttggatttgttccagatttgacccactatctgtatacaaataatatgcttcggtatattgaaggctatgtacagaaagtatgcaactcttccaattcagtgttattggagtatcatcattctcatgtgctatgtatttaaatgcttattttcctttatattgtaggtgaaccctggaaatgctccattagttgttggacagctacttgatgatgagtgccctgaagatttcattaagggtttgattctgtctgtccgttctctccttcctgttgagccactagttgatgaatgcgagaagaggtatgattctttatattatcttgtattccacagccagcttaagggcatgtgcacatgcacacaaacatatgcttttttgtttcgttgctgatctcatcttttatatttcttttttcaggaaccgcctacggctgctgacacaatttttggagcacttagtgagcgagggtagccaagatgtccatgtgcacaatgctcttggaaaaatcatcattgacagcaacaataatcctgagcacttccttaccaccaatccattttatgactctcgcgtggtcggtaaatactgtgaaaagcgggatcctacccttgctgttgttgcttacagacgtggacagtgtgatgatgaacttattaatgtcaccaataaaaactcactgttcaagctgcaagctaggtatgcaaattgtttttattcttcataccttttaattttatttcttctgaatctttaaatccatctattgattgcttacatagaaatcgatttgaattgccaggtatgtggttgaaagaatggatggtgatctgtgggataaagttctacagcctgaaaattaattttaaagggcacttattgaccaagtgggttcttccggtttgccttaaaaccagaacccccagcaagtgtctgctggccgtcggctttcatgacagctgatcttccccatgaactgattgaacttcttgaaaagatcgtccttcaaaattctgctttcagtggaaacttcaatctgcagaaccttctcatcttgacagccatcaaggctgacccatctagggtcatggactatgtaacaggctggacaactttgatgggcctgctgttggagaagtagcagttgaagcacagctgtttgaggaggctttcgctatcttcaagaagttcaacttaaatgtgcaggctgtcaatgttctattggacaacatccgaagcatagaaagagctgaagagtttgcattccgtgttgaagaagatgctgtttggagccaggttgccaaggcccagttgcgtgaaggtttggttagtgaagcaattgagtccttcattcgtgcagatgatgcaacacatttcctcgacgtcatccgtgctgctgaggaagctaatgtatacgatgatctagttaagtacttgcttatggtaaggcagaaggcaagggaacccaaagttgatggagaactcatctttgcgtatgctaagattgatagactcagtgatattgaagagttcattctcatgccaaatgttgccaatcttcaaaatgttggtgatcgtctgtatgatgaagaactttatgaagcagcaaagatcatctatgccttcatctcaaactgggctaagctggctgttacccttgttaagctgaagcagttccaaggtgctgtggatgctgctcgcaaggctaacagtgctaaaacatggaaggaagtctgctttgcttgtgttgatgccgaggagttccggctagcacaaatatgtggtctcaatattattgtccaggtatatatacaggaccaacctgttagaactaaaacatatttcagtacaagtcttttcttatctagattttttctaacacccttttttttgtataggttgatgatttggaggaagtaagtgaatactaccagaacagaggatgtttcaatgaacttatttccctcatggaaagtggtctaggactggagcgtgctcacatgggcatcttcacagaattaggagtcctctatgctagatatcgccctgagaagctcatggaacatatcaaacttttctccacacgtctcaacattcctaagcttatccgtgcttgtgatgaacagcagcactggaaagagcttacttacctatacatccagtatgatgaatttgacaatgctgccaccactattatgaaccattctccggatgcatgggatcatatgcaatttaaggatgttgctgttaaagttgcaaatgttgagctatactacaaggcagtgcacttctatctgcaagagcatcctgatctcatcaatgaccttctcaatgtactcgcgcttcgtttggatcatacaagagtcgtggacataatgcgcaaggtttgttttttatggcagggccttctattggtctatcagttttgctccgtttcaaaattttgaactatttcattattctttgtacaggctggtcagttgcatcttgtgaaaccatacatggttgcagttcagagcaacaatgtctctgctgtgaatgaatctttgaatgagctttatgttgaagaggaggattatgagagactccgtgaatcggttgatatgcatgacaactttgatcagataggtcttgcccagaaggtaaagcgattagatgattgtactgcttattgatgttatttttccttttttttttattttgaataactaatggctggaatgccttgatcagcttgagaagcatgaattgcttgagatgaggaggatcgctgcctacatttacaagaaggctggcagatggaagcaatctattgccctgtcgaagaaagacaacatgtacaaggattgcatggagacatgctcacagtctggtgaccgcgagctgtcagaagatttgcttgtctatttcattgaacaggtttgatttaagcccataaatttctatcttatttttgggtggaatatttagcatgtagtatgctgcattaccttgtaacattgccatctcttctagttatatccaaaccatcctttttaatgctggttttaagggcattattttctggtcgatgatttttaaaaactaaccatgtagtgggggcgaatatgccttcagaaatccagtttctggagcattgccatctaaaaatagaccagctggactccaattgaagtgaaacaagccagctcacctgattttttattattatttaggcataatctgtattgcattctgatgagtaacatctataattggtattgcaaggaaagaaagaatgctttgcttcttgtctctttatttggtatgacttgatccgtgcggatgttgctcttgagcttgcatggatgaacaacatggtggactttgcattcccctatctgttacaggtatcttgtttccgttcatgtgtttgggactattcatttacgtacagttttccataacaacaaagcttgcttcatgtgcagttcattcgggagtacacaagcaaggttgatgagctagtgaaggacaggattgaatcacagaatgaagtaagggctaaagagaaggaagaaaaagatcttgttgctcagcaggtaatctatagagattgctcttcttttggttattattctgttattatttagtaggcagcatgacgagtggtattacattgtatggtgcagaacatgtatgcccaattgcttcctcttgccttgcctgctcctcctggtatgggcggtcctccaccgccaatggggatgccgggcatgcctccgatgggcggaatggggatgcctccgatgggtcctggacctatgccagcatatgggatgcctccaatgg

SEQ ID NO: 23848 - DNA, 11409 bp, Oryza sativa
acaattttggcgagtgaaatctctagccaggtcgagttaattgctggttgctatatatattatgttacgatgggataggatgagggatggttgttaggttgagcgggagctgcaaaggctggtaccattatttgtataggttgtgtgataaaaaagcttgtagacattttgcatgtacactttgccgtagtggttggcgttggcagccataaacaggaacaccattgtctgtatgttacttgtttacggtctcatgtccagctgtttgaattttgtacctgaaatatttttttctttggacaaaaagatggagtatttgaatatttcgctcttgccagtgacttgtgtattctataatattatatgggtttttctttgagtaaataaatgcatttgccaaccctggttgctgtggtgtacaacaaaacaatgcaagtgttcctcgatcggttgccttgttgcagccttcacccctgcgctgcatgctgtgtgatttgctaattgggtttgttatgaagctggttatccgaacaaaatcgacgcgtttgcatgtgatttgctagttggatttgttatgaagctggttatccgaacaaaatctacgcgtttgcatgtcgcttggtcaggaatcgatatgtagagagggttacgacggcagaagatggtgtttttcgtcgaagttgctcgattctgcaacattgactagactcttctatattgttaatctagaaagacccagtgcaatgcaaacaatgggctctgcccgtctgccgtcgtctaaaacgttgaaatggggaagctgcagggcagggcttactcttccatctcctcttgtgtctatccatcaacattgaacaaagttgtcctagacctagctattcttcctcgtgcgtgctatggcatgcaaattgcaaagtaaaaaaacaataaaattgaatgaatctatcatcatatggacacatgaggaattaccaagctatcaatctgtcatctgcactaattaaataattgacaacaaaagaatgaatgaatgagaaatagtgcaacaaaataaaacgtaggtcaagccatgagcatcatgaccctgaactcgtcaaaggagagcacgccgtcgccgttgaggtcgaacctgcaaatcatggccctgcactcctccatctccagccgctgatgctctgaccccagccgcctcagcatccgccgcaggctcgccggcgtgatcaccgccgtttcttcttcttccgggtacatgtcaaacgcctccctcaggcaccttaggctctcctccgttggctcctgcaactgatgagcagcaaagagcctcatgacctcgtgggggtccagcaagccgtccctgtcggtgtcggccgttgcaaggatcgccgccgcctcctcctcggacacctcctccccgagcgccgccgccatgcagccccgcagcggcggacgcggacaccttgccgtcgccgtccttgtcgaaggccgcgaacaccgacgaagctgacgatgccatggcactgtcagtgattatatggtatctaatctaaggagaggattaatctcggttgctcctggatcgacaatataatcagagttcgcaagaaatacgtatatatgtagtgagtctaatttgcgacttgtctctgctgcaacttactatcgaaatcatcggtcgatctgatgatagctatatactcctatatataagatgatagagatgatccagcaggcaatacttactaaggtaagaggacagaaggttcagcgttagttaattcccatatatttcgatgcatggagttcacgcctatagcagtggaccgaccgatccatatgatgcaaagaaacgtttccgcgtcattcaacaatttagtttttctagaacatgcatgcattgtgttgctcgtgtgtttaaattttcttctcgatctatatatgttattattaattattcagtttttcgtactccatttaacagtaacctggtcagtccttaattatttaattagcaccgtctgacggacgcgtagcagtatatagttacaaattaatcaatcatatatttatactgttataacatgtggtgtgttatcttgcacttaattaattcccttttgaagcacggaagcatgataaatctaatcatcagaagtcaaataaatcatctgaccagacggccaggtattagacagtcatttgcaagatactagtatgacattatgacttaatgccagagtatatcagaatgatcaagctagcaacgcgttagtagtcacacgtttttatataatattacatacttaatagataaatagaatagatagaaccaggtttgtttaagaagatgatatttaatttatactaccaatagttttttgaagtttatatcatcgtccatgtggcatgccatgttggcaagaccatggtcaggctttggaccgagatgatacgttaaaccaagtttaaggatctcgacgcacgttttgcaagttcgtggacctaagtgaaacctcgttacaagtttaagtattgctagtgtaatttacttattaattaattccaaaaacagaactagggaaatgctgcgcgccgggcgttcgatggcagtggaaaaatcggacgcctcggacgcccgcgcctactgccactcttactttaaaatgattttctcttaaactaattatccaatctacgatccgatcacaccgttatattcgttgtaattaaatctttacaacaagaccacacatgattatatttcgacaaaaaaaatattttagcttttctattgatattttttttaatgttgcatatgatctctttcgatgtttcaaccagtagttttacgatgtttcagcaagtgtatttgcgatgtttcactatgtacggatcaaatgttgcaatgaattttgatactatggaacgcgccgttgcaaaaaatcacccacatattttggaaaccccctattaagggaatttggtttattttttgttccaccaaaaatatttcacctagtgtacttacagtgtttcactgtatatagatctaatgttacagtgaaatgaaatattccattgcaacaaaaaacccacatattttggaaaccccctattaaggaaattcgttttattttttgttccaccgaaaaatatttcatctagtgtacttataatgtttcactatgtatggatcaaatattgcagcgaactgaaatattctttcgctatttgctgaaacattgtttttatataaggtgaaacaacacccgatttaaacgagtgaaacattttcgatctatttagtgaaacaattccgatatatctggtggaacatcgcgcaacatttaaaaataattcaataataagctaaaaaaatttcgtcggaatatatccatgtgtggtcttgttttgaagatttaattgcaacaaatttaatggtgtaatcgaatcatgatttggataagtaatttaagagaaaaatcagtttaaagtagttttttcacgtaaatcggacgctgatgtcgatttttcccccaatatcggacgtccgagccggagttgtctccacagaactaataaagagtcgatggtagaaataagcttagcttgtgttggggatatgcatgatggttttgaataggaagtaacagtaaggtaagggcattatgatgggctggatggaaattgttcagaaatgtttgatggttgatgttagggagatatatggatggatcgataacagttgggcaggagaaagaaagcggtgataagctagagtgggttggtactacatgctcccgtatccgattcctgttgggcctccagccttattactgtgtttatatatacatacatcaacaaggaaggaaggaagcctcaacggaacaaacttcaacgtggaaggaagaaaggaaggaaaagtgtcagcttgcgatgaagcggcggaaaatccccaacccacagcagcagcttgggcagatttacgtgttaccacgacgacgacaaccacaccgcggactccacgctgcgccgtggccgcctcctccgcgccctcgtcgtgtccttggaccccgtctccaacatcatatcctcaacgccctttggtaccacaccgcctaccctctccccacacaccaagagttgccacaggacatctccgacacccgcgccatgtctcccgctccctcgacggcctcgtcaccctcctccgtgccatcaccaccaccggtgacacactatccaaacatgaggccgtggtccacgcaatgtgacctcaccgacaagctgcagcagcagcacaccgtgacgatgaccaagaagaagaacccatacgccgcagcagccgaggcttccaagcacccgcagcacaccgcgctcgggtcattcctcctgtccctctccggcgacggcgagaagctcgaccggctgcgccacttgctgagatccattaccgatggctctggccgtgtcatctccgatgctgattgggagcagctaaacgcaatgatgatccaagagcggcttatgataaccaaaaagattggcagaaaaagagcgctgcctcctccatctgctgctccacacgacttggcagaattatccaagagaaggtcagcctatgtgaagcgacagaggtttgctcgcagcaacctagaggaattgcttctcaaatattgcagacaacatccttgggtacgtaaattgaattcacactagtacaaacttaattaccttttggtttcttgattgattaattatttaattaattgctgcacttgagattgattatgctaaaatgtgtttgtaattgcaggaaccaaggtacaagcttgatgtcatctgtggactggaggaacccaaatcctatcactggagaagctaccatgctaacttcctggcaagcgccaatggcactaatgtgctcaatggtggtgaggcaaacccccctgtgcgcaaactgttcttcgccgaattctgggactcacaatctggtcgatttaacaaatcaaattcaaagcccatctgctctcctgttcaaaattataatgcatgtttcggtgagtcactcaactcttgttcctactctactactatctccgtttcaggttataagactttttagcattgtctatatttatatagatgttaatgaatctaggtaacatatatataaatgtggataatgctagaaagtcttataatatgaaacggaggaagtaatttttatttttgtcaaggaatgtattagacaggcacaataattgtggcaatcgttattgcaatttgcatgcatgttaatgccctactggattggtgtaataataatattgttttggctttcccagcaggtcgcctttgcagcttctgtgatgaaccaagaacgatattgcatccaccatgtgcaactggaagtcattctaatgacgatgacgatgctgatgccgatgtcattcctgactacaatgttgatgatgccattcgtatgtatggctctgttgcgcccgagcttagtgagggcagggacttggtagagtcagacatcatttattttgatcacgaaaaggatgctgctaatctcacacaagttctcaatgacccctccttcaaagaagaggacaataatttaggtcggaggaggaagcagtagtaattaggttccaaaacagagcatgttatgtttgctagctcagatcaggaacaggcatctcatcagaaattactactagaagaaagctgtacttgatgtttgaccttggaactttgaaacttttgtttgattagccttggaaattaataacaatgccattttttttctcttacaaaaataaagcaaggctatgcgcctatgccaaaaagagtatatgctaatgctgtgacgagtgattagtgttcacaaagcacgcacatatgtttgagaaaactgatcaagttgaccaaaaaacaaatcttcaatcggtaattccatcagttgttgattttttaaaagaggaactagacgatgagtttattcaggaacttgtgtcaacaatggccggattagctgtcactctgtcagtgaggcacggaggcttaatttcatgaaaagaaaagattatgaatttccgacctcaatggtctcatggcttaaactacaattggtgccactcgaaaaataataagcttgttccccatgtacggcaatgtctccggcgagcagctcatcttccgtcatcctcagcggcacgaacgccctgacgacgaccaagatgatggacgtggcggccacgttccatgcggcaacgaacaatgcggcggcgacctgcttcaacacctgcaccccgccggcgcggacgccgtagacgaggccccttgagccggtcaccggaaggaacatgtcacagagagtagggtgcgcgaaaacgccggtgaggacgccgcccagaacaccggacaccgcgtgggtgtgcaggatgcccagcgtgtcgtctaccttgaacgacatggcggcgttcatggtgtagcatggcagtgtccccgacgcgacgcccattagcagagctgcccacccctgcaccagccctgccgccggagttatgcacaccaggccggtgatcatgccctgcaccgcgcccaccaccgacggcctcccgcggacggcgatgtcgcagcaaacccaagcgaggatgctggtggtggtgcagatgtgcgtgttgagcaccgccaccgacgagtcggtgttggcggagaaggggtcgccgccgttgaagccggtccaccccatccacaggatgcccgcgccggccaccatcgccaccaggttgccaccacccgccattgtcatttcctcctcctccttcctccttggtcccacccagtacgcggccgtgtagccggagacgccggcggcgaggtgaacgacgtagccgccggagtagtccatgacgccccagtggaagaggaagcccccgccccaaatgctgtacgctcccaccgtataggacagcgtcgtccacagcggcacgaacgccatccacgccttgacgctcatgcgcccgagcacggcgccggcgaccagccccacggtgacgccggcggaggcccactggaagaacaccatgctcgccgacgggtacagcggcgccaccgcggccgtctccacctcgccgttggagtggaggtggagggtgaaggggagcagcgcctgggtgagcatgtagtgctgggcgagcgccggggcggggcggccgacgaagggcaggaggcggtggccgaaggccatgttgtgcgcccagagcgcccagcacggcatggtggcggccatggcgtagagcgccatgaatgcggaggtgagcgcgcacttgcgggtgacggcgccggcgtagaagagggcgagaccggggaagccctgcagggcgacgagcgtggcggagagcatctgccaggcgttgtcgcccttgttcagccactccggcaccgccaccgacgccattgctcttcctagtttgagttcgatctgctgcttcatctacttacaagatgatgatgatagtaacaatgtagtagtatattgattaataaaccatgtagtagtacagtcctaactaacaggacatatggagtagtaacaacctatgagagagaaaagtcgtgtgtctgctacggtgaattggggtgatctcattaacaagagtgcaactcactcacttgtgagtataaaatgtatagctcattaaccaacgatatatatatagcttgactggtggacaggagacaagagaaaatatcaagttctagggcttaccaacatagttgaaggaatctcagtttgtaaccccaatgagtttccttaatgaagcctggcagcccgagtcttacaaattttcagtattcattcatgacataaaaaaggtttggtctatctttatcatcaccgttgagatatgaactggaaataacatttcggaaattttctatccgaaagaattaaataaaagaaacaggaagaatgaaatttacaaaacaaacaaacctgcacacaacactcacaaaggccccagggtaggctccaaaaacaactaaagagtacgttttttttcttttttttggcgagaaatcaaattaaagctaccaacgaattcattcaaggagtaacaattgttcggaaaagtttaaataccaccagatgaagcatgttagctgcgtagatgtgccaccctgttaataagacacgaagagttttatagaaaatactaggacaacgaacaccctgttaacatattacatttttcagatttccaacgtaccaagagcacagacgcttacattgaatgacctccttcggtcattccggcaaaaaagagcacagacgccatgcgcacgcacaataccaaaaactgcctcagcacaacaagacagcaagtgcgtcactgcaaactgggtgtgcaagccaaacaagcttaagaagaatcatcagcttcagctcgcagttgcgccaagccttccttgtaaacttcgaagtcatcagaggaccaccggcagacaaggtacagtcggaatgttgccatctgcatcccaagcaaccgctgcaatacagaaattaaagaggaccttaatgcaatggaatagaaagacataggattggccaatgtgttttaacttgtgtatttcttaaagtacataataattacgacaccacaaagatgttaccattggcttggtcacaatattaacatcatcaaaaatgccaatctgattttgcatttttttaatcatgcacgatatgcagtacataccagagtttgtgctgcttctggtgaaatgggcttcccttcttcacatactatgtgatctgcaactaattttaccgcacctgcatcaaccaggccaaactttacaaccatttcgcttggtgatttccaacacgcgcacaaaaaatgtagggaaactgctaacctttgttcagacgaactggcattccttgcttgcgtagaaagggttccatttcatgtgtaaactgttctaaggggccttccttaagctccacctgacatatcatcaggttctaaatttagtaaaccatgttttatgaagaagagagagtgaatagttattccagacattgtgcattgcagacaccacagctaaaacaaaatcaccaaagagcttaacactgtcaaagtgcttttgacttaattttccacaagttactgtaaatcctactactttcattcctaaaatcaccaaagagcttaacattgtcattggtaacgtcagcataaatctcgataagcatggtcattctagattgtttactgagaaaacaagccatgaacagaggtacataaatagaaaggataacttgaataccgtttctgtcgcaatacttcctgtcctggcgaaatcatgctcttcgaattctcgaaataatctgcagtggaatatatggcaaaaaaaaagctcatatcaagcataggcagtcatcatgtataagtataaagtgcaagccattggatgaggagactacctctctacatcatctcttggaagattagtaaagaacagtccagtatcaccttgtaggaactaaatacagaaaacatacatcaagtaagagctcataattcaaaggaatggtgtggattgtattatatgccaagtgttaagaaaggaaaatgtcaccttggaaagtttatgaaggcctgttttagcttcatcagcaggtgaacgccccaacgctatctgcatgaccttctttccagcaaggaatatcctgacataaagggagtatgtaagaatttcatcaaacagccaacctagaatagcctttgcaaatacatgcaaatatgttgtagttgcaaggttaaagcgaaaagcataaccgaaaagcgaaaattcaatctatgcagcatatcgtttgatgctttgagcagagaggcacagtactggctagactagtaatactaataataataagaggcagctacctgctggaggacttgagctgctctctgaggtccttgagcttctgattcctcatgttatcgtaggtgaagacataggcattagcgtagtgctcgacggcatctttgatatcggtaacaactttgcccttgcgctctaatccaggcttcttcttggtcttggataaggttactgcgctcgaatcaggggcacaaattagagctttggtgctgataactaactaattacaaaacaagagcgatctgtgcagaatatgcaggatagaaaaaaaaaataaaaagagaaggtttttggatctcccttggccttggggaaacagcatcacagcatagtctgtaccttactactggcgagtgaaaagcatgaatgaagtaaacaagctgtgcaaagtaaactgtatgattctctatgattagaactaacagcatatataaaattgcaaaagataggatatgagcgaggtaagaatagaatcagtcagatagatggatgagcaacgaatcgccgcggagtatagggattagatgcagttaccagggcggttgcgcttggatttcggcatcgcctcgtattctcagctcgtcctcgtcgtcggtgctgttgcggctggcggtggcggcggcgatgttgctctgtggggtggtggctctagggtttaacaagacgtcgtctgtttggatttggacacaaaggaaggaaagaagggaccattgggctggcctccttcatgggctcctcaatatatgggcttgaacatttttctcattttatatatgggtcgaatattccaacttaaatccttcaaatttcagccttcttcaattttttatgaaggaaatgtaaatgtatgttttgcactgcttcaactccagcttcatgtctcttggagctagagcccagacaaatagttttaacaccatctaaaatgaaagtagagttggttgaagcgctatcacaaaataaattagagaaacggatctgattttagactgctctaactccacttcaaacccaactactcgtccaccatctgatctcgccgtagggtcgatctagccgtccacgtgtcccagtgtgctggcccttccacgcccgtgtgatcgtcggattgtggacggacggcttggatttcgcgaaccggtaaaaaccctagccgcctgtcctctcctctccccacacccgtcggttcgctcgccgcctccgctcgcatgcgccgtcgccgcctccgctcgcgtgcgccatcgctgccgcagcccgcagctccctctcctctaccgtgctgcgccaccgctccctcctaatgagccgccggatctcccagtgaggaggccggggccgctgaatccggtgaccccggtctgctcgctggcggatccggcgcaaagacgccccacctcctccgtcgccgccgcagctcccttctcctctaccgtgctgctctggccgccg

SEQ ID NO: 23849 - DNA, 17891 bp, Oryza sativa
gccgccgccttttattccactgccatcgctgccctctcctccgatgccgatcccgatgccgccgcctccatccaaactgccttgactgtgtgccaggcgtcggcacaagccgccggtggtacttgccgccgttgatccgcaaccccactcttcccctccacaggttagccctaaactcccttgctccccattctccatgtccctcttctctcttctccattggaggtaggcgcaaggagcatttgtttttgtttttttctcttcacaattttgtaacgtagaagataggattactaaaccattgttgatcccatattattaaacatgtcagttctattgaactttttatatcttgatgaatgtgtatgatgatttacttgatactactttgatcaaacacacatattgctgtcatggtcttcttggatgctatattgctattggccagcttaagatgcttggattaggtctttttaagacttcatcagaatagttgcacctagcaaagtaaaaaccagcaacttagatggtccctcaagatgtcgaatagccatatccctaattcatcacattaaatctgaatgcaataaaatttgttaggctctatagttgagtagaaatgatatggttttttgacaaatcaccatctatttcctatatgcaggtaattttcagggcaactcattggctccgattttgggcacaattacaaaggtgtgatgaagatggagagtttctgaaagttgcatgtcgcgagttggagacaatggtgttaacgaccaaatttggtaatatcagtatcggaaaggaagattagatcgaagcggaatcaaagataaggattatagcggaaacagagtaagaatcgactggagtctggatcggctacgattggatcggctaagttcgagtcagacttggcttggtgatgcggccgattccgacaatacgacttggtgtacaacatcgggttgggttgatatgcttcaagatgattgccgcgcatggatatagtcctgagaaggcaattgtatctattaattaggatattttatgtaattcccttagaaatatgtttggcaaaagtctgccgcaaagacttatggtatcttagagtttgttagagataaaagtcgtgtccgatatggacatagtttgtaattctcgggtataaatagacctcgaaccccatttaattaaggaacacacacgttcaatacaatctcggcgcatcgccaccctttttgctttagttttatttcaacgagttcttactttcgggttgagctgtatctgtctcgatcttcaacaagaggtaaaacttgttatgacggcttgcgttctcgggattagtgcttccatctttatgatactctaatcttgtttatgtaattcatcgagttatcatatatcttacataatctctggcaatatcgctatctaacctacaatcggctaacatctgtcggtagagggcagccgattagattagacatcgatgttgacttagattatataggatatccaccactctatgaaacttctagcggcttgattggctagatatcgttcttcttttcatacttaatgctgcatcagttgagtttgatctattaagtcgtgtttagaatatcagtctctagcttgccttctggttgccgattagagtagtatcggggtttcagccgatcttacctgatttaactacatttattctatatgcttcgctgatatgttaaatctaccctctgtgctaagatcttgttgcatttacgtatattaggcctttgttcagtatattctacttgctttaatatcttagtatagagtggtatcggagtattagccgatacatgctatatctatctgatcggctatgctatgagtatatatagtcccattattaatatatatttcgatgtaagtgatttatactgtcttgacatggtgaccgatctatcccaatcacttgatttaagtatatatcgatatgaggagtatatattgttaatatctacagccgatcgagtagatttagttcctttttaattacttatgactgccgatcgatacatgtatgacatcggctcccagataaatgatatgtcatcggcacttagccgatcggctatcgtttataggttccacggtttatttgtctttgttttttgttgattgcaggatcaaatcaactggcacgctagcatacccgaaggcgagtttttgacctgcactggagttaagcagatctcccaggcctcgtgtttttcattaacaaatggttatgcaactttatgccaactatggatggagattaacaaataggctggaataaatgtgttcttcttattttggttttttcctatttaagtgtgttctattttatttgaactacactattatctcgagtgctactttgtaataattagctgtagctcttcttgagcaaaggccgggatattatattccatcatctaaaaaaatataagcagtctagctgattggtagtactagttcttttgcttttaaaaatgcgctcttgcaacctttaaatacaaagaaatacataatctagtatgcatgtattcatcgtctgtacacttaatcatcctttcctgccatattgggatttacacttgtatttttctactttttagccactcaattaatcttgcctttcaagtttcaacaaagaaaataaaccagtcaactgtggaatgcagcatgcatggttagagctatgaaatttgtggagcagatgtctgtgttgtacacatcttgcttcttagctcttcaaacgccttcatgctttcctcgtcaaagcctccggcaaactatacaacacacaagaataagttgtcttatgtcagaaaagaataagttgtcaagtagataaatttcaatttctcaatctattaacttattaaaggaataaaaaaaggagcatccacgttctctcttatggcctagaaattctcatattaatcggagaaaaagaaaagcagaattcatatagcaataaaattaagaaaaaacagaaattcggaattaaaaataaggaatattagaagtagagtatagagtccatatagaaatacaattaagaagtaatagaaaatcgaaattaaaaataaggagtattagaagtagagtatagagtccatatgaaaatacaattgagaagtaatagaaaatcagaattaaaaataaggaatattagaagtagattatagagtccatataggaatttaaaactaactaaaattcagaataaacataataaaattaaaagtagagtttagagttcgtataaaaatacaatttaaaaataactaaaattcgaaattaaaaaatgggaagaagagtctaaagtcaatataggaatacaattcagaagtaactgaaattcaaaattaaaaattaaagattatcaaaagatgaatttatagtccacatagaaatacaattagaaataataaaaattcagaattaaaaataaataatattggaagaagagcctagagtctatatagaaatacaatttacaaataacgaaaattcggaattaaaaaaaataaatattgaaagacgagtctagagttcatataggaatataatttacaaataactaaaatctgatattaaaaataattaataactaacacgtatataaaatacacatattaatattacacattagtagtttcataaagttagtataaaatttaaaattatgtggctattttaatatatttgaataatacattaaaaaaaacatatatgctattatatgagagaaaatataatgatgctagccgcgcaatctgcacgggccatcatgctagttcagattaatcaacaccatcatgttagttcagattaatcaacaccatcgtatatatgcccatgaattatacctgatgaactcggaaagcaaatctcacaccctgaagaagcaagaactctctgttgggctctttctcggtgccttgcaaggcatctagctctgtggcaaccctattcatatacttcttcgccagctgaacagatgccaatttgatctattcccaacataacaagatggaatttcgattttagatttcctacatggtctaacaaagtggcaatagatagaggctagagatgtatgttaaccttgccaactaccccggaatcagacagccaatccaccggtattccatactccctgtagcgtgatatggccatgtctctagtacgaagtagcgcataaacactctgctccactctgacataagtatgatacttgttagtccaattaaacatcaaatgcttatgcttgctaaagataattggacttgacaagatatttattatcttactctgaggaaccatgtaatttgggagaagaatggttcagaggagatgcttacgtttcaagcaaggaatacatcttcttgagagcttcttcacatgcaagctttggatcatcagtaaacgacgaaaccttgtgttctaattttagcaggtcttgatactcaaaggctgcctctcttagtgcatcagttttgctctctggccaatcaaagtgctttagtactgcccgctcatcgacctaaaacgttatttgaccctttttcagtactaactattttgtcatgtggtgcattgaaaaaaaaatagataagcttaccaagaaggatagttcctcatcaagccagtttacaaatgcaacaacgtcgtcgacgtttacaaaactagctgctcggacctcatttgctagagactcaacaaagtctccttgtgtctccacatccactttgacctgaaacaaatccatttttttatataaaaagtaagtcctcataataatctacctgaattagcagtggactaaaggaattcagtagtatatatttctgaaaggtagcatcatcttgaataacttacagctaagaggaatgttgatctattctcaatctctccaatcatgttgcttctcacatcagagacacttgatgttgttgatcccagagaagttgtgtccttcttggcttcacgcttcatgagactttgatagaactctacaacctctggagcacggtgtaccttgtcaccaccagcaagattcctaggtagggaaccagggcgtggtggcggcggtggcgggccaccaggtttgccaggaggcggtggtggaggaggtgcacctggcgggcgtggcggtggtggaggtaacgcacttgcagtgttggcagtggctgatggtgcaggaggtggcctaggaactcttggagctctcttctcaatatttgcaagtttcagttgtgtcacaactagagggttgttctggttatcactaggttggtcactggattcagcattagctgtaggagccttttcctttatttgagcaagttttggagggagtgcagatcttggagatggcacaatacctgaactgttgacaccgccatatctttgtaccctagctttctcggccttctcttttattgccttctcccgttctgtggcgagtttatgcctatctttgtaagcgggatacttgtcatcagcaaaaccttgtacagtctttgacatcaaatgaaatgaagatgcaacatttgcctcatccatgatatcactgggatcttgttccctctttccaaaggttgtaatgcccataccatctcctgcgtttctgagcatgagagcctctaggggcccctttggtttctggctggcgctctttggggagtcactagtgaaggactgtgtcggtgaagctaagctgcttccgtcatccttgccccttccccacttcttgagcttttgcatcagattgggccttttgccaaagaagctgtatctgctagaagaactgtcaactgaaacgttgtcgaagtcttcgcttctgggtgaagaaggtgcagaagaagcagtttcaaggtcagtgtcgccctgtcctcgttctgatcctgcatattccagcattagaagtttggccctctcacgcgattttgggctcagggtcttgttaaggtcacgagcagaaattttctcagacggtgcctggtagttgcggagctcatatctcagacaagcattaacccaacgcaggtaaaccaactcttctacttcactgaatctgttcatttgtaggccttctacttgcttggtaaggtcttcatttgcatgcctcagcttgttgatctcctctcttgcatgggaaactacatcactctgcacaatgataagctctgttattaatatatctgtatatgctgaaaatgaacataataaaaatatctattgctagttcattcttccttttctgagagaagcagtgtgaaattatgatgtggttttgaaatataagtttagctcttaatatagctatgcattattgaataggcaagggatttttcagttaaaccaatgctagtgtgtgcaagtctagtccaatggataatattcagcggttcaatcctttaccctctctcttcagcatgctcagatcatgctcctcttttcctaatcggtaatgacaaaagaggtagaccacccagttttagatttgaggcatattggttaagaattccaggtttcctagatgttgtgcaagaatcttggaacaagccgatactagccacgaactgtctcgctactttcagcctaaaacttcgtcgtcttgcccgtgatcttaagagatggaatcgcagtcaggtgggggatattacgctacagcttgcagtggcgatggaagttgtctttcaacttgacgtggcacaggagtcaagagttttaaccaatgatgagcggcagctatactcaaacctcaaagcacgtattttgggcctctcggttctgaataagttaaagatcaggcaacgttctaggttaacatggattaaggagggtgatgtaaattccaagttcttccatataaaagcaacctcaaggaggagaaagaacttcatccaatcactgaaaactccatcaggcttagcagtttcagccaaggataaagaagatgagttgtttagattctatagtgagaaattggggacaaattttcaaaggacgaagaatctgaattggaccaatttgcaactgccttcttttaatctgtccgagctagaggaagacatctcggaagaggaacttagaggaacgatttttggcatgcctcccgaaaaggctccaggtccggatggtttcattggagcttttttcaaagttgcctgggaaataatcaaaggtgaccttctagcagcggtgacttccttcatgaacctaagcacttcacatcttgaggagctaaattcggcctacatctttctgctgccaaagaaagatgacgcttcaggtgctgatcattttcgtcctattagcctcgtacacagttttaccaagataatcaccaaagtgttagcaaatcgtcttgcactgagactaaacgagatgatctctcaaaatcaaaatgcttttgtgcgaaaaagagcaattcatgataatttcatttttgttcaaaacttggttcagcgcttacacaggacaagaaaacagagtttgttcattaaagttgatattgccaaagctttcgatatggtgtgctggccttacctccttgatgttcttcgacagttcggctttggcaaccgttggctcaattggatctgcaacctttttgccacctcttcgtcccaggtccttctcaatggtgcaccgggacaaccaattcctcatgcgaggggtcttcgtcagggcgatcctctgtcaccaatgctctttattctcgccatggaacccttccactggattcttaaagcggccgaaggtgcttccatcctttctccgttagagagtaaccgcaacaggttccgttgctctttatatgctgatgatgtagctgttttcacaagaccagatgcgacagagctcaccaccctttcaaagcttctaaatttcttcgcgcaagttttaggcctccacacaaatgttgccaaaactgaaatttttcctattagatgtgaaggaattgatctagctcctttgttgcaaatcttcccaggcacaattaagtcctttccctgtcgttatcttggattgccactccactaccgaaaattgaggaaaattgattttctccccttaattgagaaaattggttcacgactccctacttggaaaggaaggtttttctcctcttcgggtcgcgaaaccctggtaaaaacggttcttagctcaatgccaatccaccatctttcggccctccaaatgccaaagtgggttttcaagagaattgataggtttcgaagatctttcctctggaagggcgaggacccagaccattcaaacccaggcagctgtttggtaaactggcagacagtgtgcagaccaaaatctttggggggattgggactccttgatttggaaaaattttctagagctctccgtctcaatggctgtggcttaaatggaaagacgaggacaaaccctgggctggtatgaatctgccttgtgatgatatcgataaaaggttgttccaagcagcaactacgatcgcagtgggcgacggagcaaaaacaagtttttggcatgatcattggcttcaaggctgctgccctaaagatattgcccctctttgttttcagctagcaaaaaggaaacaaagaaatgttcagttagaggtttcatcaaacaactggattctctccttcaggcaattctcgtcaatcgaagagatccacgacctcgtgcggctgggaggcatgcttcaagattttcatctatcacaaagtgccgacgatataacctggaattggaactccgcaggttgctactcaagtaaaagtgcatattcttaccaatttgaaggttctttcactcgtttggattttgtctctctttggaaggcgccagctgaacctaaaatgaggtctttgggatggcttattcttcaccacaaaactctaacggctcagaacctccttcagagacattggccttgcaattggatctgctgtctttgcaccgatgcctttgaggacactaatcatcttttttgcgaatgctccttttttaaagaagtttgggcactagttcacagttggcataatttgctagtttctaattcacagccggctgggatcgcttcttggtgggaggatatcaatcgacaaggctcagcaatccaaaagcaggatattagaggagttttgttaaccacttggtggaatgtttggcttgaaagaaataggagaatttttcacaataccacttgtacttcgttccaagtagcatactttgttaagcaggacctagatttgcggaggactgcttttagtcctccttgatttcctttttgtttctgggactgtaagttttttttttttctcctatcaattaaattccggcagctctcctgccgtcgtttccctcaaaaaaaaatatattcagtgttgataatgtgagaggaaagtctaaattctgagtccttgtcatgaaattgattgatggaatcccaagggaaaattaaaagaagaagaaaaaaaaataaagcctatcattttgtgcctatttttcttaatgtgaaaatgtaggacagcaaccagctgtctgcatgccacataaatcatgaaaaaaatatgtcaacattaaaaacaactgttgctgctgcaaatgatgccacgcaaatgtgaggctttaaaagcatataattgctgagtgaaaatgatactaatatcatacctctgttatttttccttgtgctgcatccagctttacgatgagatcccttttctcatacaaaagctccttgttcttcctcctcagctcaactacctccacttccagctccttgagcttcttcagcttcctctgcacctctgcgtccttgatggctgcctcctcctccttggacttcagcgcaatcacctggttctttagaagcaacagctgcccttttgtctggttcgcctccatctgtatctgtcgctgcagctccttgatcttgttcctcgcagcctccagctccctcttggctcctgtgccacgggcgacgtcatcctgcagcttcttcctctcctcttgcagcgagttgatggtcattttgagcatgtcgatctccaccatcttgatcttgagctgtctgtgtagctctacaacatcagtctcctgttccttgaggccatagtactctagcagctctccctcaagcttcacttccctctcctccagctcacgcacaagtccacgcagcctctccagctcggagttaacactgttgtaccgagagcgttctttgacgtcgaacctgtcacttggtagggggatgtcaatctcccctgataggaggctctcgatctcggagagcatgtcgtcatcatctgaaagagctgaattgattatgccgctgattgttttaacctcttccttctcttcttctttctccccctgaaccacagcaattgaaaagaacagttaaacgcatacgtgttcagaacagttacagttaaactcacaagttctaagctagtagagaatggcatgcacttacatgttcagagtagcgagttttatcctttcctttccttgcttggccatctgttgaagttcaacaagagcttcagtgagaaattcagaggaacaaattaaggaaggaagtgccactgcaagagagaagcaagtatagtacctctgttgccactgttggctctcttaagagttaaagctgcgacggaggctacaacaacgacgcctaacctgacaagcatggctccttgccctcatcactgtcccgggcaggagagctgacgacgcacagagctcccttggctcatcagaaactggcaagctatgagaatggcaagccagatatatcttgggctagagatagatagatacattggaggaggagagctccagctcgttgccttggaatgagtgaaactgtgaaagccactagaacatgtggcttgcaaacggttccttccaatttgtctgtctctatatgtttatctcttcccttgtttgcaaaaacagacaggacttgtatagcagacgagctcttttctgtgtgctagcagtgtggcacttactaatagctgacaaaatttacatatgctgacagtggcaggaagaaagcatgcatcttaatttgtggcttctgatttgcctgtcatgatacaagtacggcttgtggcttgaaagctagcttaatacgcaggctgtttcctgtgcacaaaaatgggtggtagctggcgtttgatagtgataattggatagcaaagaccagacgatagttgaggcttacgaggctcacaggatggagcattgcttatcattaccctcttctggacacacctgcaaagggcctgttggagatttactacagtagatctaaacagtaaatgggaacagtaatcaggcaagctgtaaaaagattactgcttacagagcactttgctacagtactgaagcgctgttcggtgcattgattcaccgtagcagtctcagaatactgtagctacagttattctctgctgcactgtagagaacctagatccgtttgggggagcttctaactgctgcagcttctcccagaatcagaagctcccctaaacagtctagcttctggtctagattctaagaagttgtagttgtagaatccataaaatgaagtagaagccagaagctgggaaacccagctgcttctcagaatcttaatctccctcaaacaagcccaaaaactaaaatactaataagctaataacacaccagtgcactcaccaaaagtattgattttctttttggcatatttttaggaatctggaggttcacatcttaattttattggcattgttttcaggcctgtaatctccatggaatggaagtgttggaataaatgggctaggcccaatttaattcaattaaaatctcaagagcccacaagtaatgttagagagaataatactgccttaaaaatttaggtggaagaacctcaacttaaatagggtgatattagatattccctgttgaccggttgaggtgatggttggactgccacacgcatgcgcgcatgccgagtcggcctcggccgtgggcgtagcgaggcgaggcggcagaccgagtcgagcctgcctgctgctcttccgttttgtaacagacgagaataaagtcaccattaacaaatgaaattcattgtgttgtaacctccgcaacaaatgagagattcattgtgttgtaacctccacaacaaatgagagattcattgtgttgtaacatccacaacaaatgagagatttatttgttgtaaccttcacaacaaatgaaagattcattatgtggtaaccttcacaacaaatgagatttattttgtagtaaccttcacaacaaatgagatttatttgtgtggtaatggagatctttctctctctacatataacgcaaggcagaggctctcaaagtgtgtgtcttcctcctactattgttccttggcgatactctccttctgttcctgcgctgtctctctgtttccccggttctgttcatcccgcgcgcacgggtgatcggaacgagcaggtgcctccgaaactccgtccgcttgagaacctgcacgggtaggcgggcgatcaagtttttgggttgcgcttcaagtgcgactgctctgcatcatgttcaccaacatgtcgacaaccggtgacaacaacaacactggagacaaggacaaggcaatactgcctcaaactccagcggagggccattctcggggtataacgtttcactattaccgttcgttcttcgtttcctacaactgtctgtcgcaatattattgcgttctcttatctatgttgatgcttattctatattaagcatgctcatgttgtacacatctagcactgtcactagatctactcaaattacaaatgtcatgtttattgtcttaatattttggattaaaatatgccgaattatgaccaaatttccaacaatccaaaaacttgataggtctttttcggtagttggctttgctgcatccctaaaaccacatgctttcgatggttcaaattataaaagatggaaagcacgtgcacttttgtggttgacggcggtgcattgtttctttgtctcacggggcaaaccaagtgaactgcctctctcacctgaggaggaggctaagttcgaggctgcggattgcttgttccgtggagcattgatcagtgtgctcgccgacaatattgtggacgtgtatatgcacatgccttcaaggaaggacatgtgggatgcttttgaggccaagttcggggtttccgatgccagcagcgagctgtatgtcatggagcagttctatgactacaagatggtcgatggtcgttctgtagtggaacaggctcatgagattcagatgttggcaaaggaacttgagaacaacaactgtgagttgcctgacaagtttgtggcaggtggcattattgccaaattgccaccttcttggacggactttgctacttctctaaaacacaagaggcaagagttcagtgttactgatcttattggctctttgggtgttgaggagaaggcgagggcaaaggacaaccggggcaaaaagatcgagggaggttctagcgccaatttggtgcagaagaagaaccctcacgcatcccacaacaacaacaagaaagtcaaacctgacgtcaaacccaaggctacaaccaattttaagaagaaaggcaagggaaaggcaaaaggaggttgctttgtgtatggcaagtctgggcattgggccaaggattgtcctgagtgcaaggacaagaagtctacaaacatggttattagtgagggcggaggaacatcgaggtatggtaaatttttacctacagttctctctgtctgtcactcacctgattggtgggttgatactggtgctaatattcatgtgtgtgtcgacatttccctgttttcttcttatcaggtcgggagaggttcctccttgttgatgggaaacggatcgcttgcggctgttcatggtgttggtacggtcgatctgaagtttatttcgggaaaaatcgtgcagctgaagaacgtgcagcatgtcccttcaataaagaagaatctagttagcggctctctattgtgtagagatggttttagacttgtgtttgaatccaataaatgtgttgtatctaaatatggaacgtttattggaaaaggttatgacagcggaggcttgttccgcttttccttggatgatatgtgtaataaagttgtgaaccatgtaagcaatgatgatgatgagtctaatgtgtgacattcacgactctgtcatgtgaattttggttgtatgacacgcttagccaacataagtttaattccaaaattcactttagtcaaaggctctaagtgccatacttatgttcaatcgaaacaacctcgcaagcctcacaaggcatctgaggcgaggaatttggcaccactagaacttgttcattccgatctgtgcgaaatgaacggcgtgttcactaaagggggaaagaaatatttcatgacactgatagatgattgcactagattctgctatgtgtacctattgaaaacaaaggatgaagcattacattacttcaagatctataaggctgaggtagaaaaccaactggaaaggaaaatcaaacggttgaggtctgataggggtggagagtatttttccaataagtttatttctttctgcgaagagtatgaaattattcattagaggacgcctccctattcaccccagtcaaacggggtagccgaaagaaagaaccgcactctaactgagatggtgaatgccatattagacactgcaggactttccaaggaatggtggggtgaggcaatattgactgcgtgtcatgtcctgaatagcattcctactaagcataaggaagtaacaccattcgaggaatgggaaaagaaaaaattaaatctctctcacctgcgcacatggggctgtttggccaaggtaaatatacctatagccaaaaagcgtaaacttgtaccaaaggccgtagattgtgtgatccttggttatgctatccacagtgtgggatatagtttcttcatagtaaattctgaagtaccagacatgtgtgatggtacaatcactgagtccagagatgccactttcttgagaatgaattttctatgcataaagcacatagtacttctagtcaagtacctattttatcccatgagcactctaagccgataatgcatattgatcaaacgcttgaggaaaatcctaaggaggataacattgtagcaactcgaaagagtaagagacaaaggactgcaaagtcttttggagatgactacattgtatatcttatggatgatactccaagaaccattgaagaggcatattcatctcctgatgctgactattggaaggaagcggtacgcagtgagatggactcaattatgtctaatggtacttgggaagtcgtcgagcgtccatatgggtgcaagcctgtaggatgcaaatgggttttcaagaaaaagcttaggcctgatggtacaattgaaaagtacaaggcaaggcttgtggccaagggttatacccaaaaagaaggcgaggactttttcgacacttattcaccggttgctcgcttgaccacgattcgagtactactcgctctggcagcctctcatggtctactcgtccatcagatggatgttaagacagctttcctcaatgaagagttggaggaggagatctatatggatcaactagatgggtatgtactagaaggtcagaagggaatggtgtgcaagctgttgaagtccttgtatggtctcaaacaagcgcctaagcaatggcatgagaagtttgataataaacttacatctgctggctttgttgtgaacgaagctgacaaatgtgtgtactatcgctatggtgggggagagggagtgatcttgtgtttatatgtcgatgacatattgatctttgggaccaggctcaatgtgattgaggaggtcaaggactttctgtccaaaagcattgaaatgaaggatttgggagtgggtggtgttattcttaacattaaactactgagaggagatgagggtgggattacacttgtgcaatctcactatgtggacaaggtcttgagtcgctttggttatagtgactgcaaagctgctcctactccttatgatcccagtgtgctattaaggaaaaaccgaagaatagcaagggatcaattgagatactctcagatcattggttcattgatgtacttagctagtgcaacgaggcctgacatctcatttgctgtgagcaagttgagccggtttttttcaaatccgggagatgatcattggcatgctcttgaaagagtaatacgctatctaaaagggacaatgagctatgaaattcactacgccgggtacccaaaagtgctggagggctatagtgattcaaattggatatctgatgctgatgagataaaggccacaagtgggtatgtgttcacacttggagggggcgttgtttcctaaaagtattgcaagtagaccatcttaacgaggtcaacaatagaagcagaactcacagctttagatactgccacagttgaggccgaatggcttcgtgagctcctgatggacttgccggtgcttaaaaaaccagttccagcaatcctgatgaactatgataatcaaacagtgattattaaagtgaacagttcgaaggacaacatgaagtcatccaggcatgttaaaagaagactgaagtctgtcagaaagcagaaaaactccggagtgatagcattggactatgtcgagacggctaaaaatctggcagatcagtttaccaaggggctaccacgtaatgtgatagactgtgcattgagggagatgggcttgagacccacttagagttgcacaatagtggaaacctgtccattgtgatcggagatcccgtgaatttggatggcgaaacaaactattgtgtagctgagagaagagaccctaaaatgagcctatcttcatgatgcacttctcttctaatctgtatggtaggatggtatacaccttaatgtgatccgagtggttttttataaagcagagatgttggcctgcagaacatcttaaaaggaacacacctatatgagtccaactgctagtcacagtctatgagatctgggtgatctctagatactcatgaaaaggccaggagtatgacttatacgctccaaacagaggggatgcaaacgacagcccagtaccagttaagggtttgagtgaaacctgaatcacacaagactgataattcaaggcatagtccattgttcagttgtgatctggtgtagctcttttctaaggtggaagttcaacttaacagtctccatcgaaacactggtataactaacaggttcagttttgagaacatttcttgtgagccatgaaatttggtgggaattgttggaataaatgggctaggcccaatttaattcaattaaaatctcaagagcccacaagtaatgttagagagaataatactgccttgaaaatttagatggaagaacctcaacttaaatagggtgatattagagattccctgttgaccggttgaggtgatggttggactgccacacgcatgcgcgcatgccgagtcggcctcggccgtgggcgtagcgaggcgaggcggccgaccgagtcgagcctgcctgctgctcttccgtttgtaacagacgagaataaagtcaccattaaaaattcattgtgttgtaacctccacaacaaatgagagattcattgtgttgtaacctccacaacaaatgagagattcattgtgttgtaacatccacaacaaatgaaagatttatttgttgtaaccttcacaacaaatgaaaaattcattatgtggg

SEQ ID NO: 23850 - DNA, 21619 bp, Oryza sativa
ttccccggttttgttcatcccgcgcgcacgggtgatcggaacgagcaggtgcctccgaaactccgtccgcttaagaacctgcacgggtaggcgggcgatcaagtttttaggtagcgcttcaagtgcgactgccttgcatcatcttcaccaacatgtcgacaaccggtgacaacaacaacaccggagacaaggagaagacaatactgcctcaaactccagcggagggccattctcggggtataacgtttcactattaccattcgttcttcgtttcctacaactgtctgtcgcaatattattgcgttctcttatctatgttgatgcttattctatattaagcatgctcatgttgtacacatctagcactgtcactagatctactcaaattacaaatgtcatgtttattgtcttaatattttggattaaaatatgccgaattatgaccaaatttccaacaggaagtctgttttaagggggaaaaaaggggctggcagcttgcacacaaccaccatacagaatagacattcagtttggacctgaaagtgaagattgctatctggtgtgtttttcctctcctcgagttttgctttactaatatcagacagtcagatactttttgttttccttgatcacaagatacaatcacaaaattatgattcttgcagcctgtatccatcgttgttacatctaatcgaatctgattttagtaagtcggttgtttttgagctctgcaaggcggctactcactagaacctgcccaagaacatctgattctgaacaagtgcagaaatatcgctgctgtcagcgctcatgcagcacaggtttctggccccaatataatagaaaacaaggacaccaatgaggacagaggcgagtggcacagtcagattgtcgtccaagcgtgtgctgatagggagcgactccacaattgcagcagaaagcgatgtcacgccaaaggcaatcaccatggtccagctctcctcgacaaatccgaagaggtggaagtagcacatgtacctggcaaatactccagtagtttcagattaacagctaccaagacttcagtagaaatgttgctattaaatagcttgttgcttacaggattgatgcaaggaaaccagctaagaacattgcaatggatccagcgtaagatttgtcagggttgtaaggaagctttatacggcctaactgccttccagctatgtcagctacacctgaaagaagcaacgcagagaattcggttgatgtctgaaacttttcacttgatgaatgaaaagagcagcccaaaatcgatagaagagtatcagcagaaaatttcaacttcaagctaaggccataccgtctccggcacacaagttgcaaatcacagcgattgaaatgggagatgtcctccagaaaataacagtagcgagagtcatagcacaagcgtagtacagtggtcctttaagaagctctctggaaacaaaaggaaaaggatggaaacggttattccattagtgaattaggtacacgaacagaactttgatgcaactatgatgctttgcaatgaagagaaaatctgtatgtctaaaaaaaaagctccttttttttgcagtattgtgagggaaatgaaatgagtacctagggtctccgttcctggtcatggagttaatgacaccatcatctttgacaataccaagtccaatcaaggtaacctttatgatgttgaatgcaatgacaatggaagcaagaaatggagcatagacatcatccgcactgcaatcaggaagagtacgttgtcaggaaggcagaaacacacttggtatgactatgactatgacaaaattaaagatactgctagtatattgttggtctggaactcgatcgatctggtttacctgaacaaaggccacatgaggaagtatactaagccaacagtaatgtgcacgagtttcctgcaaagtttctgaagatggacggcaaggagatactcccagttaagaatcagcaaatacgaaacaccatttgctgcagtattatatgtgatgtgactaacactggatctgacacaaacacctcaattagccaacaaattaatggtgtacttttggaaaattgccggcagctaatagggatctaaacacacttgtcatatcatgctacagagagctgaagtgaacagtaggtgaaggaagaagaggtgaggtgacatggtccaatagagcgcggttccagacctctttccagaagcgaagcacggcgagcgcggtggctccggtgagcacggcggcgccgggtcccggagcacctgactctccatgggtgaatcaatgcttctcttaccgccttggccgccacaaactcaatttcatttacttgtagttgaccttccttggattgtgcaagattggatccggacactgctgtactagtaccgctagctgacgatgatataatattcatcacgcttctcatatgtttctatattcttatatttcacaaaataaagttgagtttatttttaagaactttgtatgcttgtctaatactaccttagcatttcgtgagattatttttaaaattggttgagatataaaattgagaaacatatgagaaaaaaaaagaggaatagtgtatttttaatgatttgttaattttatattccattaataaagtcgagtttgttcatgcaactttgtagagttgtttatttatatattacctacttgtgtgattcttttaagacttcttgagagattctatagaaaatggacgtcactaggtagtgcattgtagtgctttagttctaaccgaagaccactctattccatatataattctcctttagcttatggtgcatgtctttttttaatctatttaatgacttatatcttttaaatcacatattccctccatcccataatataagggattttagagagatgtgacacaatctagtacaatgcatctggacggagagtctgtccagatacattgtactatgatgtgtcacatcgctcaaaaatcacttatattatgaaacggagggagtattattttcaaaatctatttgcatcattgtactctacataaaatatgtgactaaacaagatctatgttgaatatattcaaacattttattaatttaaaagtaatttatttaattgcagaagtaacttagcaatgaactagaagtaactctctatagcattagaaataattacattatgactgagttgaaataagaaactatgtagagtaaattcacaagtaaagtgtagaaaagatttttaagtaaatgcatttatgaaagtaaattcaataaaatctaaaagtaatttaaataaatcataaagtaatttagcataaaatggaagtaaattgttacaatattaaaagcaaattcgtcgtagagagaaaaatatggtctatctaaaaattaaattaaagtccacaaattatagaattgactaaaaacaataataaaaataatcaacttagagcattatgaatgtataagaagtaatttaatcaaatcgaaaagtaattgttatatatgataaaagtaacttacgtatataataaatgtcatttacaaacataaatattttttcatcataatataataatgtaagatcttgttgtaatgatttaattgtaacgaacataatggtgtaattggattattgtagatcggataagtaatttgagagaaaattttataagaagggaaaaaagacatgcatgcataatagcaaagaagacatgcatgtctatatagatgtgtagtctttctctgatgtatgtggtgtctccaattaagactaaatagagaggcctctcagttcaatacaatctcggcgcatcgccaccctttttactttcgttctatttcgacgagttcttactttcgggttgagctgcatcgattcgatcttcaactagaggtaagcttgtcatggcggcttgcgttctcggggttaatgcttccatctttatgacactttaatcctgtttatgtaattcgtcgagttatcatatacacgttgcaatctttgttagttgcactatataattttttatcggctggttcttaccattaggaagtgactgatagggttatgtattgttattaatctagattatatcgtgtatctaccatctcttagaggatttcatcatcttgcctagatcttatacttgtctttatgcttaatactgcatcggttgagttcgatctattaagtaatattcataattatgatatatggcttgctttatgatcatcgaaagagatagcatcggggtttcagccgatcttacctgatttagctactttatatcttatatgcttgattgatatgctaaatctgccctttatattaagatcttatcgcactaaagtatactaggcttcttgtttgatatattcttcctattttaatatcttaatatagagtagcatcggagtattagccgatacacgctagatctatctgatcggctatgctataaacatttataacatttgtgttaatgtatacttcgacctaagtgatttatactatctcggcatggtgaccggtctatccccatcacttagtttaattatacatcgttagaaggattatattgtcgttaatatctacaggccgatcgaatagattcagtcttatcttatttacctataactgctgatcgattccaatatgacatcggctcgaaaataaatgatatgtcatcggcaacggctatcgtttatggatttaaccgcggttttctcgtctttctttcttgttgattgcaggatcaaatcaactggcacgctcacgaacctaaaagcaagattttggacctgcactgaagttaagcagatcttccaggccagtgtgtgtttttcgcatcaacacagcggtggagacgaatggcatcgttgacccctatgctaaaagggcatcgtgccaggaatggagttgggcccctttgctactaggatgtagtatgcaatcaaaggacataaaaatggaatcctctcagaaaatagaacataacaatgatcacggtttgtttggagatcttataatcgtcaagaaatcaaatcagtggaagaggaaagattagatgaagagaaacaatgggggaaaaagaacagctagatagattaggacatgggattgatttttctgaattttatggatttttcatgaattatggaccacatttgaatagaattttgaaaaatccaaccaaaatctgccaaaactcttccatcggaattgggtgttatctttttaaaaaatatatggtggagtgatcgctagaatgggcacacccagtgcaatttttctaggtccgccactaggtggggtcgatgtcgatcatggaggtgggaggcacggcagtgatggtggaagacggaggccagtcagcacgccggtgggctgcagcgcacaacggcagtgggggtgttcttagggctgaagggtttgcggtggtgccacaggcctaggtggcgatgacggtgatggcgctgatgttggcaaaggtggtgggtggcaatgttggctagtcagcttggcatcgcactaggagcaaagttgagcacagcggtgatggaggtccgcggtgaaggcggcgtggttgtaacaagacaacctatgatagcaacatggtggagtttgtggtcgatgacaacgtttgtggcggctctccgatgagataagctaaggcagctcaacggaggttgtggctcatagcgatgacagcgtggcagtgacggtttccggtgagataattaagcttcggcggcttgacggagttgaggttctgcaacaaggacggtggggcagtgtgatggtttgcatgggatgtgaccatggtgtagtgatgcagacttttggcgagataagctacgataactctatagatgtggtatcctactatgatgacatggcggtgatggttgcgttgacactgagggagcatacactaggcggcatgaggctagtgcttgatattgacaaggctgcagggagggctagttctgcccctgtctttgctcacggcggatggagaagcttgaattggcagcgagagggcatggaggcggaagggaggattagttccacatcctccgaagtttgcaatgacgagggaaaacttggagctagtctcctagtcattttcatttcgttttttttctttgtatctcaattttaagatgttgagtgtatgcactcgtgtaacttttgcctgtgtatatccaattatggaatggatataaaggccggatttctatacattatttaaaaagttatcgaatatcaatctttcaataaaaaaagggaaatacaaatactcaaccaagaggttcaaaagaatcggcagaaaatagctaaggaatattcatcctaggccttacggctgtaactgcttagcacatccacaaaattttctgatggcattgtcgattccacacaaccccagaaaatgctcaattagcaatctcagggtgatacccggtgttttagttcaatcaagacatctcccctacaaaaatgggggaggaaatagttcagcattggcaatgatttcacgctgacatatgctccaggtccaggaaatttatagagtggcttcgcaatattttacatatataagtttacatactttttttacactttgcattaattctaagagttgacatcaaccataatgataaaaattagcaaacctgcctaacaagcagaaagttggatataggaacaaacagcattaactatagctgtgtcttcacctggaagcaacatggtaaaccatttcaacgtttttcaatgaatagaactaaaggaaagaactggtcatgcaccgaacaaaaccagaagctgctacggttgaactgaaattgttagtcctagcccttgtttagttcccaactttttttcaaactttcaacttttccatcacatcaaaattttcctacacacataaactttcaattttagtcaaactttcaattttggtgtggaactaaacacacccctagataggcggtgcataaaactatcagagataatttatgagttgcatggagatcgaagtcagagatctacagtgaaaaacacaaacagtcaatccatcatgaaccaatacactgtcaaatagttaatttcagatgcacatacttggaccagatattcctatatatagatctcaaatctcaatatatagcatgttctgtcaaaaaaaaaagaaaaagaaaaagaaaaaaatcattgtcaaacatgatatagagtgtttaataaggtgacttataggcatgctgttgagtagaactaaaccaaaataaaatagcatatagtagggggagctatagatctgcattactctctaaaatctgtataccaataattgaaattgcatatatacctcactaaacaaacaccaactccttagggaaattaacataaaccacaattattaatgaatcagtagatagatcaaccgggatcagctatattaatcaaaagatacgaaagataatgtgcaacagaaatacaataaatttatgtttatcttcctctagatacatgcgtaaaaggacaagtaccacaaaatatcaccacagtgtagtcatatggtgagatgaagagtacttgtccctgttgcatgagttttcttctttcctaatttgatttatcatccacaatgacatatgatctagctagtgatatctgatatatcaccagggaccagaccagtacagcacagcaatatagtagtggtaggactctgatgatgcatctttcaacaggggagacatgatcagaacaaagaaagagagagcccagtagcacaactctctgcttcttgatcaccaccaatagcaatagtagtatgatcatgatcttcctcatgtttcctccagctgatcaattctctcttcctcttctcgccccgcggacagatatcgagtgagagatcgagattaagaggacctccttgatggttactaccctcattgtagatcatctctttcagcactactggtctttgatggttcatggtatgatcatctggagatgaagaagagccttggacaaaatctggatggttgctgctggtattagctctagcttcagctggtggtggtgggtaatagggttttgatccaacaagcaggtgatggcctgcacggagccagtatgatccatggcatctccatggggaccatgcattggcaaccctatatatgtaaatatatatagtccattattagtgatcgatcggcgtcaataattagtcagaagaacaagttaagtgtatatgactttaggagaggacccatcggcagatttcaattatgcatacaagagtgtgctgcatgccagacaaataactaactaaagttgtctgagaaatttaatggattttgtttgcaagctagctagagttgcatgcatgcatggatctaacaactacctggactgcaagatggtaccggagccagcagtgatgtggcgatgatgaagagctgcaggcaaggaaagatggccaaggttgtacgcttgtcccccgtcaccaccaccttgcatttgcagatgatgatactgctgttcatctgaagatctccatgagccaccacctatcactgtatgcacaaaatcaatcaacatgttcatctgaagatctccaacactgcatcttacacaaaaaaaaattaaaatctgttcatgaagaattaattggtcatgtctggcacataccctggccagactcatcgatcttcttgcttctatacatctgaaaatcgaacatatggaagaaaaggcaacatggattaattttaggaaattaagaggaaatactactactgacctaaattaattaataagagcataagaaacgaaacaagtttgttaggtataatatacctggagatggctcttgacatggcctatgctaagccctctaacattcatcaactgaagaacgagcttaggagttgcacctataggaataattacatacaaagatgaatagtgaaattaacaacaggagcagattgaaatgagatcgatgagtaaataataaaattagtaatcgatcaatatatagatacacacatatgcgcatgtttagggaggaataattaatatcagactgaaccggaccgaacatgatgaagcttaattagctatggcaaatagataggtcggattgcttacgatcttggccgccgagcctgtcgacggcgcggacgaaggagagatggagctccggcgtccagcggaggcgagggttcttggagcggatgtaggggcgcaccgacgacgacgacgacgtgcgccgctggctctccccggattcctcctcctccgtagtactgctcgtcgagctcccatcgttgttggccgccgccgtcttactctcggagccctcctccttgcctgcactagttttttccatgacacaagctaggaaattataggaaggatcaccggccggccagcagccagctctgatcgatctatggcagcttgacgatatgatgatgaagagagctctagtctcgttgctgctgctgcatgatatcgccgccggccactgcactgatatgatgtcaaaagaggctataggagaagccaaaagctgaagctggagctgaggtcaccattcaattctatctatctacctagctacacccatatatatgtccagatgcatatatattgctgcctttttggaagggattgagctaagcatgcatgctcatatacaagtaactaccaatctactccagtagtaattaaggtagctagctaggtaattaaaggcagcaggtggattcatgcatgaggagaagtaggtaaatatataattaagatccagggacagacaatcttccaagaagtagctactccagtttggaattggttggaacttactcgatccaaagtctttgataggtttctctgagtcttacttgtagaattttcatcgatttctaacttgttaatttcctttttgtctcttagctagtatagtaagagcagtggactaaaggacccagtgtgaaaatgagagatggagaaaagagtccaagagacaaaattcagatgaagtatgaagagttccgggtctttgactagctccttgcactacatgccattttgtctctgtgcttgtctatgtgaacgcacgagtttttagtaatacttctatgtaggaggatgtacgtgtcaattgtcctcccgtcctgatatactcacgtaatttattttgtctacacattgtaccaatttttatttttaaaaaattattactcctaaaatataccatttttagaaggtgacacatgcattaagaaggactagaaaaacttatttgccttctccagatagttgaggtatatgctcggattataatagagcaagaggatattagcataatataatagttaagtagcaaaagttactttttacatatcctaggttgctacatcaacaacaaaatttgaactatcaaacttattattattttaggacggagggtgtagcatgtaaagtatatatgtgtgcttgtttcaattctaatattattaacataccaatgggtattactccaggacacctcatcagtatcggttcgtaaggatcatctatatatcttttttttaaccaagtataattttaccagtagtgaggattgagggggtcattaggacgggatgaaggtagaaaaccccccctatcagtgtttggtattatttaactggtcctgatagggcatcacacattttagccggttccatggcagtgatcaagtatatatgaaggtttaagaattagttggaatttcatagaaagtcgatgaaaacataaaggttgcaaagataatgtaaggaatgagtcatatgtatggactgaagaaagggaagatcatggtggttggcaaaaggttgaatgcctttttctagccttttgctttcctctcttcctggccccattgttcagctggtatttcctgcaggatgcatatatacatcaatacatgtataacacgtcagtatatctcatcatttacagttactctgatggagtatattgctgttgctgatgtgtactagtgttatttttcagttgagtaatatgccaagccaagcttgtgaaaatctccattgtttctttttaaaaaataatcatgtacccaaaggtttttataaatatgttcctttacatttttatatatcctttttgggatacaggtgttttcagtagaattcccagtgatgcaatattgaagtggaggaatctcgcagaataggtacaattgggatttccgttagtacgaaagcattactacaatccctcaatccctgtatgtgtgtattagcatacggataaccctgatgagtctaatggacacttcaattaaagtgcatgtactctcaacttcagaagatgttaatgtagaggtgaggtccatcattggactactcagaagacatcttaactaaacttttgaacgtatgaatgtaattaaaccagtagcactttatcttttaggtacattttgtacaacattaattaattctccctattgaccagctagcctgtttttctttgatacaaaagaaagagagaaaaccggtatatcattgttgaattgttgcctggtggcatgcttgttctctgaaaacttcatgaagcatataagcatacaacataggtttgatatatcaccgtttcaaaaataaggaactaataaagatcagctggcatgatgattactgaacagagagattggagagccatggatcagttacatcagtaccatagcaatgcatattatttgcccttttctcattattattccaatttggtacaatgcaagttcttccagctggtacctctggtttcaaagcaaaagagatctagctttttcaaaatctacattaaaaaccttctttttctttatcattccatttcaaagattaactaaccaccatttgcgaggaaaaattaactaactcactttcctaattagagaacatgaatgctaattatcatggagaccaattggaagataggaaaaggatcaagcttaattgccacaataaatagcatttcactgtatgacgatatcagttaattatgaccacagcactaagaaatcagctggagttgtactaggaattagctaggccttgttgactaacagaaacagtactagcatgagcttatatatttgcaaggccgttccgttcttagtttgtactatgactcaaccaactaattaccacctagctgatttgctgcgtgccgattagttcaagaattagagcgatacaagcagtggtgaggaaataaaacatgtcagctgttccaatgcagcatgcatctgcatgtgagaaatctagacaagagaataataagagaaaaagaaaggagcacacacatttgtcatatcagtccggcaagttcaccaaccttttgaatagctgaataacagaatttggtggtttgtcaaacatagtggctggttgccttacctgcacctgcagaaaaacgttgctgctcttcttcagcacctgacatgtattagacatgtcaccatcctcttagaaatcggaatgtctccaatctccccaactgcttgatcgacgaggtcacggcattagtcactgaatcaaattcagtataagctatgatactttttgtgcctctacatatgctcttctgtctgagaaaagctattcttcccatgcatagggcatagaattgttcccgattccagaatagttgaaaacagttaaacatgtttccatcatgtattccaaacaaggtcttcacagggtgcactgtatagtgtttctttgatgaaattgcagtgtaaaatcttacatgttgggactcatattagaacatgtagttccttttaacattattccaacaatgtacaacaccatatgtcgtagcttgcaggcttgcacagtcgattttttttcaccacagctgttctattgacaatgatacttgaacagaattatcatgtgactatcacttccactagcatggagaaaagcattgcaaactgatgcttctcacgactttcatttccgttttgattgtaaactttacaggtgtcaatatcacatcatagaccaggacaagaattcatcacccacagtttctgggcccttttttctggagagattaattgtggaggaagaaaaagaccaagagctgagggtcatagtgaggggaaaaggaaaatacagctattcatcttgtggcagaaagaaattagggcgaaaaaaagttcaactgtatccccgccttcccgaggtcataatcaaactgttttaggatgtggcagtaattcacctgggcaagaggggaaaaaattcattcagtaacaaaataattcaatttcatcagttactttagagggatgtcaaagacaaacctctatgcgaaataatcttgttggcacaactacaccaaatcctgcagaactcctgaatgtttgtagaaactcagcaagagggaatttcctgagatcaggctctgttagtttggcaagatttccagctgagacaaatgcatggccatggattcccagctccctgagaggcttcagaggtatatcaaatgacagatcagcaaaggctgtgaccgcaatgtcacctccccgtgcacttagctcaggagaagtggaagcaacattttcagaattctctggggtactgcttcccagtctgtccccagccctcttttcttgaaacctaatagtgatgatggtccacccaagcggcacataagagacctattgccacccaagtagaactgctctgaaagtggggatatagagcccgtcgatccccttgccaatgggtggatgatcccagcagccactccagcattaacggcgccattcaacacacccagcggtaaagccactcgaagatcaatttcctgatataatgtgaataaaatgagtgatgccagtgaaaaaagaacaatatgattcctgctagctctagtagtttaggcttgaatcagaacagttgtttaatatgaaaaaaattcagatgtcgagcacattagatattataaacagagataccaagttgtgccgttcaaaggcaaagttgttggtttctgcagagactaaaaagaaagggaaatgccacgaaagaatttggaatgcttgaacaaaacatttaattccagaagtctttggtactttagtgtcatgattcatatcacacatgaagaataaactgcttttaacaggcaaaaactatggagcaagtcatgtgatttcccctttcaaggaagtggcagatatagaacacaaaggtaaagttgttcaatatacctgtctaatgtaacgtgcatctttgctctctggtgcaaggcctccaacttgagaagaaaatagataagcatatcctcgtgtcggtcgaattcttgaatctctctggtcaaccttgtatgcatatttaatagaggacaaaaggctatgccctaactgcccccttatggaattggatgacatcagtgctcggtctgttatagttcgccatgacagattgtaagcgaggttatggttcatggtggagagcaaaccaacagaaacacccatcatgtgttctttgagtgaggacttcaaccagtcctcagagagaaatgatattcgagctaccagtggagtaggtattgctccaattcttggtattgccactccagtacttagctccactgtctgatctaatccaagatcaccggatgcatcccatgtctcacaatatccaaataggttcttcaacttcactgaaccttgaaccgaacatgatctagtctgcaataaattcaaaaggaattatgcggatgacacaagaagatttgaaaagcaattgaaatcatgcagcagatattggccatcatggcattttctactcccagcaaagtaggttatgaaactcgattcatggttcactagtaaaattgcattagaaaaaacaaagaaactgcagtggacgagttattctttattctccaagcaatcaaactagtgtaattgaagcaactaatataaccatatgcgcattttagagtagtccttaaagagagctgtgtgatttccacctaaaagcaacattgacacattgaattttatcgaaacaaatcgcattgattgactaagagatgcgcttaaaattttcctactcatgttcatcatcaaagtcatggtaccagcataacaaattaacacctgttgtctgctgagatcaaaattatggtacaacattgccttatttccatgtgaaaaaaaaaacacttattttcgttggaattggctaggtttactcttgttcctaatgcgaaggaagattgttcggtctaatccttttagaaactcaagcaaagtaagtaatcataacatggatgttcaattttatactagaaaggagagattttcagtaggaagcgcatacccctttgttagcgaagatgccgagttcgccggcggcgcggccacgagcctcggcgacgtcaacaaggacgatgacggcagcgttaccggggatccctggcggcgcggcgtcgagggtgatggacacggtgtcgaaggcgccgaggcgacggatccgatcggcggcggcggctgcagcgcgcacgaggtctctgacggtggcggcacgcggcaggtccgagccgaccgccgcctccaccgcggcgcggcgcgtgcggcagcagccccggatctccacatcgtgcacccggatccggacctcctccgcggtgaggcggcgcaggacggactcgaggcgagcctcgtcggacggggacggggagggttcttggtcatcgtcctcctcgtcttcgtcatcgaggtcgtcgtcgtcgtccgtcttggaagtcgtcgtcatcatcctcttgcaggtcggggtaatcttggacggaaacgggagaggatgcggtggccattggaatgttggacgatcggaaggggatctcaactgaattgggagacgaagacgacgactctactcactcaaactcaaggatgccttttcacaagcaacgaataacactatcaacttcctcttttggggtaaaatttatgtagagattgatgtttgcaattcatgaatttcacaagtttttctttttaaagaaacaaatgcatgctagaatatgtgaaaaattgctatgatccatatggtatagaggtaatgcctttgatactttttttttcaatatacaaaagatttgagtatcactgtattaaactgaagggaaatgtttacaacgaacgtgagaaaaaaaaaagaaacacaattcagaaatcatctcgccccatgagttagtgagcacaataaaagaacaacaacttttttttaaaggaaacacaataggagagacccccgctgttagataaactttgttaaagaaataaacaaaaagattacaacatcctaatccagttaagaattactcatctttatcactttcattaagcctaaacaataacgggagcatatcactctaaaagagatcctccaggaaactagggaatgagacttattctaaaaaatatagtcattcctttgcttccaaatattccaagctcccaacagaaagatttccatgaagcaacgattctgaaaagtgcacttagtctgcaatagcatatgatcaaaggacagagaagtgtcccaaattatgcccaaagagttctagtagctcgccgaaaaggagcaaagaaagaacatatgcaagagatcctccactgattgagaagaacaaagaacacacggtaggtcacagtttggagtagtataatgcttatgatccagcatatacttcgtattcaatctattcatcagaagcagccatccaaagacaacaacttgctaagctcgtatttcggttgatcttcgtagcgttgccttaaacgctgggatacgtcgcctaccactgaaagaataattagttgtaaatgcgaatactcacgtcaaatctagaatttaaatccaggtggttggttccaacataaccagttgagctacgttcactttctcgttgccttgatatttgagagaacacaagcaataggtgtcttattataaaaaccatgccttacattgtcgcatgcatgctctaaatcataatctgaaattacgtttacattgtgtcattatctacttaaataacttcactaacatgcttattggtactaataagttactccctccagtttcttttacaagatgttggctagttcaaatttatactagccagcgtcatacatatatggttggaggtagtatatagtacttcaaatacacacaacacaaagataagattacatatcggttaaatgctagtatttatttcctttttttctcacctttacaaacctgcaaactcatttctgcaaagaaaaaaaaatgaaaatatgttgcagagtattcctaatttcctactacaccctccgtccaaaaaaataaatctagcactagatgtgacgtattctagtacaataaatctagacagagatattccagattcgttatactataatatgtcatatccaaatatgtttagtttcgttgtattatgatgtgtactatgttggttttttatttgacggagggtgtatgataccagaaagaagagaaaacacactgaatttcagtttcaggctttcaaacgcatatgtactctgaaactaactgattttggggcctcaactgaatttcaggcggtttcggaggaggcgatctcaagctccgcccaccacaggggcttctccctcggcgccgcctgctccggcgacaacccggcgatgcccctcaccagcctcgccacctcgcccatgcttatcgctctcttccccgcctccggcctcctcacgcactgccgcaccacgtcgcacagcgccgccacatctttctccggcgcggcagacgacgacctcaccagcgtccggtcagccatggcgctgagtggcctcttgccgtccaggtagctggacgcccacagcaccaggagccggtcgtcctcggagaatggccgccgcccggagatcacctccagaaccagtatcccgaacttgtacaccacgctttcttggtcgtcctgcttgttgatgtcatccttccagaattcgatgtcggcgatcttggctgcgttgtcctcggtgagatagatggatgatgagctcaaatttgttgggagaagaggaggaggatctagctggctcatgtgctccaggcagtaggctactcccattatgattcgtagccgtgttttccagtccagatgttctgcttctctgactgcaaaaccaaatttacacatacaacaattgccagttacagtttgtttgtttttcagattaatcaagatcgaacacatacaagaaattattattaggaggcttactatgcaaatgctcaaagagggaaccacatggagcatactcgaacaccatcatcctggtgaatggctcctcgcatgcgcagtaaccaatcaggttcatgaagttcttatggttcactctggacagcaccgagatctgaaataagaacagttagtactatactctaaaattatgtatgattttcatcattacaacaaatgagtaccttgttcctgaattgctcctcagactgagctgaccattgttgtgaagagttaactgaagtggacagaacagctatttcaactccacttgacagagttcccttatacaatgtgcattcaggtaaagtgccgatcacattgatgaaaccctcgcatgccgcctccagttctgtcctctcaagagaaggcacacctgcacacaaaggtaaaacatacttagtatactgaatatcagtaaaatgcatcaggcgctctctggcttgatgtatcatggatttgtgacttctgtagttttactattgcagaaaacaaatttctacagaaactgacaagttcatttaaccatgaaatagtcttaacttctgcattggtaagatgatgatggaacagaaaaaccaacctgttacaaatgccttctttagctgtccactcagccctgtagcccatggcatgacagtattatccttctttctacgggagaagaatacatatatggcagtagctactgctgcaatgaaaaggactccagcaacaggcaatgcgtaaatagcccaacgaggtaccaggtgtgatgctgatgattgaactggagatgattggcttttggggtgtgtttgtgtttgattagaagccagctccctggcttgcagaagtcgccttggtgtggcattgtgaacagttctaccaaaaaaagagagagagagagagagaacataatgtgttagaaaaaaatgttctcggaaaattgattcaccaaatgactagtatatttgcaaattaaatttgataacggataatctatcaagaaaataaacatttatagccacaaagaagcctcactttgctaaacattttctgcatggttcaaatcctgcactgtcatgaggtacagactctgaaattgagctatgctctttcgattcagatggtgtttcactggcaaacatgttctctttgagtaatctgcagagatcatcatagtgcttaagattacatagtacatcagaaagactaaagctccattaaaatgttgttattcattgtaaagcatcctatatttacagtgcagcagccaacatgtgatgacctatataacttctaatgtatcttatataactattaacatgaagtacaatgatctgtacttgcatcactttggaagcattttcgaccgaattacaataaccaaagtcattcacctattttgaacagaaattggagagtagataaatctaaatgtgatgaaagtaggacatcaagaaaatttccccttgaaaaagagctatgttaatatgtaatgcatccccagcaataaatatctaacatgaaagacatattcaagagcaataaataatttggatccatgtttcagtttggtagaagaggaaagattgcattaaagcataacttacaagttgaacactctgccaatgagcttcccttctccccaatttgacaaagagccaattgattggtcttgctcactctctctataacccggaagagctctccctaaagcacaaacttacatatgttcaggttgttgcaatccaaatccacttgaagcaaccattctattagcccctttcagttcaatctttagcaatcaaaaaaacatctcaccttcttcactgtggggagcacaggacccaaatcttgcagtgacaagaaaggagaacactatgaagtaggccactctaatggcccatggctccatttctgtcccgatctaaatttttggaagagctcgaacctcttgtttcttgtgcagaatgttaaaggtaagtaagaacaatacggtgattacgggaaaaacactgttaggaggggaaatgattcggaattttacctatggagtgtggagatggggctagacagctagtttgtccagaaagctcaaatctttaggattgtgaaagcacacatgattgatgattccataccacctcaagacaggtattaccatgtaaagaagcatcgtcttccctcaaagattgaaatcttgatcttaagaattacaaaaaagaaatggtaaataagtgaaacaagagagtattatgcaaagagtcgaatgaactgagcaaacaaggaaccggacactgtcataaatctgttttgcaagtaccaaaagtgtacagaggtagttacaaaggaaatcgacaagaaaaaaaagccaaggatggtacctgtaaagagaggaatccaattccaatccactctatagtagtaggagtagtaacttccagtttggcatttctcctggctctcttctcttggccggtatgcagttggaaaaaagataagagacaagcacacaaagtcttgagcttccagagaggagagccaagcacaagcaagaagcaacgtctcaggaataatcgaaatggtctctggagacacatgcgaacaaagaaaacttgcaggcagcttggattttcgagcacctcacctgtaaagctttccacaccacgagtcttgagttaacaaaaaggaagacgcggcatatccttgtctacttttgtgtatcgattggagccgaatgtctgcccttctgcagtagtagccctgcctgccaagtactccagtattagtattatactactagtgtgcaggttagatatggcaacggcagattttgttttaaagccagcttatggtgtgcagaaaatgaacttctgttgggcacataaccatttgttactagttctgctttatttaaagttcattttatgtcgatcgggatagtttaattatcaggcagttcgcagcttatctactcgcatggcaatggcaacttggttggtgtcctcctatcttggctatgtatatggcttgctgcttcctactaaccagctagccattatatatcgataagaggatgtagttgtcctaatagcagtagccatggttattgtagtaaatagcaaacgcacttccaactctttcaaggtttcattaatgcaaaggtttttttaaaa

SEQ ID NO: 23851 - DNA, 23490 bp, Oryza sativa
  unsure (1)..(23490): unsure at all n locations
cttttttttttagataatggtattttttacccggcctccacatccaactggatatatacggccattgaaatagggaatttagccccgcaacgaacccaatctctgaaattcgctcctatgaatatttgaagccaaaaccttggggtactactcaagtctctgcaaccactaggctacatgcccttttgtctatcgtgtaatcgtaaaaaaaataatccaaagcttttttcttttttatatgatttcatccttcttaccttcttatgtggaataattctcaccaacaaagtttgtggaagctttcacatttgaacatttctcaacatttgcacaaggcgtgcgttagtaggtcaaaccagcctcccacaggttatattcattgatacaaaacaaaaggtggtagagaagagcttcacaagttgcattgcacacctcacacaccttatacagctgattaaatcaaagcagagaattgacaaggcatctacctttgatgcgactgaggctgattaaccatcttattgtgtttaatgattagctacttgttgtgcttctattggcatgtttttatgtttgagtcgatcgtcaatgggagtgagtcaacttaagaaagcacaaagaaatcttcacaagacatcgagacagtgacagcttcaaagcatatgaaacaggcaggctcctcgcctcctcatctgcaacttatattacctttactgatcaaaatgctccaaaagacaaaaggatgttgagatgaaaatggaagtggtcagttaacttctgaatttcttttcagacagctgctaactccattagtcctagcaattacctactcgatcgttcgtgtacaatttccacttgctttttctaaagaaagattgcagattgtaccatccaatacttgaggaaaaaacatagaagaaagctttatattcataggaaaactagatttagttggtattcgtacctttcatgaatcatggtagcatgctcgcaggttaggctacttcaatcatgcaaggcgggccatgatgcccagtatatgtgcagaattaaattctgcatgttccataatcactagtttatcaaaacaaatgctgaaattatttctggactagcacattttctctgtcaccatttgtgtgaaaattggtttaacaaaagagatgataaaacgtctatcaccaaagggtgtttggtctagtggtatgattctcgcttcgggtgcgagaggtcgtgagttcgattctcgcaacacccccttaacgttttgctatttacaactaggtccttctcttacagatgtgatgtactctttctgatgttgcaagtctctgtctttttctctttccttttttttggtcctgtacatggtgcaaattagaagcactccaagataattggcagctaaaattgggccgtttgctacattatggtgtagctgtgatgaagatgatatggtagtgtatattgcaagagcaggaggagcagctgcatgatccaacgaattccgcaacatgcagacgacaatcaagctggacaaggtcacgttcagaggtaacgaacccatgtggccacgccgtgcattctcattctcatattgaatgcacattccaagcatgtgctccaatctttttgtatattgctctctagagacaatggatcatggatgcacatcagcactaaactattttatcttggagcttctaatgttttctcaaaatggatattcaggtcatcagagaagcaaaagatttcacaagtaacttggtggtgccatacccaccgaaaagtgcacaaggttcgaccgatcaaaagatcagattcacgaaaacagacactaaattgctgttcatcatacgagtcgcaaacagggcatatgccatatctaattcagtcgtacggtatcatcatgcatcaattatcaatatgatggtatcgtatcaagtttcggggatggtaacaaaccacccatctgaacgagctctatcaagatggtagcaaaataaaatcagtaatgtggcttaaacccccacttagtttacaggcaccggtgcaacttatacatcgtctctctgaaaagaccaaatccaacgccatgtcaacggagtgacagcccctacttcaccggaagtagattgataccagtgggatgtcaacgtcgttgtcatcatcgtcctcacaagccaccaccacgtcaagatggcgccggtatgggggcacctccacctttgccacctccctcgccacatcgaccaccttcttgtctagacgctccttgtgcctcgggaacattgagttgtacagcagcgaggtgccgcaagatatgctgtatgcattcaggcccttctccttgagccagtccagaagctccctcagcgtgatgttgccagttatggtccagcggtcccaaacagtccaggccatgtcctggtgcttgatggtcttgggagggaccggctcatccatatagaagagggggattgcaaggtttgcaaatgtgttcctgtagtcttcaaccttgtgcccaccaccgagtaccttgtacagttccaagcacacaagaccagtagccatcgcagttgaagtggcaatggcagggatgatcctgccagctatgaacttcgccttcagcttgtccacttcatgaatgctatagtttcttgcccgcatgttagcaaaaccagctatcacgtccatatggttattggtgtcatcatcctgcacgtacatgaatgcggattataaaaccaactctcanagctaacacaatttgtgaaactgtttaaggtcataagggtgttcatcctagaggtgcatgattggctaccaaggaaaagctaaggaaaacaaaatcacatttactctctcgaacttatcagggaaaaaaattgaaactaaccttctcaaactggattggtttcatctggaatcctggttgcagtgttttggaaattgcttctaactttgcaataagctcttcaatgacagcagcatcatcaacagatgcagacgaaagactagtagccttctcatctgtaactatcttaaccccctgttttggttggaaatcaggaacaatcaccttgtcaacagcttcagccatctttgctgggtttttgacccagtcaggtatgggtatcccaaatgtctctgcccttaaaattgcagcagccaaaataaagttaagctggcttggatcagatgtcaagaactccagtggtcgtgggaaacgctttggagcagaccagaaaggagcaccagagctggtcatcgcatcttcagggaaagtgtatgtcagttgcttcacacggttggagaaataatcctcaaacctaagatgaacaatcaatacaaacaaaatgcaaagtgtatgtcagttgctgcaaaatgcaaacaacaatcaaaaagcaaatgctttagttgcaaaatttaaattttggaatattcttgcatattgcaataatgaaattcaagcagatgtacacagcttcaccccctatgcgtaataagctaaaggtgctcaagagatgtgctaacttacttgagccgggcccaggtaatacaatcttggaatgtctcacacttctctctctcgagacattcaataacgcgctcaagctgatccctagcctgtgcatcaccagcagttcttgctacagttgcatatccaccaggattcgataggaaggcatttacttcagtgggggtcttctcaagcaaaccctcaaactcagacctagcccaggttaggcaatgatcaatattatgaggaaatgaatgtacagtacacatcggcgcctgcttttcaggtggatctctggatgcgccatagttctctgttaggtgaggtatgaccatctgtgtgttacatttagcacccagagtcccagattccaagagtggcttctggaaatatacacatcgggagtcaatatacattcttgcggtaacattgtccaacgcattgacaacagcatccaggctctcccaaaaggcatcgttgaacacattttcagtctcaggacttgctctgttctgaagggcctcgacatgaagcttaggattaattgccatagcagcagtagcagcaaccgtggacttgggctgaccaatgttccagtcacggaagagaaactggcgactgagattgctcttttcaataacatcatcatctgtcactgtcagctttccattctgattgcaagaaatgcccattagtgctaggtttttcaagaattcacatccaagcgccccagaaccaaccataaatattttcgcctgctcaagtttcttttgaaggttagatccaaaaacactgatttgtgcatcatatctagtattctctggcttcaactcggctggctccaatggttcaacagggagagattcaacagaatcaaaatagaagaactgcaaaaccaggaaaattacattaatgtttacatgaagagtgcagataaaaaaagggatttacgttattataatgaaggaaacagattataacctggtaaagtggatggaatttccctgagcatgctttcacaacctcttgacctacaatgccaccaaacattgcagccatagggttcagaacagccctggaaccacttgcaaaatgatgcagaagctttttgtcgagctcttcaagtttgctatcacccagggactcgttaatgctaatagcaaaatctatcagtctttgcacatcatcactagacccagcaatagggaatcgcctcaaatcattcctaaacttatccaaagcttggaaagccaaatgcagaagtggtggacggtcgaatttggagaaatcgctcatgaaaaattctcctggttccttaatggcgtctttcaaggttttgaatttaagaacctttggtggcttgacctgagtaacaataccacctctaacatatgtcccatatgaggtagtgtcttcttctagagtaaaagaataaggcctagcgttcttaatctttcttggtttcccatcatttagttcactcattccatggacttctgagaacacaactaaatcaccatcctggaactccagacgctcatcatcaacacaggaaacaagcgcagggttgtcattgctgatcgatgctactattcctgtatgtggctcctctccatcaacatccaatacagtaaactcaggaccaaagtcacaaaagacactgccaaaaaggccacgaatttctgacttaatgaaagcaattggtggctgatggttgtggcagtaactgtcaaactcaactgctttctctaagctgatatcagtaaagaccacagcctgtatgttcacatggaaatggttattccaagaataagaaaatatgcaatacaaagagacagtcattgctcaaaacagaaagatggctctgaaatattatcttgaactactacagcccttttgcaggccatattagtatgaaggatttactgccatgccccaaaattaaagcagactcgcacgattgtctctgtagtctactgagatgatgtggaactactacagctttactcttaatttttcttatcagtaattggcacaaatttaatagagctattgtgtgggaatacgatgataacactaactactaagaccaaattcactaagtttaaatagtatgtgttgcactgttgctaaatattaaatatggagttccaatgaatgtaaaagatgtttctttgacaaaaatcaagcaatcaaaggaaaaaggcgataataccacagaaacctgagggctgaaggcctaatgaatgcaacgaacctttatgctattccaaatatcaagcagaagaggaatttgaggaagctagtagtgatacacatgcatagttaatcctaaactccatgaaatttggtgtgtaaatactattttgcataccttgattgtgcacttccttatacataattgttgactttatttcttcattcaaacatatatttagtaaattgtgaaaccgcactgtattgcctataaagaatttccatactttctatgaagagtagcaacaattcctagactaagatcaaataaaagatgcacagcctgtagtcacagacttgcagctcacatggactgaagtacaagtgaaacgactacttgaaatctaagattaacaggcatacacgatgaagtagaagaaacaaacagcaaggaaggagatcacaaatcaactgcatgctcacatacctggaaattagaaagctgctccttagtcaaatcaccggttatagtagagataataacagcattattgagctcctgtagcttctgaacacaagtttgagcacggttttgaccaacatccttctctgtgaggaagaagttgcttgataagtcccatagctccacattgtcatcatcgtgcaaggttacggacttgacacccgcaaggacaaggttcttggctgcaggaagacattggcattaagtaaatttcaacagcatatctgaaagtatgaaaaaggcaaagccaaaaacttgtacaatcatgtgatttgaatcctcaaaaggtctcccaatttcacaaggtagacattgcattctgagtggttaagcattatatgccaagtctcaagcatcttagcttattgcatagcacaggggactgaccagaactaacacagatttgttgtatgatgcaagctcctaaaatgtaataagggggtaagagcaccccagcacaactgggaaaagtttaaactctggttcaaagaatggactcaagagtcaagagcgtcaatgtgtttgacaatttgagctgctcctataatcattgtttacaaatcttaaaattgaagaatcagttaataggaagcacacgctaccacgcttcatatttctagtaacaagatgtagaacttgcggaactgagggcagtaacccagcatggagatcgtaaagcacgcattgagataaaatttgataataatgagtagcgaaagatcaacttgtgcacaagtgatatcgataactgtctacgggtctataatagataaaatcgattgtggcaggaaagtggtaattgaagacaagttgcccctttactcaataaggtcgatctgtatgtagagtagatgaggggctttgggaagctaattaaggcgtaccgatctcggcgccgaggccgttgaggccagagacgaggacgttggaggcgaagaggcgcttcatggtctcgcggccatagacggcgagctggcggctgtgaaggtcctcatcgatctcgggcgctctgccggtggtcatggtgtggttgtcgtcggcgggttcgtcgtcggcgcgggtcttcttgtgcaagtcgtggacgacctcgccggcgagatcctcccgcttgcgggtaagcatatagtgtagggcgccgccgaggaggccgacagcgacggtcaccgcgaggacgaggctgaaggcagccggcgagagctgccgcgtcagatccaggacgcaaccacggcgagacctacacacccgaccggctgggcgtgagacgggagggagcaccgcaccaagagatgagggagttgggcgatggactggaggaactcaccttctaccttggattcgtctccctattcgtggatcgacttggttcttccttcgcttcccttgtatactctatctagggttttgaggaggaaagaagaagaagggctaatttgtaaattgtggccgcttcgcttgtgcgtctgataagaggaggtggagaaggggagttgtttgagtttgagacgagatgaaagatgtgggggtggggcccagttggcagtgaaagaaacgaaaggcaaagcaaagcatgagtgctttcctgcgttggcgccatgagcatatgcttctctctatttgcacatcaactccggccttttttgttcacaccaaacttctctcaactctcaacttttcatcgtatcacatcacatccaaaacttttctacacacataaattttcaattttttttcaaaattaccaacgtttccctaacttctccccaattttagaaactaaacacagccggccatggaaccatctcgaaagacacaagaggagtcttggaaaaaagtccacttcacgtctctcatctcatcttatcgttgagtttaaaatacatcccttaacaataaacccaaatatagcatctttggtcttgcaaaaaccgcagtatgtatggattggctccgttgacgtgataaattgactcggtccacttacgctgactagacacttgcatggcaaaaacaaaatacagccccacatataattctctcctcccttctctccctctcctctccttcctcctcctcctctttttttctctccatctctctcccgcaccctggtgatgctcgacaccgtcctcaaaggatgtcgactggcttctccacatctcctcgttgtggttcggcagcggcggtagcggcgacgacaacgacaacctatgcgggcattctaacatcacatagaacgagcccatattgttccttatctgggaccacctcgtgctcgatatcttcattgcagaggaaggtgccgatgaggatcaatgttgggtgctcaacatactgctatactttttgcttgatttggattgtcagcgtcgagcttttacatgtcgcttgttgcgtgtctttcctgtattaggtcaatcctttctttgtcggtcaccacccttccagtccgtcatgagacaagtgggcggcgtcgacgcccggcttgtaggtgacgaggtgtgccactgctatcgagcgcgccgcatgtcggtcacaatctcctcactcccccgattgtccgtgcctccactacttctgccatcgccgagaccgaaggatggggagagagataaggaagaatatttgtttcactgacatgtggatcccacgtgagttttattttttatttttcccttttagtgtcgcgtcagccaaaaccaccctcaatgctatatctaatgtgacctggttttgcaagattagagatatgttaacatgacccggtttgcaagttttagagactaaaaaaatgcatgtgcgttgcaactgcatagtctattttaatcttattattgttatacggtttagctatggtgaaattcaccgtgggaattcgcctggatattttattttacaaaatcatgagttgcaattaggagttcgttaccatacgagtttttttaaaagagatttctcatacgattcattctgcatttctaaaagcgaacggacataaaaaccaactcaaacacggatctgcatttccaagaaaaaaacttaaaaaccgactcaaacataaataacgtgctaaaatacagataaaaacatcttccgtttttataatagcagagatatagacgtgttataatgtggagcctcaccacgccagcaaaggtgggctcaaactcaaacataagctgtcacttaaggcccaattattcttgatgggcccatcctcttctttttctctctccttttcttttgtctgttctttcagaggcagcaaagcaaagggacatatatgcataaaaacttgccaggcttcgagttactaacataaactactaggaacatgacataagcacgatgaaacaagcattaacaccacaatggattatcatactgttccttactggctgccagcaaaatctctctagcaacaaacgtgtaaatgctccccaaaatacaccatcaccatgactccatgcatagccacaatatcacaagtatcgctacagccagccgcgccatgttccttttctgcgaggacgcgcgacatacacatgattctgaagctctactgacctagacacagggggaagttcatgaccaaattggttggttcattcactccattgctactgcgtgcttaatttgatgaatacacagactcgacttattttctttctttagctgcatgatcccatggatggaagaaacgaaacctactactgcccttcacaccgtctcctccattcaagcttcttcctcaagcagcttctgatcaaagtgccacacccctgcaacacaaattacgtagcaaacaacaactgatgagtcaaaccacaggtctatagatagatggtagtacatcaaatgaagtattttctgacaaaacacactaaccatgcccctttcccactcttctcagctgggcgacatactcagagatcttcttgatggcttcaacctttcagagcaaggcagatattttcagcaaaacataattcactaaagcatagcagttgaatattaacatctcaagagctagttcagtacccaagtgggcagaaggttttttacctgctcctcaaggaattcactctcaacgaagtcggtcagctgtggatcattgcaccttgatgccacctgttgattcacggcaacacattttcaagtttcaccatatatttcttttcaaaatagtgttgagaattatacaacgcattctaaatccatgttcagcattactgcataactgcataacaggagaatatcttacactgtgcaggttgtgcaacttctcatttacaagcttttcgagagccaaggccaactccatagctgaaatcacaagcaagctagagggtaaaacataggggaacacaaagtttgtacaggtatgtacagcaacaaacagccagtgcatgctactttctggagacactagcaaatgccataaggtgaaatgatggaaaatatacaatgacgttttctcctttaggagcgtttagaatttagagaatcttttctgtgcagtccaaaatgtttaaaagaaagcttttacaaaacaaagtagcctttattgaaagttactcccttcgttttataatgtatgacgccgttgactttttaattaacgtttaaccttattcaattttttttgcaaatataaaaatatttaaatcacgcttaaagaacatttgatgataaattaagtcacaataaaataaataataattatatatattttttgaataagacgaatggttaaacgtatctcaaaaagttaaccgcgtcatacattaaaaaacggagagtaattgacatcaggattcaacatggaacttttgaagaggaaagtatccttgctgaatctggatggcgaatgagctcattcaccaaggaagttcccctgttcttgccaaaaaaagggctcctcccaaccttaaggatccaaccacttaaattttcacatagataataattaacagacactcagactagcacacagtaaggcgtaagcagaagcacaagtacatataccatggaataaaaaacataagagataataggacaagctgaaagcaactcaccatacaaggcatcccctttctcaggatggtcgaactctgtcaagggtgtgacgatggactggagccgcaccctgcctccacgcatgttctgacaaagaagaacatggcagttttagcatttgggcgcatgattatagtggtacagcctacagttttcctggtgtgccaaacgaagcagaggtaaagttacctggtacttcatgagtttctctgcgtgatccctctcctcatcgctggattctttgaagaatctgaaggaacagaatttatcgatacatgggtgacaattttcctacttggtgatggctaatgaggggtggtgatggcttacttggcgaatcccttgagagcaacgttgtcacggtcaaagtaggcgaaaagggagtggtacgcgtacgatgcattgaactccacactgcaaagattgaactattttttaggattgaattccaattcggaatataactacggatgacaagctaagggggtgtttggaacagggacttcatatcggatgaatttggagtattgaaaatagactacttataaaactaattacataaatgagagctaattcgcgtgacaaatttttttaagcctaattaatccataattagcgcatgtttactgtagcatgacataggctaatcatggattaattagactcaatagattcgtctcgcgaattaattcaggttatagaatgggttttattaatagtccgcgtttaatatttataattagtgtccaaacatcggactaaagaggttttagtcccatctaaacagggtctaaatttagctaagcacaagtgtcttttctcctatttacatcaattattgtggactaaaataattttgtatccgttggtccatgtaaaaaaaatgtttgggaaaatctgcagcactgtagaacagacgcatcccaagagcagaaattattataggatgaaaaatgaaccctttacgaaatccaatcactaacaaagaaaataaaatgaccaggaggcacagagatttttgttaaattttaaaaaagaagaagcagaagaaatgcgcacatgaaaggggaatagaaattcaaaaatggaaggcagagtgaggaggaggaggaaaacagacttgatctgctcgctgatggcggcctcgcactcgtcgacgaacttttgcctagcaagagactggtccttggcctgggggacgagggagagctcccccttgagctcctcgaatggctggaagaccacgccgctgagcacctccttccctttcccggcggccctgcacactgccacggctccggctccacgcggcacaggcagccagacggaagcaggggtcgaggccgcggcggcgagataggtaggcgccgcggcggcggcggcggccagagaggagggggcaaccctaggaggaagcatggcggattaagtgagaggaaggcgcgtgtggcgttcggttccggagttcgcggcgcggcgggtgaagagtgatgagattgtgcggtggtaggggtggaggtgatagaaagggatagatataggcgcgtggagctcacggatgggccacacgtggacggtcgagatgggacgaaggcgagggagcgcgtggcgggctcgtggctggagaggatattttgggcttgtggttggttgatgtggagcccggcccggccgcaccggagtcggtcaagcttaaccactattccttcccggattgtctctgatggatcggttagtcttgttaatttcgtcatcagcttatacttggtttggtggagtttgtgtgtttattgctttccttccaagttgattgcgatgagttgtacaaaattccacacaaatttatacgtctagatgcaatgcatgctggcaaatttctctccttcctctgatgattggtcagcagagaagacaagggggatatcgaggaggagctagatgaagctagacaagataagaatggcgtgcacagtgtggactgtggagatgcggtgtcgatatcctacacaaaaaagtcatttggaggcgtgtggaggcctcacgcccgctctggaccagattgccctatttctctccaccacaattatcatcttctttttttttccacctttttacatacttatctgtcttcgtcagtattcatgtgttgcacagagccacatatacacggtaccctcttccttgcattgcaaccatatgtttacttggctcctatagtgacaaaaccatcttttctccttttaacagcgcatttgtctcttgacaaaattgattcatcgagactcctgctttgctcgtattctttttctatatagtatatacttctagaacgagctaacgttttcattttaaagaaaaaaagaaaacggacaaaagttctgctgggcttcgttggaagcgagttcgttagtgggcctaggcccaaatacaaaatccaatccaattccatccattctctgggaatcgccgtcgccgtcgccttcgccttcgccttcgtcgagcagagagggaggcaagccatggccgccgccgccggggatggggacgagcacctcctctccctcttcgcctccgccctctcccaccgcaggtaaccacacacccttcttcctctacgatccaccaacttggatttcagtcttctacaaccgctccattctgattctcctcgcgctgctcaggtttggggaccaggagctccgcctactcgacgccgcgctttccgccggcgccgacgtcccctcgctgctccacactcgctcatccgcccgctgtctgctgcgcaaggccgccgcccaggcattctcctccgtccccgatttgggtaccaccctctccacggccgacttcttcgcgcgcgccttcgccctcgccggagatgtcaaggtcctcactcaccgatgacttgcctcagcgcctgtggccaggattgtggggccattaatcatgtgcacatatccactagttttgtttgctcttcattctacacctaactgggtttcgattgcgatgcacatcgggtgctccagttctgtatgttcaatccaattcgcatcatatgtcgatgcccttataattattcattctcctcgtgcaaatacacattctgcacatgctaccgtaccgtactaaactagcggtgttgcaacttttttttttctgccactacttcactaattctgctaatttctgtcattcactagagttgccttgctatgagatatgaagctctgctcctgagacaagccgaatactccgatgaccttcatttgcaagtatccaatgaagaatggctaacttttgcaaaggactctcttgataatggtttttacaccattgcttccaaggtactttcctttcagttctgctgtacctccacttaattcttttattagtcagcattgaaacagaactgatgacacctcctagctaatactaattctatgttgccttgggtcacatgttacttttgtaccagaatttagactaatgaccttttcaagtggaaaggcatcgccatttggaaatatgttctgaacaatgtgatggatgatgtttgataactgcctgctgttcatactggtagtattgtctgaacaaacatagcacaaataaacatagatcactatgtagaacaacactctcacgctggagggcattgttttgtctgcctcctttagcagttatgattaggtcataaccatgccaatgtgtcaatctaatcatctgtctgtaattcattttgttgaatgactgcatcatagtgcttcaacattatttatgtgcaaaccactgattctagggtttaaaaccatgtggccatgtttctttctacttatatatgtatttaccttttaggcttttgcaaatgctcttgtgcgtattgatcccaaccacccagaatacttggactcaaccaattctattctgaagaaagataagatcaatgatataagtggactccaaaacttggccaagtcattatccgcactgcgttctggtgagttttgtgataccataaaatgatgtaaattacatgctgcgttgactggttaaaagaacactttagatgctactcttgtgctctaactgcctcctttattgtctctctggggacttctgtaagaccttgctatgttcttacgttaagtgatggaatcggcataaaaactcaaactacatctcgggaaactgcagtcttactttaaattgactattaaacaagatgtttagagtagataagtgtatttcaatggaaaatcatgatctttctatgtagaaaaaggattagcataacctgagtataggctgtacaactatgtctttattttcattttaattgaaggaacatctgggcatctggttaattattttgttaaacatcatctataagatactcgaggttattaggtatgactatgttttttttatcatattgtgttcattattctgttggattgatgtagcattccctgaacatagatcaagtcaaggcactaaatcttctattagatttttcaaaattcggtgcttatttccttttgtttcaaataaatttccaatacagctacttgtactatgacagttcaggcacaatcagctgaatacatgaaaaggaaagcttcaggggttgatgaaaagtgtaatttgcacttgaaaaaaacaaagctacctggaagttcaatgtttaggctaggtatcaaaacaaggaacatacagaaactacgttgcagccgggagagtaatctgtaagatgtttgaagcaatatcggtgtgacatcttccaataggctgataagagtggtatgatctttcacacaatctgttgttgatgtaacaaaaggtgaatctcatgccttggggtttactcatttgtttactgagaacttctcagtttattattttggtaactagtggaacatctgcagctgcacatatgtccagtatagattttatcaatctcttacggtttctttgctgactacctctttgttagctcaacatatttccatcctgctatccactcattttcttccttaaatacatccatactgccgtatgtacacgtctccttatcagattgctatgattaatgttctttgatcggaacagaataggaccactttgaacttcctctttgtaagatagcaatgtaggttatgtagaatttatatgtgagggttgtgttggtacatggcagcatgtgcacttttgactcgttctcattttctttggtaagtatcatcgtgcatgtgttgtaccatgtaaaactcttaccatttgtcactttcaaggagtactttcaattagtttcattagtattatctgtatgaccaagccaggcccaacttctcactcctttaaaataacactacaacatcttctctttcttgcttactttcagagcactggtggaaatgagagcactgagtagaatagcacacctcacttcagcacagaagtttaactatacatttatcatattgaaacaggatacttgtatctgctcatatagttacattgcatcacattattgcgtaggaattcatgttgtttattcacttggaatgattgtcgatcccattattaattacatatcattctgatataccactgcgcattttggtctgtccaatgtggctatgtacattaatacttaatatgcttcaacgtaatgagtttgcttctgttttttcattcaattaggtgaacattttcgtgcaatgggaattttgatcctgatgtcgtggatgggtatttgggatcctgagacaatgagggtatcacttgcctcttctactgctgtttcactgggaacgtaagctgcttttttaaatactcctgaatattatgacttgtgatgtactaaacaatatgctatatttttgctatgcttacgcatctgtattaggatcataaggattaaaatccagtgctgaagtattttatttaccttttgagatgatatagtgaagaacttcatgttgttcattcgtggacaggtttattatgcacggcaccaaatgatagcataagacatgcaattagctcaggtattttttttagggaaacaattagctaagtttcattgaagaatcatgtcatttatatttagtagtaaaatagtaaggaaaaatattgagaaataagcatgtttagcttggaaagtcaggtacttgacatgtggcagttggcagtgacatagatggatagaccaaaatctgaatactgaagctgatcctagagcacatgcggatgtatgactagatcttaactactgttcagagaacatgaagctaatataattagtggtccagatgatagtgtcttggatccctatccaatagcaagtgtcttcataggaacaagtcatcgtgttgaggaaagaacatgtctgttgcatatgctctcgctaggaattgaggaaaaaggaaaatactgatgttagtaaaagtttgcaaaataaggtgggttggtgcataggcacaagatataaacgagagcctagcctgtcatgtgggtgatcacccagttagcctagtgaacttgcatgtgaggggtacgtttattttgaccttggaaaagggaagagttggcaacgggtttatactttccttgacttgcttagtggtaaaacactgtcggcaacttagggtgtcggcgccgccttctctgattgtgatgaccattcatatttatgcttgaaattcttggtgaacttagggtgtgtttagttcacaaaaaagaaaatttttagtgttacatcggatgtttgaccagatgttagaaggggtttttggacatgaatgaaaaaaactaatttcataactcgcctggaaaccgcaagacgaatcttttgagcctaattaagttgtcattagcacatgtgggttactgcaacacttatgtctaatcatggactaattaggctcaaaagattcgtctcgcgatttccatctaaactgtgcaattagtttttatttttatctatatttaatgcttcatgcatatgtccaaagattcaatgtgatgtttttgagaaaaatattttgggaactaaaccaggcctgagttttggcaacaatggcatgtgcaagcacgcatacggctgtaagaacactgatccattgtactctatttcaaagggttttgcagcaaatgagggcagagtcctcgttccgctaatgtagtctacacaagctagacaaaatcaacgcaagaggtagaattttgtgtcttttgtgtgtcgactgatcgaacaatgttatttttgtttgctagcatcgctccaacatgattttgttctgtcatccacattggaaacaaaatctgggaaaaataacaatataagggattaagggatgtcgttgtggactctgcatctatcataattaagctgcgaaatgcattgcatgggagcatgggtgtttgtagtacatgtcactcaccacctgactcagactgaaaccacaaccaccggaggtcccattcgcatttacacaggcatgacgtatactttgtctctagccacaacctgctgtatgcatgaataatgcttatcttaagacatcctcggtttgatggatgttgtaaattgctatgctcgacaaagtcctaatctcgtcgttgttggatagcctcttccggcgtttatacgtgtcatctggtctcctgctgttggctactaacatgcacgtatgggataaacaaatagacaaacaggagtactggaatactacctgtcgttttctcatgttttaattaatctatatccttgatttacgattttccttttatatatatagctactttctccgtttcataatataagtcattctagtattttccacatttatattgatgctaatgaatctaaatagatatatatgtctatattcattagcatcaatatgaatatgaaaaatgctagaatgacttattgtgaaacggagggagtgctatgttatgatcgacatatataaaaagagaacgatgactgggagaggtgatgagatctggtgaggtgtccaaagttgctaatgtccaattgctagagcttagaagaagctacaattaatatttttgctggtactgtcagttgtttgttttacgtggattgtgatgaatactagtactgtctagcaattaaaccagaagttaacatgcaagtgttgcatctcaaggtcaactctgagaacgtgcgcaggaactaacattaacagttcagtaaccaaaggtcaaacaaactgcactagagtccacatttactagtgtgtagtagtagtacgtttgaacgaacttgattaccagctgtcgtcgtagtcgtagctagttagggtccaactcatttttgtcgatcgcgggggaggaatgttaacggtgcatgtggttggttgatttgattagtgaaacaaaaaaaaagtggttttcggtggtggtaatttgagcttgctttgaactttgaaaagtgatcgatgcctgcaattcacacttcagaaaagaatgaaggcttagctcgtatgtagacttttgatggcttaatcttatttgctgccaagtagagacaaaacaagtcagagaacccattactgtacatatttatacatgagtaatcaatgatatgggtggatgtgatccatgcctccagcaggacatcatgattaacatgttatgagggatcactatacttaatactcctcatatgcttagttgtttagtagtgttaattatgtttgtcgtgactcagcttagttgttgctgttgttgagctataaaaggagaagctctgctcccgtgcaccctcccccctgaagcctgctcctctgcatcaactgtttgctgcccagtacagtagaggcctgcacttgcaagttgcaactgcaagcaatggcgggaagcgggagcgggacaccgtgcgcgtcgtgcaagctgctgcggcggcggtgcacgtcggagtgcgtgttcgcgccctacttcccggcggaggaggcgcagcggttcgccatggtgcaccgggtgttcggcgccagcaacgtcagcaagatgctgctcgatgtgccgccgccgcagaggcccgacgccgtcagcagcctcgtctacgaggccaacgcccgtatgagggaccccgtctacggctgcgtcgccgccatctccttcctccagaaccaagtctcccagctccagatgcagctcgccctcgcccacgccgagaccgccgccctgcaactccagctgcagcagcagcaccaagatcaagatgaccaccaccaccagcagtgcatcctggagaatgctgctgctcatcaccagctgatgctgcaggaggcattcctcaagaaagagtccatgtggacataattgtagtagatgctttctagtaaatctttatgcttcgattgatatgatttgatgttgcacaaagatttatagtaaatctttgtgcttgttgtcttctcttacgtaatttccggaaagaatgaaaatgaagaacaacaattcggtctcattagcctacctcatatccccatttctgttcaatgctgtattagcaagacagaaactgattggctttctgaaacacctgttggcttcatgaaccatcaattcagctcccatgcatgcacaagtttcagacaagccttttgctttcggagatatggttgtttgcttggtaagggtcagtgatgtgggacacattaatttgtcttcacatggtctctagttctagtacagtaggatccagatagtatgtacacgaactaattaagcacctcaaaccaccccaaactcaattaagtagcaggagagctaatgatattagaagtcctgatctcacctactagattcctaagttctctacacgggacatgtgtcctttctgtgctaggtctatatcatacctggacttcactaatactccaaatccaatatcatacctggagtactaatttgtcaaatccaatgttgtaaaatacctacgcatcagaatatgagttggttgatcgatcctacaaaacaagagttgagtgcccgtgtcatcaaagggaccaacacagacaaaccaaaggttgtctctttcttgagaaaggaataatttccagctatgcttaatttggttgttttttttagtaatgatatattaagatggagtccttttaacagcttgtttttataaacttgatcatgattatcttggttatgacattatcaaggtgctaaagtcccaatctaggacaaacaaaggattcgcttgttaccccccacccacattaatttctgcacatatgaacatatattgtatcttgcacatacattatctccatttttttttatcaaatactgtattagcaagacagaaacttattggcttcccgaagcacccgttggcttcatgaaccattcattcagctcccatgcatgcacgacacgacaagtttcagacatgccttttgctttcagagatatggttgtttgcttggtaagtttcagtgttgtgggacacatggtctctactacagtaggatccagatagtgtgtacacgaattaagcatctcaaaccaccccaaactcaattaagtgcaggagagctaatgatattggaagtctcagatctcaactactactagattcctaagttctctacacaggacatgtgtcctttctgagctaggtatatggagtaccatatattggacagtggcatgtccttaattacatgaacttcactaatactaatttgccaggttcaatgttgttaaatacctatgcatcacagaatatgagttggacgatcttataaaacaagagtcgggtgcctcatgtcatcaaggaaccaacacagtcaaaccaaaggttgtctctttcttctaaaagaataattcccagctagtgcttaatttgctggttttgttagtaatgatatcattccttggttttatattataaaatattttgactctttttataagtcaaactcctataagattaatcaatcttatagaaaaatgtagtcactcttaccggatcaaattagttctattaatctaacatttgaatacattttaatagtatgtttgtttggtgtaaaaatattgttatatttttctataaatttaatcaaacttaaaaaattatataaaaataaaaatatcttgtaatatgaaacaaagggagtaagttgaagtccttttaccaaggacttgctcatgatatgattggcttgattatgacattatcaaggtgctctaatatcaacccatgacaacacaaaggattcgcttgtaaccctcacatttctgcacatatgaacactgtatcttgcacatacatatgtgtgcattcaaacttttaaggatcttagacataagtatatacgcaaatactaaaatcgttgtgttttaaatcattacgcaaatctcgtgaatcgttgtgttttgaatagtttatataaatacttaggagaaaaatatgatggtgaaagatgcattttagagagctagcaatgtttaatactccttacgtcccaaaatataagtagttttggatctcgatacggtctccgagatactactttgacaaacaatatctacgaaagtataatgttttaaataaaagagttgcatattatgatagttcgtttaatgataaatatatatagtagatcaaatttgcatgattaatctttctaaattttttgctattaatagttaaaatttaaaagtttaacttggcactattttaaaaatacttatattttagaacggatgaagtgtatataaggagtactcttatagtttaggggtgatttgctctgagtatgaccggccaaccaactgttcccctttgtctttttaccaacatcaatcattgatcagcccataaatatttgatctgacattttattagagctggtacaatagcagactattagccagctataaacatagtattttaatgagataaaaaataagagagaagagcagtgggctatctgtagccagctccagcgcggatttaaagacgcaatgtgtgtatgacaggtgggactatatattagtaagcaactattgtatgaattgacttttagattggttatcgataaattggagctagtagtgggctacagatcatcttatgcatgctgtcttggttgacccaaaaatcaatggaaca

SEQ ID NO: 23852 - DNA, 10093 bp, Oryza sativa
  unsure (1)..(10093): unsure at all n locations
ccctctctaatttgtggtcatctttattttcaagagactcttgttgatctaccgtaccaatcaacagctagctaagcagagtgcgtgattgtgattacagtgttgtactcttgtgcgcacaaggccggttaatttaatttgttggtttaactaattaactgtcaacagattgatcgatcgatgatgttgcccgatcgtccagccgatagataaatcctaacagccaataatatagtatataactggaccactttgatatcacggttgcagcagattttgatatctcgtccattgtctgaggaatttattaaccatggattttgccctgaagctccgcccctgattatcatgactagctagttcatgcgttcattcaggctttatataatcatgcatagcatggactggggaatcatatatatgtacatggatcgatcgagtaggatgcagaggtcgtcaaaagagtgggacagaccgagaaaatagacagtgctctgtcggcaattaaactagctataacaatctttattaatttcatatgatctgtaggttactcactttaggtagctaatggttcaaaatcaatcaatcaaagcttcattactattatttgttagtagctagcatcatatatttaataatacaaagtcgtttgcaactaatgcatgcgtgccttcgcagctagcacagatcgaaaggaatatataccactccttacatgacaagaacacagcgacctgcagacattccaagttgaaacgccctctaattggacttgtgcatgaagcaatccatatttcattcgattcaattcatgtggagcattaggtacaattcatcccaactgctgctactgtgcacatcgatctcaatcttactaaccttctaaggctcactagctcaccagctgatgtaccaccaagcagtaataattgtaccattctccacacttgcagatatgttcatcattttttgctcaaagcatgcagctggtgtacacgatcatatacctgtcagagacaggtttttttatatatataaagaaaacggcaacattgctatccgattagcaccatggatgaccgtactgtacatgcatatatcttttctaagtttttcagcaggcaagcattcctattagaccccacactacttatatattgggacaggataccaaacaaattaaagcaaatctcaccacagaatttttcacctaaccctttatatttttggtctttggaggcgcactcatttcatgctatgtggaaagaagagatatgcaaaaggagtctactaacactgagtagcagggacattaattaatttgaatatccaccgccaaaccaaattgatgctggattaatgttttgatttatcatgtgccgtttacctctaggcacctgcatgcatggtattaaacaaaaattaatatgtcttatatatccactccattattgatccccggccgtacttttgccagaaaagaaagattggaaggcgaataaaagacggtgtggaccattattaattgtccatttctaagtaaatccaagcgcatgctggctggtggactatatatttcactcatcttctgctatacatttgcgatcaaaattcacaactttattattcagaaaccagtcttatagagagaaagacagaccgacatgcatcagttgtagttgttcagaaagatcaggggcgccgttgcatgcacatcgacgctgggaccaaaaaaaatatacaacatcatcgctgactcagatgttctgaaagtagctaagaatgtacacatgtaaaataagtatgatcatttctttgcttagtggacaaagattaccttaattatatatatatctcgttaatgcatgcatgtttgataaggaaaagatttctttgctgaatgctcaccatcaacttttcgtggcctaagttgcatgtgaatctcatcatttttacaattgatacacggaataatctttttggtacatgtttggtgcgatactgtggtggacttgtagatagagaggtgtgtcggtcaccagaaaccagcactctagctaccacgaatcaccttttaattttccctgtttgcttttcgttagccaaacgaggcacagtatgaacatgataattaagcagcaagggaggatctactgtagatgatttcgcaaattcagggcacagtacatgtagcagagggaccaacattcacatgcagagccatttcagtttcagtactatctaaaaaggctaacctgctctcatgctttgccatgaataatgatggagttgttgcatgtgctgagatgatgaatgtttcagatgaatatataagtttcaccaccacattccaaacaaacacacaaccattccaattctattctaacccatttataagctccttcattggaggttagcccaagggtcagtgttgcttgagaggtactcaccctgtgcaggtgccagtggactcaggccatttagctagctagccaaagccaattgccatgtggagtgctctcttctcccatctgagagaggttcacaagagaagcggagttaaggaggagaagttgataatgaagtcgccaccagcagcaggtgaggccggctgccacaagccacaggcgactgccaccaacaagatgacggtgctgcagtccccgctggggctcaggaccatcctcacctccctcgtcgccttcttcatcgtcgtcagctccgtctccctcctcttcgaccgcggccaggatgctcaggcgcaactcgccgtcgagcagcatcagcaccaagaagttctgctcaagcagaagccggcatcagcagcagtgggcgagcagaaatcagtggtagtagatcagtcgtcgttgaggagccaggaggcgcaggtgcagtggacatctgagctgcaggacgtggccacggacagcggcgacggcggcttcgacggcgaggaggactgcaactggtcgttgggacggtgggtgtacgacaacgcgtcgcggccactctactccggcttgaagtgctccttcattttcgacgaggtggcctgcgacaagtatggaaggaatgacaccaagtaccagcactggagatggcagcctcacggttgcaaccttccaaggtatcaacacaactcatctccattctaatccacatcaattttgacactacgtacactcactactgctgcaaggatctgaaactgcactactacttagtactacactccgttcgtactagctgtctcagtgtttcttaccaaacttccaacttgacctactcatggtaacaaaaacgtttttagttttgtgaaagcaggggaaaatgttctctcctagtcctgcaggaaaaaaaaatcaactttattttttttttcagattgctcttgtaacccagagtcctaggtgccaactggaaaacatacagagaaaaattggttggttttgagttctttaaacaacggttagttttggggaataaattattggacagcaaaagatcggttgtttttttagataaccaaagatacagtttgtgaaagatcagttatgagagaaccaatcgccaatgcttacttgataaagaacttcagaagttcttttttttttcttctgatatggtgtcgcactcataagaatggaccttttaaattcctatataatggtcaaatccattggaagttttgaggaaatataacatgaagtccaagctcttgataatttcctttgtgtcatcctctcttcaaattcctgtactgttatgaagcatccaaaaaacacaattgagtaattcctatatttttcatattccttatgattacattgacacgtcacttcaatttctgtgcttttcttattcttgtgttttcctgtgtttctcaattcctttgatccaaagagtcagttaatatgttcctcccataattaatacccaattaaaatagtacaaggtacctagtggaaagaaaaaaaaaacgtcatttataatgtgtccagattgctaaatttataatatggttgcttctgtaatccaatggccaactagaaaacgtacagacaaactattgattacttttgagttattcttaaaaaaattgttagttctcaggactaaactattaacagtgaaagatccgttatgaaacacaaaccaatcactattcactaatgcttactatggattaattgtttttttttctgatatatggtgtcgcaatctttaccctgtcaaaacagattcaatgccacaaagtttcttgaaaagcttaggaacaagagactggtttttgtgggcgattcagtaaacagaaatcaatgggtgtcgatggtgtgcatggtggagcacttcatccctgatggccgcaagatgcgcgtttacaacggctcccttatctccttcaaagcatttgtatgtctcactaatctcttcatcccaacatgcttctgaattcagaaatcagaaacagtacattctctgatctgaacatttcttctgtttgctccaggagtacaatgcgacgatagatttctactggtcaccactgctattggaatcaaacagcgacaaccccataattcacagagtggagtaccggatcataagggcagacaggattgagaaacacgccaatgtctggaaggacgctgatttcatcgtcttcaactcctacctttggtggaggaagcagagggatggtatgatgatgaaagtcatgtaagtacttaatttttactcctctttctttcctggtcagaaaaaaaatgttgctcttttttcttattccaatgcaacaaagtggggtttggaggcatcagaaagttttactactttttcagtcaaaaaaagtttcctttttttctctttccaatgcaacaaactctgatttggaggtatgatcagtaagtcattatgcaaaaatgtaggtatggttcatttgaggacggggatgcaaagttagatgaggtgcaaatggttgatggttatgagatagctctcaagaaactaactgaatatcttggagccaatatcaacaagaacaagactagaatcttctttgcaggctcatcacctgcccattcctggtgagagaacgtacaactcttgcatcatttctcaactgcgaaacattctgaaaaccaataaaattcatcagctctactcaagttcaaagcttgcttatatttttgaccctgaaaatgaaaaaaaaaccccaatattagggaaagacctaatatcaaataattagaagggatgagactttgaacccatgccggctagcttcaggcccaccaccttgtggagctagccggaagatccctgggtgtttctcatgacactgaaaatggcaattaatctacactgaaaatgacaatcatgtgcattctgacaagaaaattctggaacaaaaatggatgttttccagggctagcaactggggaggagatgacaacaacaagtgtctaaacgaaacagaaccaattcagatagaagattataggagtgcaaccacagactacggcatgatggacaaggcgaaggagatatttggaacactggaaccaaagggcatacatgttcagatactgaacatcacccagctttttgagtaccgcaaggacgcccatccaacgatattcaggagacagtacgttcctttgacgaaagagcagattgcaaacccgagcatctacgcagactgcacgcattggtgcctccctggagttcctgatgtttggaacgagttcttgtatgcatacattatgcacaaatgatatatgtataataatgtaatcttaatttggccaaatttcttctttgttaacttgtgggtgtctaagtaggtataagtgcacagtacttggcccccatcaatttttttttcttttttgacatttacatcattacattacatgtaaagagaaagggaagaacataagcgcagaaatgaaaaggaagaagataagttaatttgcctatactgagagttactgctacttatcgatggttgtgcttgtgcagcataaaaattattttttgtgagtaagtactatacattgtacataaagcaaatgctgtaaagataggaaatcaattgccgaactggtcatgtcatgaagctcaccagggagcagataccaaattcagatagagaacttttcgtgcttatgtggatcgttggttcctccaatcgatcaccttttgccatatgggctgtttagtcagcccagcccagcgtagggcccatcatcatagattgtgaattaagtctagtttacgtccctcacattttcgtcaagattaatcagaaatcttaaatacctacttacaaaaccgggttaaatgagatgagatgtaccgtgggcgacgacgaacttgggggcgtgcatccggtgtgggtgtggccagtacgtgcaagaggagaggactggactgctgcacctgcggacacatccacatcacgggcgggccgccgtcgtttaggcatagcaccgccgcacgctcaagtgacccacggcgccgccctcgacttcgcgtcgtgcttctcactgtcgccccgcccgtccacgtcgtcgtcgtcgtctccaaccagctatagctcattctgcacaacgtacgtacggcaagatgaaaaccaaaccgtgttccctgctaattaaaactagctgccctagttaatgcctatataagcccttgttttctttcaggtatttaaatttttagtttcaagtgccaaatttgtactgtgtcattcataccttcgatctttcgctcgctcttactagtaggaatctttgcaacgatgatattaattaattaatacaatatgaacttaaaaataaagttcttgggtttagtaaagatcgatactacacatagtacacgttttacactactcatgtgatccaacctactaacccttatatgatctgaaataattactactactactatatagtataagtacatagcccttatgagggctagggtgaaaaaaagctttttttttctgtcctatgcagtagtaatatgttcgtatattgcaacggatctatacgacaagaaatagaaatgatttgtgagtatgatcgagtatatatatactaatataaaacggagaagttttttttcctacatccatctagtaaaatgtacacatgatttcccttgtttttctatagccatcagatcagatccttttgtctaacggctgaaaacgtccacaattggctagtctaacattgctatacggtgaactcaccgcagaaacgcccactgccagacgcacttctcccacatgctaataccatcgccgtgccttctactctatgaaaacatcaccgtcacaccctgcttctccaacaccgttgctcccttcatggcgtaacctcgctcctccaacgccgatgcacgcttccttccactacggtgcgtctccgctcactacaaatcacttctctcactgcaaaatgcatcacatcctcctcttgcgtcggagccttggtccagtactgttgcatacatcctcccgtgacggcgcgcctcctttctttttaaatagtaaaaatagaactatttaatcagtataatttcatatgtataaaaaaattaaatgataaggcattttcaaatataggtacatgtaattgcgaatatctagctagctatgcaattaatcaggtgcttaagatgatgtcacttagatggttaattaattactttgctgatgtatctggtagcttttctttagcgtttgagatgcaaatgaaaatggggagcatccatccagagtagtccatgtgtgtcacgcattcgtgtattccatcggattcccctgcctgcagacttgcagatacagttgagcgtacaaataaaccatcaacaaaatggtccttattgcgcatgctgcttcctgcatcaattctcgatcgatcaatcatcgtgcagatcaacacgaatggtccacggtacagagacagccgcccccatgcacctggttttttcaactctggttttcaattcgtcatttgttcattgttcacatgttcgtgtacatgtacatgacaaattgacaaccagtacttcattgtacaggtactactgtactagcagacgctattacttttcactcactccgtttctaaatatttaacgctgttgatttttttaaatatgtttgaccattcatcttatttaaaaaatttaagtaattattaattctttttctatcatttgatttattattgttaaatatacttatatgtatacatatagttttatatatatcacaaaaatttttaaataaaacgaacggtcaaacatgtacttaaaaagtcaatggtgtcaaatatttagaaacgaagggagtattttataatcttaaaaatgtacatatacttaattacatcgatcaatacgtgttgcctagctcgaaagtcgaaacccaaaattcaattagtcaatctactactactaccttgtaaaaggctcagggggtgtttgggagagaggggcctcagtttatatgcggtttggtttaactatagtttgatcatcacttaagactaaaatgtcttctcaaaatttctgctggtgcaactctacataatatttaaagcgtgcagatgcaatccgcataatacgaagtgacagagcatattaattaatcgatgagaatcaatttcataatcatggaggttttgttatgactgatcagaacattatttgcctaaatgatgatcaaacatggatgaaggagattgtatataataattatcaaattaagatgttgtcacatcaatgtcctaagtgacaaataaaaaaataagaacaccatgtcggtgtttgtaattcattttatataatgaaaatggattatgtcggtgtcttcaattaataacaagtaaaaaggagaaaagaatggaggtagtaactaattaattgatcagaggaaagtattacagtgatgcatatatccattaatggacgcatggacgaaattgatcggaacggttggaatcggtagtaaatctttgaaaacaattctcggttggtcgagaatgaaccatgcatatttaccaatttaactattcaatgtcgatataacagtacgatgttaaaagaaattagaaaaagaaaatccaaatattatatatgactagaattagaaatgatatcacttatataataataacgatgccgggtcaatcagaaaattcggtggcaataatatatataccagcaatatacatgtgcgcatatatagagcatacattaggaaattaatttcggaaaaggagaatgaagtttgagagtgacatacatagtcttaatctggctgcgcgtatatagttagctagccaggtggtaaatggattaaggagatgagggagacatgcatgtttgtgtcgtttatattgagaaagagagaaataaatataggggggctacgacagcggggcggcgctggatggatgctgtatatatatatgtggccgggcaagagcgagcacagccggccggaggaggaattaagcaacaagctaagctaagctagccagaggaaacaacaaggaaaaggagagatcgatcgagcgatggagcggtcgacgacgacgacgacggagcagcagcagcagcagcagcaggggcggaggagaggcgcaggatggcggcgttgggcggtgctggtggcgacggtgtggatacaggcggtgacggggacaaacttcgacttctcggcctactcgtcggcgctcaaggcgtccctgggtgtctcgcaggaggcgctcaactacctggccaccgcctccgacctgggcaaggcgctgggctggtcgtcgggcctcgccctcatccacctccccctccccgccgtcctcctcctctccgccgcctccggcctcgccgcatacgccctccagtacgccctcatcctcgactacctccacctcccctacccgctcgtacgtacacacttcgtcttctctctctctcttttttttttcttttctttattatcgatcgcctattcgctttgttttaattnnnnnnnnnnnnnnnnnnnnnnnnnnnnnnnnnnnnnnnn

SEQ ID NO: 23853 - DNA, 1003 bp, Oryza sativa
caaaagaagagggaattccgggcgctccatcagggcaacaggactgtgacagagtacctccacgagttcaatcgcctcgcgcgatatgcaccagaggatgtccgcaccgacgccgagaagcaggagaagttcatggcgggtttggatgatgagctgaccaaccaactgatatctggggactacgctgactttgagaggctggtcgacaaggcaatccgtcaggaggaccaacgcaacaagatggacaggaagaggaaggccgctcagttcagggcacatcagggaagtcaccagaggccgcgcttcactcccgggcagcagggtggacctaccaccatgatcgtccgccagcaccgcccgttcaaccctagcaacttccaccagggcaccagtggcagtcaaaactaccatggaagtcagcccaaccgcggtacagctccacgcccaccaatggcaccggcacagtcaggccagcccgcgcaagccaagaaggagacgggagcaaaaccagggtcctgcttcaattgtggcgagcttggccacttcgctgacaaatgcccgaagcccaggcgtgccgggccaaggtttatccaggctcgtgtcaaccacgcatctgcggaggaggcacaaacagcaccggaggtcgtactgggtacgttccctgttaactcaatccctgcaacagtactttttgattctggtgcaacgcattctttcatttcaaagaaatttgtggggaggtatgggttaaggaaagaagagcttagcacaccaatgagggttcataccccgggaaatagttcaacctcagtcagttttagcccctcagtgctaatagaaatccaaagatcaccatttctagccaacctcattcttctcgaatccaaagacctagatgtcattcttgggatggattggctgaccaagtttaagggagtcatcgattgtgcgagtcgcacagtcaccttgaccaacgagaaggaagaaacagtggtgtacaaat

SEQ ID NO: 23854 - DNA, 6979 bp, Oryza sativa
gtccttccgactcggcgacccttctttcggtttcgccgagtggttgccgaccccgtccgccgttccgtttcgcccgccgaccgccggagcaccgtcgtcatcgtcatcccgagccgcgccgccgtcttcttccgctccggccgccgttctcgtcgtcgtcgttgtcccggggtgagccgaggaccgccgttcgccttcccccttccctcctctctctcgggtgccgctccgccgcgccggtggtcgccggcggtgaccatcggggcgcgggcgcgtccccctcccttcggccgcgccggcgaggccgccttcgggcgcgccccgcggctgccaggtggggcccggccgtcagccgcccgcgcccgcgggtgcggctgacgcgtgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagtttagtagtgtaaaagcccttttcttttccgttggtcgtgtagacgctgcagcttcggaagatccgctcttcgtggaagccgaagccgtcatttgggaaagcgagcaaggcaagtcacatcatccttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagaataaataaaaccccaactagtgggtactctattcatggttccactagtataaatttaggtagatgcttcgctgattaattaggcaacattaggtggttttataactttagacttgggatattctcatatcatttggacactatggaatggttggcttatgttggaattggacacacacctctcttcctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatgtggaatggttggcctgggttggcttgggacgagctggaacccaggtcgggttgccagttcggtccgaatcatcgtaggccttgggttaaggcaggttcgtgagggttcacggccttgtttaataatattgtgtagctctaggatcgtctttataaaataactttgggcaactaagtgacttttaaatgctgtttactgcaaaacctaacccctattattatccccttgtactctccttgcattaatcatgcatctgccggtgtggcttgctgggtactgtggttgtactcattcttgctcaatctttcccctcttcagtaagagaagctttggagaagatgtcttaggtggagtcctagcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctcttttcttcttcccctaatgctatttgcaaaaggtttacccttttcttccttcttcaaatttcaactagtactagatggtcagctttgcgaagaagaagatgtcgtcagttgtttgccgaagctccggaaggctgcaggatccgctagcgaagcgaaggaagcagtgaagccagctgtgaagcaggagtgaagatcttggagaacccgtcgcagaacctaagccaccctctagtgtttcgtttgtcgtatgtttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcctgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtacctacagtccagcaacagtgcaagttatcagaatttctcaaaacggggcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaaacatcacggccagaaggacatgccatcacctggaacgagttttcatctgtattcaagagatcacatgttcccgcaggaatgatcacactaagaaaacgagagtttcgctacctgaagcaaggagatttgaccgtcacagagtacctgcacgagttctatcgtttggctcactatgcaccagaagacgtggaaacggatgaaggcaaacaagagaagtttctccaggggttaaaagatgagctcgcagtgcaactactcctagaggattatgaagattttgagaaacttgtggacaaagccatgcaactcgaaagtgagcataatcggatgacgaactgcaagagaaggattgtcaacatcccagtaattccaggtggtaaccaaagacagcgcactgagccacttcagatcaccggatcttctgttgtgcatcaagagttcctgccccaagaagatgaacgcaatgcagacaacaacactagcaatactaatgatgatgataccaccaacaaccatggttcttgccccattagtgaccactcgaacaaagcgtgcaatgtcagtagcattcaccaagatgtcaacgatagtatcaatgttggaacccagaatgacaaccttagcaattttgactctgggaaggactccaatggtgatagcaataatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccatacctgtgaggcctcatgttaattctaacccatagtagatacaatgtaccgatgttaagcaccttccctttttgtttaaagcagtgcctcgtattcatgtaatatgggagaaatttgtaataaaaacaagctctaagaggattcttttggaagatgcggatatgtgatcatgtgtataattgtttactgacaaaggagacctagggtctcgtgccagaggaactacattctaacctcgagctaatcaccaacctgaggatggaaaagaaaatcaagtgattaaccaaagagacatttgtttggactaagagtttcagatgtgtctttttcggatcaaaggcaatgacagtcagtatagcttttggcgaaacacttcaaggtttcactgaaaggcagcaagccaaaggacctcatcatccccagaagcgtccgcaatccacattaaagaataccccctgttagagataagccgaaagaagattgataaaagagattggcaaagatgttctctagcatgaaagaagtaggccgaaaggtgattgataaacagaaacatgctctgcatcgctcaaggaagacccctaattgtaattgccccacaacagccaccttgtcattaagtaagcaagatgacctaggtaaaagtgtttctatgaaggcaaggggtgaagtcttcaactcggtatcagatgctacacggagtgaaaagtgcaagccccggttaccaggcgacgccatgtcttgggagatgatccaatgggaaagaacacatcaaggctgaaggtgcacaggaatacgttgaatgctaaatgatgacaacatgaagagaatagcggaaagtaaactgaacataaagaaagtgaatctgcgttgcttgttcgtgggagctattcccagttatgaatcaggtgatacgttcgaagatagtctacagaggtcagacaacgaagcttcagatttggcaggataacgatcaaacaataagaagtccagcagtaaagccatttggggagacgccaaagcatgtcaagtgggagaagttggttcggttgagaaacataattcaaaggcaaagttatcgaccctcgcatcgaatagcagaagtagctagcacccggagaccaggaaagctaatatgaggcagtttgtggcaagttagaagtaaatgacaagcctgatatccttatgacgacaagctggtatcacaagcatggtatcctagtaatgtcgagctgatctcgacgcatgacatgaagtgggtaacttgtatgaggttgactccaaagatgtgaactatgcaaagttctggaactgaagccccatcttcaagtgccgcaacccagtcgaagtcagctaaaggttcaaccagggacaagtcaggtgaagagaagattccatccgcaataggagatcgagccaagcagtcccgagtggagaagttttgctaggcaagtttgttataaaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttcaaaaaggaataatagaattaattaaaattcgaaaagaaattggcaaacactaaaacacgtacaagaaaaattcaaatgtgacccggagaatttttgttaaattctccttggtctaaaaggagccctcaaattttagtggaattttcagagcacaaataataagtgaaaagaaataaacaaagttaaaaaggttttataaaaagaaaaccctaaaagaagtcttttccccctcctcctcccttcttgggccggctcggcccattccctccctctctctctctctccccccccggcccatcggctccccgcgcgcgcgcgcgccgctgacaggcgggcccgcccgccactctcgctgacgggtggggcccacctgtcatctccctcctcccgccgcgccgccgcccgcccgtgccctagcgccgccgccgccgcggattgcgccgcatcccgccgtccccgcgcgcattaaagagaggggaatcactccccgcgtttccctctcccgattccccctcttttccctctctctctccctcggattcgtccggattcatcccgcgaagttcgccggcgtcttcaatggcgcccgagatctccgcgcgcggtttcctctctcttggccgcgctctccccctcccgttgctataaaatcgtccctcgtgcttcgctcttccgtttccgccgctcgccgctcgctctcgccgtcggtttcgtgcccgcgccgtgctcctctctctccgccgtcgccgtcgaccttcggttcgccgccgacgtcgctccggacgtccttccgactcggcgacccctccttcggcttcgccgagtggttgccgaccccgtccgccgctccgcttcgcccgccgaccgccggagcaccgtcgtcatcgtcatcccgagccgcgccgccgtcttcttccgctccggccgccgttctcgtcgtcgtcgttgtcccggggtgagccgaggaccgccgttcgccttcccccttccctcctctctctcgggtgccgctccgccgcgccggtggtcgccggcggtgaccatcggggcgcgggcgcgtccccctcccttcggccgcgccggcgaggccgccttcgggcgcgccccgcggctgccaggtggggcccggccgtcaaccgcccgcgcccgcgggttcgg

SEQ ID NO: 23855 - DNA, 6486 bp, Oryza sativa
  unsure (1)..(6486): unsure at all n locations
nnnnnnnnnnnnnnnnnnnnnnnnnnnnnnnnnnnnnnnnnnnnntgtcacccccaataattcaaatagactagttaagtatgcatgcagtgatgcttcttttttattattcctagttcatacttttaagtatccaggtacttaaaaggtgtgagacgaactaccggagcacatgttagagttcaagatgttaatccccaagtcatgtgggcatatacatcattatcgagttagcatttttaagtagtatgtggcttctgtccttcaaaattcaacatttcaagataagttactggttacatttgtttcctcaacactcgatagtggaagcatccaatactgcacaggacaatgaggacataccacctattgaaatgtttcgtaaggaactcacatgataagggcactggaagcaagtcttctgaccacttccacatgcaaggagtgaggcgtgatggcgacacacgttgtgaaaagcatggagttctccatttgcatcccgacatatgacaaattctacatttccaagtctactacatcaacttgttagattatcacaatcatgaatatccaatgtaaatgattttattttacagaaatttgggggtaatgatgactaaagtgttttctgtgcggatggctatatagaaatgtcataagaccgacacctttatgcgtataaaaataaacttcatggtttgcattagccactacaagattctggctacagaaggatgaaatcaccttcctgtgaagtagtcatttgggttcttgacttgccatatgtggcctggaaaacaaccatgaaaggaagcacaaaacaagctttcagtaagaagataaaggtgactatcaacactctttctgaactggccacaaaagttagtgaattatacactgatgatgatgcaatgacagtgaagagaagttactacaaaagcataaacgacaaacggatcagaaagctaatcaaggtgtctccatgaagaactaaccctaggaagttggaactcaacataaaattgaaatgagcaaagctactaatggacaacaattgtacaaggagtctcaaatgcaatnnnccatccagataatccctctttttgaaacacctacacaagtcccaccactgtcaacattaaggatgttggtagcccttgatctgtttagcatgggccctgaacccctgaactcaccccatttcaagcaagtgagaagcgagctcttaacttccacactcccacttgcagtcttactcacatcacacatattcccctctagacaagtcatccattgatggcatacagctcaagtaaaatccaccattagcgatggtttagaagcgatctccactgccagcgcttgtacaatcgtactaccacacaactagcaaccaaccaatcgtgcggaaactaagaacaaatggaggaggggggttggagtgtgcgaaatcgggagtatataccaacagcctgccacccgcggaggaagacgcggtcgagctcgagccggagaaagtccgggtcggtgtaccacccgctcggcggcgtcacggcggaggccagcgggaccgccgggtcgaacgccgccacgaggcgccgcgcggcgggctccggcggcgccacggaggaggcggaggcggcgatgcggcgcggcgcggcgcgggtcggccttgggcgggaggctcttgcggcggatgataccgcggccgcggattgcgcgatcgccatcgccggcgccggcgcacgagtcgcgagaggcgtgggaatcggagagaggaggcgagtcacctgctagcgtggcaatgttgtcaaatttggtttatgaatttatgatgttgtcaaatttgatttttaaattcgagttttttttttttagagatggaaatttggtttggctctgttcgatgttcttgttttctcatgtctctccaatccaacctaaggctactaaccattattatgtgtcacttttcaaagataattaaaatatgcaaaatcgtatgttgtctattttatttcaagctttttcaaaaaaatatagagataactaaaatggatacatgcatctcatcgtctacctgttaatatatcagccttagctaaaatttattttttaaccttaaatttagagtatgtttgggggttttcattcatgcgagtgttcgtttggagaggatatggagaagaaatctctcgtttttttgcatgcacgatcccgaatggcttgatggtgtatttttttacaaatattctatagaaaagttgttttagaaaattattttaatttgtttttaaaatttaaaataattaataattaattaattatgtgctaatgactcatcttgttttatgtatgttttcaatcttcttatttccctttctcttaaatgcacaatatagtatatttctatatttttactcataagttattttgtattgctttgttttttttttgagaaatcaatgtctcttaaaattcttaaaatgtccaagtcctttggaacaatctaaattatcgctttagattttgagacttagtaacaatagaatccataaataaactactaagtatgcagaaactaggttcttcgaattctcaccagctaaatactcaatggctaatctttaccaccgaaaccaaaatctttatacggttattccctgtttaactgagcttagaattctaattctaagtggtgaaaagctaacgggcgagaatatgaaatataattttatagtttctggattctaatttagtttttaattacataagtataatttctcaaaatctatataaaagtctggacaaagggttggagatttctatagaaagtagttgataccccgcgctctgttgtgggatatgtgaatgaatttatgtgatatattatataaatgatagatgtatatgtttaaataatgtaaaaatgatgtggagatggttatttgatagtgcttacatgttgagttctaaaagaacagtaaaattataaataatatatcatatttgtatgagatttaagatactctatataataattactagtgggtgatgatgtggcatacttgcgtattaagttttagaagttagtgggtaccaatagtatatagaaagtataagctctctcttaaacatagccttaaactgtttacggtccaaggtgaagcctactcaatttgggaagtctcggttgctccttgggtactcctggtccaagatgcgtaccgtcggcccatcggcccagcaagccacctatttattggtcgggccagtctaagacaaacagaccaaatttacttaaaaaaggggtatgtacacatttacagagttcaaacttcgacaataagatgatgaagtgaatggatgttgccatatgagcaacttcctaaaatgaaaacaagatacaacaaggcgctactctcctaaatatttggaaaccccatattctttccagaccacgacctcctctttaatcaaggtaaagaggatgcccgctgcttgactctgactttggaaaacacgtatatttctcttcttccaaaccatccaatagacaagcagcacaagagtgtagaaagcatgcatccctgtaagctggtctgaaacccttgccgcgccgtgagccaccattctcccaattccattcgcgcttctgcccacagttggaagccgattcatgtccatcccttgatcatcctctagactggaagtgcaagggcaggaaataaagagatgcccagagtcttcgttgctgatcatgcatagcgcgtttgctcagattatcagccgttagacaacgtccaatttatgttgtgttgcttgataatttcactgttcgtcgtctactcttctggcaccaatctgaacatttaattggtgttactatcaaattacgaatctaccgatctgaacaaaaatcatatcacaagttccctccgaaggctgaatcagaaccagtgaatctaccaacagaaaacagtgctacgcgtttagagcagttacaatagcaggctataaaccagctgcaaacatattttaagaagataaataaggagagagaagagcagcgtttgtagcccgctatagcacggactccaagacgcagtgtgtgtataacaggtgggaccatgtattattagtgtagtatataactattgtatgaataagctattagattaattatagttattgaagctagtagttaactatactattaaacttggcccttaccatttcttcacaagttgccgtttctgctgtgccaagcaggtcgcactcctgcctgtgcctgaagggcgaaagaaaaggaagagaaaaacgtcctcaccacaacccgtgccgactgagacttaccgatcgctctcgcgaaccaagacagaataccgagacaattagcagcgttccaacccgtactaacacctccaattaaatcaaatcaatcgctcgcttaataattactaataaataatctgatgactcagcggctgcagcttgagctaaaccgacagtgaacgaaacggataagatcatgtactgctgctgcgctggtccaacgacgtgaccctggtttcgatctcactcattatctctccatctatctcctctccaaagcttatcctctctcgcctcacttttcacaaccctgtctttcccatccctttcgcaaccaaccacattttgaccctcctaattacaccaatttaattaggctgtgtttacacacaacttttcagtcacatcatctccaatttcaaccaaaattcaaactttgcgctgtactaaacacagccttagataattaattaccccctcactcagtcctaaaatataagcatttcatcctaaaatatacttcctcggtccgaaaaacgaatttagaattgaatataacatattctaacactataaggcaccctttgattcaaaggaaattcataggaattttagaggatttctttcctataggaatttttcctatatagccctttgaatcaaaggaatggatcttatggaatcctatgaaattcctatggattgcctaatgccatgcaaattttggaggaattctaacctgaggtaaaacctcttggaaactttcctttaagtctttatctctcctctaattcctgcgtttttcctgcggttcaatcaaacgactattcctgtgtttttcctgtgttttgcaatcacctattttacacttacattcctatcaaaaacctgcgtttttcctattcctatgttttctcattcctgtgattcaaaggggccctaaatctagatatctagtactactttgatttttttataagacagaggaagtaaacatctttggctataaaactagataaatgtatatccagtaataactaaaagttgttatattttaagatgaattagtaattcttttccaaaatcataagaaattctgagtgttttcgcgtcaaatccatgctaattattgagcaaaacctggtcgattagtactaagcgctatactagataagctctccgctgaacctggtcaccgatcacgatcagttgcggcgtccacgtcttgtaaaggcgttttggataagcctccctctgaacgtcctgtccccagtatggccgatgtgtaggtatagtagctagtgtgttcccctgatggccaagaaaagataagatgatgaaatggagattaaattactcctaataaggtacaatatgggcaccaaccagcaggaagaatcagtttggctttgcttctgatctttagcaaaacagaaaaaaaaaaaaagaagtcatcatgctgatgatagtattgttcattcatggatggatgcacacaaggtggttacaagtgtggttgttggtccctaactaggagtacttatatacatgaaacaattgcatatgcattatgcagatgagataagtgcaaagaacagattgggatgactaattgggtcttgattaattcatctctgcatgcctcctgcagctatattgacagaaggttattgctattgaacaaaattgaaggttagcccaatgagatcaaaggcactagctagttaggaattagtaggatacatacatggcatatatatgcaccaagaattaaacattgttcaataggagttctccataagtgtatttggtgcatgatatgatgctctcatctcttggtcaatgcaattatgcaactaattaacagtgagtttgttcataggtaggattggcatgcagctaatataagagaagaagaaatcaagaaacctaagcactaatataaggtatttttgatggttgatttgatgagatgagatcccaaactattacaaaagggatccatccatattatccatctctgcttaattaatttgtcctcactgaatttgattcttttcatcatttcatcctcctcctcctcctcctcgtcgttgtcctcagccattgccgccgccgccgccgccgtcgtcgggcggcggtggatggtgg

SEQ ID NO: 23856 - DNA, 7758 bp, Oryza sativa
cagccgccatcatcccccactaccccaccagccagatcctccagctgctgcaccacgtccttctttttcctggccccaccacccccaccaccaccgccgcacatcccgtacggcgacgacggcggcgccaccgccaccgccgccgccgcagccgccacaacggacatcgcgtcgcccggacgacgccgccgctctcatcaatggcccggccggcggctcacctctcaaacgagactcatggccaccaccaccaccaccaccgatcgatcgagacgtcgtcgacgacggacagatcgacagacagaaggaggcaaggtgatcgccgcggcggtgtatatagccaccacggcgaggggaggaggaagacgacggcgacgcgtggagagggggagacgtgtcgggggcagcgagggccacgggggcaccagagacacacaggcgagctgcatgcacggcaacacgtacgtttcagctaaccttagctatactattagctttaagcttagcttagctttatctcatctttttgtcatgctatgcttgctagctgcatgcattattggcttattgcccatactctctcaccttacagtactaccttaggttagctgtagcggctgagtgaacagcacgctatagctcacgggctatcttttcgcttgtatttatgcttatagtaaaaattaaaattttcaacttcaaattaaaagttggtcacagggtattctcatcctgatttagttttaagtttacttttagatcgttacgagaaagtacatacaagttttttatttataaattatttattttgcaaatatgttatttttggtttatatttctctaataagctagacgatgggttgttagctgtttccataatcaagaagtatcatcttatctgcaagctaaaatttgctctgtttaatcaattattaaattgatttggcacacacatatgatgaaccagtttagcataactggggtcttatccacatccacaacaaaccatattgatggatactccaaatcaagatggttcgtcttatctgcaagctaaaatttgctctgtttaatcaattattaaattgatttgggacacaggcgatgaaccagttttgcataactggggtcttatccacatccacaacaaaccatattgatagatactccaatagcatatgctctgcctcgtgttaattccatgcttgtaattgtaattactactccccttaatggagtacaagccagtactacattatatcttccccttgatgatttcctaagcatgcagatttactcttgttcacagttacttttagttaacacagagatgcaattatcttcttcttaatttgcacactgccgtgtcattccttggtattaattaagttcttcttgattttgccttttaatttgctatatataaagtgagcccccatttgcaatgtgtgggaagttggcgtgaaatgctgggaacattgccatgcatgcatgcaaaatgatatcctatcttcctataaaattatcccctactaactccttaagcttaacatgtaaagatgccacatcatcatccactactacctccgtcccataaaaattatatttctagctaatttaggacaaaatagtaggattggaaaatgaccacaataaccttatttaataaacgcactgcatgcacacattccatatatacaaatgattaaaaggaagtttgagagaattaacccatataattagcatacttaataaaattacaagcattagcagcccaaattatgtgggatggaaggaaacttatatagatgaatcaattagttgggccccacatggctagaaatacaatttttgtgggacaaaaccttggagctagaaatgcaatttttatgggacggagggagtaacaagatgccacatcatcatccactaacaatcatcacatttaaacatcatacaaatatgctatatctttatagtttttataatttaagagctttttaaatacaaacatgttaaattatcatccaacataatttatataatgttttaatgtatatttttattatgttttatgatatgtcaacttctgttagatatggccggtgataagtaattagcaagcaaattcaccttgactaatggttataaattctgtcgctttcatgatcttcagagataaacgataacacttcgtattttttttgattaatttcattgcaaggcatacgtgtctccaggtaggattcgattcccgtcaattaatttttacccctctgaacatttcaaggcacatagtttcttttaacaagtgactgcattttcgacagagacttcttgtatgctcaattgtttgagttgcatgcttgattaagtgcaaaattagagatcgtgtgtgaattaaaaagttacaaaccgatgatgattaattctgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccgggtgtagtatagatctaacgatcatatgtgctcatgccccctagagggcctcctgcccaccttatataggatggggggcaggattacaagatagaaaccttaaccaacacggtatcggcttcctaaatctactttacaatattatcaaatcaggactttaggccgctccataatataaaaggaaacgtaatacccaagtcatgatctgttacatatccatacatatatgttatcccctattactagtcggataaccatgccgtgtgggtatggggtacccataatctccacagtagcccctgaaaccttcacagtcaaaaagataatcttctcccgaactaaattattccaaagccgagtacttcaatcatctttgccatggtctcccgagtacttttaccaaatctgaagactgggagggctgaaaaaaaagtcaggtgcatcgactagatgcacctaataggtgtagccctcgactatgcggttaagtgaacaaaccaagcatatagtcaaggaataaataatccaaccaaccgagtggcttcgataattatagttaaccaagcgacttgatataaatatgtagcatatgcggtgtaaatccctgaataacatgatccgagtgatataccgactgctttgtaaaacatgatgagtgtaacctaaagttggctacattattgaaaattcacatagcaaaacagctataaaaaagcttgtatgttgtgaataaagaaatttccaaagtattgggcatacgccatgcgcatactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctagaccaaaaaatatgccttcgacaccctttaaaggatgacgcatgtaacatgctctcgagtaataaatcttccgggtgatatagaccaggtgtagctcatatgaatagcttctgatctgagtgattatcccttatgagatactccaaaatatatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaggatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagcagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccataatgacaaagttgtgttgccgtgatgaagtgaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccggcgatgaagatggtaaggccaatcaacactagcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcagatgaggcggccggtcggtgaagacgtagacgcccaacaacggcggtataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccacccgtgcaggcgaggactcgtcgtcggcaacaaaggcaagccggtcggtgaaaacttaggcccccaacaacggcggcttattaggccaccccttgcggcaaggacatcggtcggcggcaacaaaggcaacccggtcggtaaaaacttatacccccaattacggcggcataaaggccagccgtgcaggcggaaacaccagtcggcggcggcgaagcaagccggtcggtgaagacgtagacgcccaacagcggcggcataaaggccagccgtgcaggcggaaacaccagtcggcggcggcgaaggcaagccggttggtgaagacgtagacgcccaacaatggcggcataaaggccagccgtgcaggcggaaacaccagtcggccgcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagtttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagctcccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccctcggtgacagcagaagtagccgatgtgggaataaagcagtccatcaatggtgacaaaaacaccagtcggcgccagtggaaccaagccagtggtgtagatgatgaagcccattaacagcggcgaagtccgccaaccgtataggcaaaaacaccaatcggcagcggcgaaggccagccggtcggcgaagacgtggacgcccatgaacggtggtgtgaccaaccaaccgtataggcgaggacaccagtcggcggcgacggaggcaggccggcggtgaagtcgtagacgcctaacagcggcggcataataggccagccgtgtaggcggaggcaccactcggcggcaacggaggcaggccggcggtgaagtcgtggacgcccaacagcggcggcataataggccagccgtgtaggcggaggcaccactcggcggcaacggaggcatgccggcggtgaagacatggacgcccatgaacggtggtgtgaccgaccaaccgtacaggcgatgacaccagtcggcggcgacggaggcaggccggcggtgaagtcgtggacgcccaacagcggcggcataataggccagccgtgtaggcggaggcaccactcggcggcaacggaggcatgccggcggtgaagacatggacgcccatgaacggtggtgtgaccaaccgaccgtataggcgatgacaccagtcggcggcgacggaggcaggccggcggtgaagtcgtggacgcccaacagccggggcataataggccaaccgtg

SEQ ID NO: 23857 - DNA, 15946 bp, Oryza sativa
cggcagcggcgcacaccaaccgtggaggcgatgaacccaatcggcagcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtagacggaggcaccaatcggcggcgacggaggcaggccggcggtgaagtcgtagacgcccaacagcggcggcataataggccagccgtgtaggcggaggcaccagtcggcggcgacggagacaggccggcggtgaagtcgtagacgcccaacagcggcggcataataggccagccgtgtaggcggaggcaccactcggcggcgacggcggcaggccggcggtgaagtcgtagacgcccaacagcggcggcataataggccagccgtgtaggcgaggacaccagtcggcggcgacggagtgaataggccagccgtgtaggcggaggcaccactcggcggcgacggaggcaggccggcggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccgggtgtagtatagatctaacgatcatatgtgctcatgccccctagagggcctcctgcccaccttatataggatggggggcaggattacaagatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacaaattctacctacctacctgctgctgcctatctcttcaaatgcatcagggtttgtgcagacgatctcgagcagcaaagatgcacgtatgccttgcaattctgaatatatttatactgtactgatctagatggattctgaaaaatactactatactggtgtacgtggcgtacgtcgtggaccggatgtgtgttaagatgacaaggcattacttaatcctagataattagtagtatacgtgtgtcgctgaagttgtcctgatccaggcttggaatttggaatagtcctgccagaaaaatatggctgtgtttagatctaaagtctttagtatttttccatcacatcaacctatcatatacacataacttttcagtcatatcatcttcaatttcaactaaatttaaactttgcactgaactaaatacagtctatattatcaatctcgatcatgagaacaaaaggcactagttttcttcctcagtttgacaagctgcatatactcctttctttaagagaaatcctcagtgtgatagcgttttaaccgacatgaacaatcagtagaatctcctagaatactcttaccatggtcagaattaagatcctcagagattaaattttcttagcctatggtgctgtttagttcacaccaaacttctctctaactctcaactttcgatcacatcacatcacatccaaaactttcctacacacataaactcctaactttttttctaaactaccaactttacctaaacttctctccaatttcagaaactaaacacagcctataattaacacgcatgcatgcttcagttatcaaatcatcattcatctcgatagaacatctaccttctccctctgtttcacaatgtaagtcattttagtattttttttcacatttatattggtgttaatgaatctaaacaatatcaatataaatgtgaaaaatgttagaataatttgtatcgtgaaacgcaggaagtaattagtactaacaattaaatcaaggtacgcacgctacgttgctgcttaatactcatccaaatctatcggcgaaaatgacaccgatcgatcatggagaggggatagccaccagctgctagctgtccatcatcacaaacagctatagcattggatcacttgtactcctatcctatctagtagactagtactatcgtgtcctgtcgaaactagatttcggcaataataaaaggggtggctatcaagctaggaaagtgtatgggtttggagacaaaggatttatacaggttcaggccttcttataaaagaagtaataccctactcctgtccggggatgaatccgccgagtgtgttattgattgtatgatttggagaaaatccaacaactgcccctagaggcgcctggaccccccttatatataggaaggagtccgggttacaaaagataatctatatccctaacggaatacacagatacagattaaatacagtcgtgaccgactaagtcttaagttgtttccttgatatacaagtcaggaaacaaacccaggatacacataagatattctatctatattcggtatcctatattcagtccaaatatcatcgccgtgtagatatgggatatccataatctccacagtagcccccgagacctttgcagtcaatcatcgtagccttctcaaagataataatccgagtgcttcaaacttttcatgccaaggcctgccgagtagcgaagacaaagactgtaaagggcgaaaagataaaaatatggtgcatcgaatagatgcacctaattaggtgtagcccccaactatgtgattagttaacaaactaaacatatagttgagaaatcaaataatagcacaattgtgcatcatatgacaaaagcacacacggcgcctaaataggcatgctagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctaggctatgactatttaccataatgaaaataggtatataacataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaatgattttatcagcattgggcaacactattgtgcgcataatattgccaaagcaaaatatgcctaagtccctaaggaacacaatgggccacgctgttaaaagtattgggctgaagtactgttcaggcctaggcccatttgcacctccgatacccttaacaagaaatcccgagatccaagcgacgcttcgtcttccccgccggaactctcgccattttccccactccttgctacagtgcagaactgcgccggcgaactagggttcaccactccactcaaatccaccttcgaaaagtgcatcaaaatccttcccgtgatccaccgccttaatccctcatttctccctagccatccctcgaatcaaatcagcgcattcggataaaatcgatggcggaagagaaggaaagcttcgaaggccaatgggcgccgtccgacgtaacggaagagaacctgaaggagatggtggcgcacggcgttctcccagccaaggagatcatcgggtggcggccacgcgttcggtaaggcttttccaccctgatacacatgagatcgtagtcttctcgcatttcttctatggcggcttcgctcttccgacctcgaaattcttccgcgggatattaagcttttatggaatcagcttgcatcacctaaacccgaattccatagtccacattgccaatttcatccatgtctgtgaagccttcttaggaattaaaccccacttcgccctttggagattatggatatcccatatctacacggcgatgatatttggactgaatataggataccgaatatagatagaatatcttatgtgtatcctgggtttgtttcctgacttgtatatcaaggaaacaacttaagacttagtcggtcacgactgtatttaatctgtatctgtgtattccgttagggatatagattatcttttgtaacccggactccttcctatatataaggggggtccgggcgcctctaggggcagttgttggattttctccaaatcatacaatcaataacacactcggcggattcatccccggacaggagtagggtattacttcttttataagaaggcctgaacctgtataaatcctttgtctccaaacccatacactttcctagcttgatagccaccctcttttattattgccgaaatctagtttcgacagttggcgcgccaggtaggggtagcgtcaagcttttcgccgatcagtgcaatgggttccatctccggcatcgacggcctcgtcttcccacccgggcagacgtttcggttcggcagcctcgacttcgtcaccaacaacttcggcaagatttctctcctcgactcggaatcagaccagtcgggagagaaccggatttcggtcccgtttggattcccgaacgcggctgaaagctacttcaagaccatctcaaccgagtcggcttcaaaccactcggccgagatcgcatcttctccaacgataccagatcaagatgatggggcttacccactagtcctgatgaagctccccgacgatttagcggccgtctccaccacgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacattgtggagtacgacgaatttagttctcgctacaacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcggaccgcgaaggaggctgaggatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcaatccgaccacgtcgtcaacatcttgaaccagacgaagaccatgattgcggcttcggtcccagttaactccgaaagcgtccacacgccgactggcagccgagttccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggaccgccacgacgacgaccttgacggagtagcagccttcaccgacgacctgcgtcgagtggattggccagccggcttcaagccgactggaatagagaagtacgacggcaccactaaccccgaatcgtggcttaccgtctacggtctcgcgatccgcgcagcaggaggagacagcaaggccatggcgaactatttaccagtggctttagcggattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccggagaatcccttcgagattacatccggcgattttctgaacaacgtaacaagatctccgacatcaccgacgacgtcatcatcgccgcgttcaccaaaggaattcgccacgaagaactagtcggcaagtttgggcgtaagcctcccaggacagtcaagcttatgtttgaaaaagccaacgagtacgccaaagctgaagacgccgtcaccgcatcaaagcagtcgggcctcagttggaagcaaaacaagggtacgccggctacgggaggtggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactctgacgaagaacaaagcacgtcgaggaagaaagacgacggcgacgccccggcaggatttcaagaccaccgcaaggagctcaaccatatcttcggcggccccttagcttatgagtctaaacggaagcagaagttgactgaacgagagatcaatgctgttcaacccgacacgccccagtatcttcgatggtcagaaatcgcaattaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaaaaccttggatgatatgcagattcctcgctccgagttaaaaccaagcaatgcgccttttcacggagtaattccaggattatccgcaactccactcggccagatcaccctcccggtcactttcggcactcgggaaaacattcgcacagagaatatcagctttgaagtcgccgatttcgagacagcataccatgccatactcggacgcccggcgttagccaagttcatggccgtcccgcactacacttacatgatgatgaagatgcctggtccccgaggagtgctatccctacggagtgacatcaagcaagccgtcacatgcgacaaggagagttgcgacatggctcaaacccgcgagatggcgtctgcccgagaggatatccgactggctgcagccacggcgagcgaaggagaaatacctgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattataccgacctcaacaagtcttgtcccaaagatccttttgggttgcctcgcattgaccaggtagttgactcaaccgccggctgtgagcttctcagttttctggattgctactcggggtatcatcagatccgactgaaggaatctgactgcttgaagacttcattcatcacgccctttggagcttattgctatgtcaccatgccgttcggactaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaaccttcgtgagcatccgtgctttcaggatgaaattgaaccctgaaaaatgcaccttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctgctgaagaaaacagataacttccagtggggacccgaagcacaaaaggccttcgaagatttcaagaaacttctcaccgagccaccagtcttagcctcatcacacccgcaggagccgttgttgctatacgtatcagccacctcccaggttgtgagcacagtcttggtcgttgagcgcgaggaagaaggccatgtccaaaaagtccagcggccgatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacgtattgctaagtgggctttggagttgatgtctttggacatatcattcaagccccgaatttcaattaagtcccaagcgttagctgattttgtcgccgaatggaccgagtgccaggaggatacccccgcggagaacatggagcactggaccatgcattttgacggatccaaacgactttcgggcactggagcaggagtggttttgatttccccaactggagaaagattgagctacgtgctttggatacatttttcggcgtcccacaacgtcgccgagtatgaggccctccttcatggactgcggattgcaatttccctagggataaagcgtctaatagttcgaggcgattcacagctggttgtcaaccaagttatgaaagagtggtcctgccttgacgacaacatgatggcgtatcgacaagaggtacgcaaattggaagataagttcgatggactcgagctcagtcatgttcttcgacataataatgaagccgccgatagacttgccaactttggatccaagcgcgaggtggcgccctctgatgttttcgttgaacacctttatacgccgacagtacctcacaaagataccactcaagttgcgggcactcatgacgtcgctatggttgaaaccgactggcgagaacccctcatacgatttttgacttctcaagaactccctcaagacaaagatgaagccgagcggatttcaaggcagagcaaactttatgttatgcatgaatctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcacttaccagctcaagagttgcaaactatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataatgctcgagacttcttcatcaacattgtgcatagatttggagtgcccaatcggataatcactgataatggcacacaattcactggcggagtttttaaagacttttgtgaggactttggaattaagatttgctacgcctcagtggcacaccccatgagcaatggacaggtggagcgagctaatggcatgatacttcaagggattaaagcgcgtgtctttgaccggctaaaaccctatgccggcaaatgggtgcaacaactgccatcggtactttggtctttgcgaactacacccagtcgggccacaggccagtcaccttttttccttgtctatggggcagaggcaatgttgccgagtgaagtcgaatttgagtctttgcgctttcgtaatttccgtgaagaacgctacgaagaagaccgagtggatgacttgcaccgattggaagaagcccgcgaagcagctttgattcggtcggctcgatatttacaagggttgcggcgctatcataatcgcaatgttcgatctcgtgcctttttagtcggtgacctagttttgaggaaaattcaaactacacgagatcggcacaagttatctcctgtcacgcccagaaattcacgaaccagaatttctaagctgaatgtgtattaaacccctgtccaggaccagccagggtacacaaacgacaattgttgacatacagacccacgccttacaaaaatataaaagattacaaatgcagcggaaaagatacaagcgagctaagcctgaagacttgactcctgcagcgggcgactccattccacaggcaaaccttgacggcagcgacgaaaccaacctctccgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgccacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggaccctttgtataaccccctctaaccgatcgcaccacaccttagggtttgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactcaagcccagccgttgcccacgctggcttgtggtaagtacgataaattcttccagggcatcccgcgaaccggtccttaatcgccatgggcacgtctagcaaaaccatgcacccacagcccaccatgaagtgtattttaattaaccaacaccattgcggtggcactaatccaaagctattgccaataatcaaagtctatgctttaatgtgatccccttttgtgcactagttgaactaagcatggctaagcatctcctaaaccaacatctagtcattttaatacccaagttatcaatggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatgaggccacagcaacgtcttcgagaaaccgcgaatcgacgaaacgggcgaaatctacgcgacaaacaaagcacacaagcaaaacatgctataagactactgaaacagataacaaagccatttttaatggattctacacatttttatgaatttactgagacttgaatggacttaatcggagctcggatgaattagttatgaattttagaagattcactgtgtttttactaataaagaaaaagtccttaattaattattgcgcaatattgccccagggctgacgtcagcaaggggtggggcggcgccgacatgcgggacccgcgggtcagtgactcaaggagagagaggggtggctggcaagcgggccccaccgagcggcggctcaagagagagagggaggggcgccggcacgtgggccccactggcagtggcacaaggcgggaggggcgcggctggtggctcggctcggcctcaaagccggcaggccaagcatggcgagcgacggcggcacgcgcggtcgccggcgacggcaaccggcggcgcggacggcgacggcagacggcgcgaaaagcggcggcggcggccgaagacgacgatgcgcgcgcggaggacggcgacgcacacggaagagagggaaagggggaggagggggagtttttcaccgaggttggccggcgcgagtggagaccacggcgaacgacgacgacgagcgacgggaggacgacggcgacgggcgaacgatctccgggacctcctagggaacaagatgggagggattagagggagaggggtggttaacggcgagtggattcgccggtcgaaggcggcggccatgggggtactcaccggcgcgcgaggaggagcaagctccggcggcgggattgaccggggaaacggcggacggggtggcgcacaagcttgcgaacccggcggcgtcgacggcgcggtgcggcgacggctctagcggcggcgagcggcgaccggaggagtggaaaaggcggcggcggcgggtgtagcggtgcgggagtgatggagggctcgggagggctcggccgagaaaggaaaaagagagaggaaggtgcgggcgtgcttaaataggagggggggcggcgagtcgtggccgggaacggcgcaatttcgccggagtagtggaggaggtggaggagaagagagagagaggcgggattcaaatttgaatcccggccatctcgcgggcgcggggtgagcgggagtggggcgtgggcgcggggagtgcggggcgcgcgggggagtgggcaacgtggcccggggcggcagggagcgcggggcggctcggcggttgccggcttggggagcggcggcgggaggttagggacgaccgacaggtgggccccacctgtcggcgcccgggaggagaggggaggtgggatggacttcggggaggggagggagaagcgggctggcgcgggaagaaaatgggccgggcccaagaaaaagaaaaaaggagggaaaagaaaagaaaaaaggaaaaaggattttccagggatttaatattgcactttgcttattttaattggttaaaattatttccaaggctctgaaaattccactaaaaatcctgttagcgtattttgacatgcagaatccaagaaaaattccacatgccgattccgattattatttgcatttattactttagggtttctctctaggttaaattaaacaatttcttcggacgatttattttatgaatttagagcaagggaggggtacttcagggcgtgacaaacctaccccccttaaacggaatctcgaccccgagattcggaagagctggcgaagaggtgcggatgggcggccttcaattcatcttctctttcccaggtggcctcttcctctgagtggtggctccattgaactttgcaaaacctgatcaccttgcttctggtccttctctcactggtctcaaggatacgaactggcttctccacgtaggtcaaatcttcttggatgtcaatgtgctctgagctagcttgttcctcaggtaccctcaaacacttcttcaattgagatacatgaaacacatcgtggataccaaccatattagatgggagctctagctggtaagcgacttcacctctgcgttccaagatcctgtatggtcccacaaagcgtggtgccaacttgcctttggtttggaagcggtgtactccccgaagcggagtgacacgaaggtacacataatcccctgcttcaaaagtaagctctcttcggcggttatcagcataactcttttgccgagactgggcgattcgcagtctttccctgacggtcctaactttctcctctgcttcagttaacacttctgtcccaaacagttggcgctcacctgtttgatcccagaagagtggcgtacgacacttccggccatacaatgcttcaaacggtgccatttgcaaactggcctgataactgttgttgtaagagaattccgcataagacagacttttatcccaggctccgccaaagtcaagcgcacaggctctcaacatatcttccaagatttgatttactcgctcggtctgaccatctgtttgcggatgataagccgtgctgaaattcaaacgagtccccaattcttcttgcagtttctgccagaattttgaagtgaattggcttcctcgatcagatacaatcttcttaggtaccccatgcaaacacatgattcttgaaagataaagctctgccaaccttttcccagtataggtagtgtgtactggaataaaatgagcaactttggtgagtcgatccacgaccacccagattgaatcgtgccccgacgatgttctgggcaaacctgttatgaaatccattccgatttcttcccatttccattccgggatctgaaggggttgtagcagtcctgcgggcctctgatgttctgctttgacttgctgacaaacatcgcagagtgcgacgaattcggctatctctcttctcatgctgacccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccattctcatcctcatggaaatctcgagcttttccaaccctcatattctttttcagctcagctatttcaggatcatttacttgagctgctctgacttgatccacgagcgtagtgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagccaaccacgccggcagatgcataattaatgcaaggggg

SEQ ID NO: 23858 - DNA, 3611 bp, Oryza sativa
gaccggctaaaacctatgccggcaaatgggtgcaacaactgccatcggtacttgggtctttgcgaactacacccagtcgggccacaggccagtcaccttttttccttgtctatggggcaaaggcaatgttgccgagtgaagtcgaatttgagtctttgcgctttcgtaatttccgtgaagaacgctacgaagaagaccgagtggatgacttgcaccgattggaagaagcccgcgaagcagctttgattcggtcggctcgatatttacaagggttgcggcgctatcataatcgcaatgttcgatctcgtgcctttttagtcggtgacctggttttgaggaaaattcaaactacacgagatcggcacaagttatctcctctatgggaagggccatttattatctctgaagtcacccggccaggttcttatcgactcaagcgcgaagacggtactcttgtcgacaactcttggaacattgaacatcttcgtcgtttctacgcttaagtttatcattgtacttccctatcttgactgtcaacatcaagttttcttcttgccgttgtcagtcgggggctatcatcataataatggagtgtgattttttatcaatttaatttgcttacttggtatatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtattgtacaaattgagcctccatttgctacatttacactcagtcagaatcagtcctttcatcatcagagttattattgctcggctgaaggtcgttgttgcggaattgctctacaacatcacttgcaatcttgtcagccgcactttgagcattactgataagatcaagagcagcttcttcacttgtcccgtctgcaaagccatcaatggtatcaatttcaattctcgggtacaaggatttggtcattgccaatgccatgctagctcccatacttccagctttcttgatgttcttgaagtacacatccggtgcaactcttagcttgtcaaagatctcggttgcgtcaagtgcactcggaccactgttattaagaaacatagcttggacaagtggtgtagcgacattggtgacttcgtttcttgctccttcaagcttcttgatcttaccaaccaggacatcaaactgagcttgagatttgattttacggtctacaaaacacatttataataagaatctgctgcattaaagagaggacagttcaaattgtcagctggcagtaccttcaacctccttcaaggctgagtccctttccgcagccagttctaccttgtcttttttcaaggcttctatttgcttctccatctgagccattctggtggcttgcgctgtttgaaatccaaatgttcgaggatacagttatgacagcataaatcaatggaacagatctggaagattaccttttgatgaaccactcagctcgaagtttgaatcctggagctgagcaattcgctcccttaattctttctccgtcttttttgcgtgctccttggcctcgtgtagctggctcctaacggcttcaagagttcccaaatgagggaccagcttttctaaggttgcagtcttggcctcattgcgaagatggattctctgcacggtgattcatgggttagttttgctaacgagaaaacaaagtcatcaaaggcagtcacctagaagacttacattcacaatgcgagtggcttctccaagtactttcttcagctggcacacttcctcgtcttctttttggcgatttataacaatgccggaaacttgagagttctcgtcccaccatttgagtaagataggaggacgagagtcatcagctgcctttatgcggagaatttcttcttcgtcgccgcctagtggacctgatgtattcccaagacattagacgaacaagctggagttattcagaacggcatcacttgagaagatgagttacctgaggatgtgcctggctgagcgtgaggtgatccttgctctttatctggagacccaatcactgagtcattaccagcttctggtcctcgagaagttgtctgcgcttcagcttcaggagtctcttgatttagatctacatccgactggtttccagtcgggggctctctggttgttgcagtttcagttgttgccgactggtttccagtcggcggctggtcactcggattggccttgtcatccgaagcatgggcgccagtcggctgactttcggcagtcggctggctttcagcagtcggttcagcatccttggatatatttggttctgtcacagccggatcaggatcttttccggttggatctatgtcggatggtttcctgcaaagtgttctttcgatattcagcgtaatctctatgagagaagcatatcaaagggagatggtaccgagaagtttatacctggaagatgttctaatctttggcatttgacggccggccagttttttcctgggcatggtatgctttgggagtttgttgggcgtgcccttgtccccagatttgttgctgtcatcgccctcgtcgtcattaagcaccagctttctcttgcgaggacctgtctgaccagccggtttggaggtttgaggttgtgagtctgacctgattgtcggccctccacttccctgaatggtgtgctggcgaggagatcggcgctgagcaattgggggatcagatttcatcaatacgtattcctgaatgagatgcttccacagttagctaactcaacatgaagacaagatactattttggtcataagttgaagatttcagatacatacctgcggaggcggattgaatgcattatatggcacaactggcagctggtgtgagtagctaacgacaatggcatttgagaagattttatacattctctccttcatgattttgaaatccagagagtctggttcttcgcgattaggatcatgcttgccgtcaaactcaaaagctgtacgggatctttctttaattggcgctagtcggcatttgatgaaatgccgagtgatctgctctccttgcaagccttgttctttgagttttaacatgcgatccaacaattccaaggcttgggcagcttcatctccgattggaagagagttccaagtatcttggtacaccgggggaagacaagagtattcgggaagagcaggctcaggattctgaacataaaaccagttcgcatgccatcctttgtttgaagtcttgaagggcattgagaagtatttctggctcagagttcccctcagctgaaatccggcccctccgactacacatggcttactcttgtttggttggggtttgagaaagaagattcggcggaacagggcgaagtggggtttaattcctaagaaggcttcacagacatggatgaaattggcaatgtggactatggaattcgggtttaggtgatgcaagctgattccataaaagcttaatatcccgcggaagaatttcgaggtcggaagagcgaagccgccatagaagaaatgcgagaagactacgatctcatgtgtatca

SEQ ID NO: 23859 - DNA, 13483 bp, Oryza sativa
ggcctgggcctcggcctgcggccggcccaacaaaaagggggggggggaaaagaaaggagaaatgggccgacggcccatttgacaaaaaggaggaaaaaagaaaaagaaaaaggaaaaaggattttccctggaataaaatattgcttgctcaattttaattggttaaaattatttctagagctctgaaaattccactaaaaatcctgttaatgaattttgacatgtagaacttaagaaaaattccacatgtcaagtccgattattatttgcattactttcttagggttttctcctgatttcacctgcattttcttggggtcatttgaaaattacgattttggctagggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaacacggcaaaaccgggtaaccttgtttctggttctcctttcgctggtatcaagtatgcgaaccggcttctcaacataagttaggtcctcctggatatcaatgtgttccgaatccgcctgttcttcaggtacccttaaacacttctttaattgggacacgtggaacacgtcatggatgccgatcatgttggatggaagttctagctgataagcaacttctccccttcgttccaagattttgtatggtcccacgaagcgtggtgccaacttgcctttcgtctgaaaacgatgtactccccggagcggagtgacacgaagatacatgtaatctcctgcctcaaaagtgagctcccttcgacggttatccgcgtagctcttctgtcgagactgggcaatcctcaacctttccctgatgattctgactttctcttctgcttccgctaatacttctgttccgaacagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgattgactcgctcggtctgaccatcagtttgcgggtgataggccgtgctgaagtttaaacgggtccccaattcttcctgcagtttctgccaaaactttgaggtgaactgactacctcggtcggatactatcttcctgggtaccccatgcaaacacatgatccttgcgaggtacaattctgccaatctctttcccgtataggtggtatgtactggtataaagtgagcaaccttagtgagtcgatccacgactacccagattgaatcatgtcccgatgatgtccggggcagtcccgttataaagtccattccgatctcctcccatttccattccgggatttgaagaggttggagtaaacctgctggtctttggtgctctgctttcactcattggcaaacatcgcagagtgcgacgaattcagctatttcccttctcatgctgacccaccaaaatttttctttaaggtcttggtacattttggtgctgcctgggtgaatggagtactgggtctgatgagcctcggtgagtatcagatccttcagttctttgtcgtcaggtacacacaatctttctcccatccagattgtgccatgctcatcttcgtggaaatcccgagcctttccgactctcatgttctttttcagttctgctatttccggatcatttacttgagcggctctaacttgatccacgagcgtaggccgtgcctccagagcggctacaaacccgtgttcaacaattcccatgttgagatgttcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcatcgcaatagacttggaagtctttcatctggtcgggcaggatcaaaaccggtgcggatactaatttcttcttgagctcctcaaaactcttatcgcactcagctgtccatttaaacttctcatctttcttaagcaactgagtcatgggtcgggcgattctggagaaattttcgatgaatcggcggtaataacctgccagtcctagaaaactccgaatctgcgacacggtcttaggtggggtccatttggtaactgactccacgttcgatgggtcgactgccacaccctgagctgtaatgacatgacccagaaattttacttccgtcaaccagaagtcacacttgctgaacttggcgtatagctggtgctccttcaacttttcgagtaccagacggagatgttgctcatgttcttcctcggattttgagtagataagtatgtcgtcgatgaataccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagaaaatactttagctcctttcagttgatcaaataaatcgtcgattcgcggcaaaggatatttattcttgattgtgacctcgttgagtgcgcgataatcaacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtatggtctcttatagattggagcggttcccggtgccaagtcaatccggaattcaatctctctcttgggtggcatggtagtgaggtcttcggggaacacttctggatactcgcagactatgggtatatcttccaattttctcaagttcttctctacggtatccactgggatttccgtctcaatctgattcaacgagacccctttctttggtgagactagagatttgtacaccactgtttctcccttctcgttggtcaaggtgactgtgcgactcgcacaatcgatgactcccttaaacttggtcagccaatccatcccaagaatgacatctaggtctttggattcgagaagaatgaggttggctagaaatggtgatctttggatttctattagcactgaggggctaaaactgactgaggttgaactatttcccggggtatgaaccctcattggtgtgctaagctcttctttccttaacccatacctccccacaaatttctttgaaatgaaagaatgcgttgcaccagaatcaaaaagtactgttgcagggattgagttaacagggaacgtacccagtacgacctccggtgctgtttgtgcctcctccgcagatgcgtggttgacacgagcctggataaaccttggcccggcacgcctgggcttcgggcatttgtcagcgaagtggccaagctcgccacagttgaagcaggaccctggtgtcgcgaccgggaaaattgccttttcccgaacgctagtgtatcaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttcttcaaagcttctcttactgaagaggggaaagattgagcaagaatgagtacaaccacagtactcagcaagccacaccggcagatgcatgattaatgcaagggggggtacaaggggataatataggggttaggttttgcagtaaacagcatttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacataagttccaacccatcctaaccataaacaagagtaccgacccaatccccctacgggcgggacacccgggacaggcaagcaggactgaaccccctagcacagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccaagcttaatccttatagtacccgaggtacgactaacaaaacccaaccacgcacctcgagcccagcctaaaccattttgggggttttgaaaagagggggaggtgtgtgtccaattccaacataagccaaccattccatggtgtccaaatgatatgagaattcccgaagtctaaagttataaaaccacctaatgttgcctaattaatcagcgaagcatctacctaaatttatactagtggaaccatgaatataatgtccactagttagggttttgtttattctagggtgaacaaggtattaatatcaataacaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgctttcccaaacgccggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaatttcaattaaaaaccgggtttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggcgcgggcggctgacggccgggcccacttggcagccgcgagggcgcgcccgaaggcggcctcgccggcacggccgacgggaggcggcacgaccgcgccccgatggtcaccgccggcgaccaccggcgcggcggagcggcgcccgagagagcggagaggagagggaagcgaaagggacggtccacggctcaccccgagacacgaggacggcggagacgacgaacggagcggaggaacgcggcggcgcggttcgggatgacgagggcgacggtgctccggcggtcggcgggcgaaacgaaggagcggacggggtcgacgacgacgcggcgaagccgatggaggtgacgccgagtcgggaggaggcccggagcgacgtcggcggcgtaccggagctcggcggcgacggcggagagaaggtgcgacggtgcgagcacgaatccgacggcgagagcgagcggcgagcggcggaaacggaagagcgaagcacggggatcgaatatatagcaacgggagggggagagcgcggccggggagagaggaaaccgcgcgcggagatctcgggcgccattgaagacgccggcgaacttcgcgggatgaatccggacgaatccgagggagagagagagggaaaagagggggaaacgggagagggaaacgcggggaatgattcccccctcattatgtcgcgcggggacggcgggatgcggcggaatccgtggcggcggcggcgctagggcacgggcgagcggcgggagcggcgggaggaaggcgatgacaggtgggccccacccgtcagcgagggcggcgggcgggcccgcctgtcagcggcgcgcgcgcggggaggaggccgatgggccgcggggagaggagagagagggagggagagttgggccgagccggcccaagagaggaaggggggggaaaagaagacttttagagatttttctttttataaaccttttcaactttgtttatttcttctcaattattatttgtgctctgaaaattccactaaaatttgagggctctttttagaccaaggagaatttaacaaaaattctccgggtcacatttgaatttttcttgtacgtattttagtgtttgccaatttcttttcgaattttaattaattctattattccttttaaaagatgatttttatttcgggatgaatttatcaggacgtgacactggttttgctcccgtctccttcttggcttgcgcgggctggcctgactgtgccggtgccattggtgggcgtggagctgtaccgcggttgggctgacttccatggtagttttgactgccactggtgccctggtggaagttgctagggttgaacgggcggtgctggcggacgatcatggtggtaggtccaccctgctgcccgggagtgaagcgcggcctctggtgacttccctgatgtgccctgaactgagcggccttcctcttcctgtccatcttgttgcgttggtcctcctgacggattgccttgtcgaccagcctctcaaagtcagcgtagtccccagatatcagttggttggtcagctcatcatccaaacccgccatgaacttctcctgcttctcggcgtcggtgcggacatcctctggtgcatatcgcgcgaggcgattgaactcgtggaggtactctgtcacagtcctgttgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacacaggaccctgaagctggtgtgtggcaaaagcgaccttctcctgatcattgcactgcaggagattcagcttcttctctattgcatggagccagtcattcgcctccatggggttggtggtgctggagaaggtgggtggcctgacgcgtagaaattctggcaacttggactgagggggagggggaccaaactgctggtgctgctgttcggcgtgctgcatcatcctctggtgcatctgctggtgctgctgctgcatctgctgcatcatggctgccatcatctgagtttgatgtgccataacttgggcaagggtcggattctcgggaagtggtggcggaccattgccagaatcactgttggggtgcacaccatcagcgcgttcttcgccgttgctgccctcgcctgtcgtgcggttgccagtcctggtgtagaccatctggagggaagagcagatgggggaaaagaagaaaaacagatgctcaagaactaagctttattacaaaggaattaaaactgcaattgttctgatctgaattaaaaacacttaaaagaacaagcaaacatccttattaagacagccatatcataggcacatgatatcgaccgtcaactgaccccaaacaagcaacctaaacacacaaactaacaaccagaagctagaccatcgataaactaatgggaaaacgagcctaatgctcggaacggctcctgcggtcggtggagtcgaaggcgtcctcctgctcgtcacccggtccctctgagcgactcctggagcctgacagatcagtctcgccgctgccactgggagtagcagacaaccaacctccggtaccattggctgaacctctggcggctgatgctggagcgaaggagagagtgaacgcgggagctggaactggagctgcaggaactgcgggcggaactgaaggtgctgcgggagctgctgctggaggtgggttcctgggcgcaagctggatgcgcacaggtgcagtcgtcgtcttgcggggcatggtgcggatccggactcctcctggcgctggaagaccctttagctgagcgttctccttcttcaggcgcgctatctcgtccttcagggcgacgatcctcatgagcttcccatcgttcaaggccttggtcgccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggccgcctcctgacaggcgtgatctgctgtgcctccagatgcctcgaccgccatgttagcgaggcaagtccccacgtagccatggacctccaagcggacacggtgaggaagctcgccactgagcggcggaatcgtcgtgtactccggcgcgttgaggtagcccaccaccagtgtcatacgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagagaatcgaatagaagcgaaattttatgcatagatcattttgcatgagagcgaataaataagacagactcatataacgacaaagtaatgagaaattagatacatattaataataacaaacgaagcataaacaccttgcaacccatgttatagagctaggacctaatgcatttcacccatcaaaccccaactgactgacgaataaatcccaataattttactaaaaccctagactgactcgttttgaaaaaccccacttaaacgagcgaccaagatttttcccttgaaccacaagaacagatcccaattttcccggaacaaatccaattgcaaagagcatatgcaatgaaaaggattcagagggctcttaggtttagagggctcttaggtttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaaatgcagcggaaaacaaaaggaactggagctaagccttgactaaactgcagcgggaacaccactccacaggcatcctcgacggcacggacgaagcctactcctcggggaaaccttcatctgacacatacccgtcctctggggttgggaaaaagtagagcaagactgagtactacccactgtactcagcaagtcataccggaataggggtatgatgcagggaattaacaaagaagagctagagtggttcatttgcataaatactggcatttataaacaggaattgaatgcgaaaacggttgtaataattaagcagtattaaacatccgctgtccaacgctaacccacgttgcgacaggcccaaccatccacctaaactatccaaattcatcagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataacccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttctttcagggcatcccgcgaaccggtccttaactgccatgggtgcgaccagcaaaaccatgcacccacagcccaccatgtgattcattttaattaaccaacaccagagcggtggtactaatccaacattaccattagaaccaacagtctaaacattaatatgattttccccattgtgaactagttgaactaagcatggctaagcaattcctagtccaaactctaatcatgttataaccccaagctaacaaaggagcatggtatcaaaatagtatggctgtaacaataggtaaccatcccatagtaatattgcaaaacaaatgcgatatttgaaggaaaacattaggacatttgcaatataggatcaatatgatcaagtgacaagcatgacttgccttgctctgctgctggagggacctcggcgactatctcgaagtacaccggaacgtcggaggaatcggaatctaacgacatacaaagcaaacattgcaaacaggctataagactactgaaacagagaacaaaaccatttttaatggattctacacaatttccttgatttactgagacttgaatgggattaaacggagctcggatgaattagttatgaattttagaagattcactgtgtttattactataacaaaaatccttaaataatttattgcgcaataaattccagggctgacgtcagcacgggggtgcggcgccgacatgcggggcccaccggtcagcggcccgggagagagagaaaggggtggcggcgcgcgggcccactgtcagcggcacgggaggtggaaggggcggcggcgccacgtggcggccgaaccgacggccccgatctacccaagggtagatcggacggcggcgggagctcgcggtcggggcgcgcgggcgcggcgcaagccgaaccggcgaccatggcgccggcggcgcggcgctcacgcggcggcggcgcgcatgcggcagcggcgcaaggcgacggccgacggcgaccgaccggcggcggagagcggcggctagaggaggagcggcggctacacagctaggcggcggtgcggcggttaaacggtgcgggagagagagagaaaacgaggaggagggtctcaccgacaacggtcgacgacggcgggcgtcggaggacgatgacgacggcgggacgagctccggagcctcctaacgaacaaaaggagaggggttagagagggagggaagggcgcgagagggcgagggcgccggccgaaggcggcggccatggcgtcactcaccggcgcacgacggggttgggtctccggcggcgaacctcagcggaggaggggtggacgaggtagatctcgaccgcgcgaagctaacggcgacgacggcgcaaggcggcggcgagcctagcggcggctagcggcggccgaagtagcaaaaacggcggcggcgggtggttgcacggcgcgggagcgatggggagctcgggagaggtcggcgcaatggggaaaaagtgagagggagtgccggcgatgcttaaatagggggagagagggccggacgtggccgggagcggcgggaatcgccggccgacgcgggggagtggggaggagagagaggcgggattcggttttcgaatcccggccatctcgggcgcgggcgcgagcgggagagagaggggaatgggcgcggagggcgcggcgcacgcgcggacgtggccgacgtggcccgggggaggcggaggcgtgggcgcggcggccgttacgggtgcggcggcgcgagcgggaaaggcgggaggtgggagacgggtccgacaggtgggtcccacctgtcggcgaccccagaagggagggaggcgggcggccggctgccgggctgggcctcggcctgcggccggcccaacagagaggggggggaaaagaaaggagaaatgggccgacggcccatttgacaaaaaggaggaaaaaagaaaaagaaaaaggaaaaaggattttccctggaataaaatattgcttgctcaattttaattggttaaaattatttctagagctctgaaaattccactaaaaatcctgttaatgaattttgacatgtagaacttaagaaaaattccacatgtcaagtccgattattatttgcattactttcttagggttttctcctgatttcacctgcattttcttggggtcatttgaaaattacgattttggctagggaggaaaacttcggggtgtgacaggatcgacgtcagcgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcaatccgaccacgtcgtcaacatcttgaaccagacgaagaccatgattgcggcttcggtcccagttaactccgaaagcgtccacacgccgactggcagccgagttccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggaccgccacgacgacgaccttgacggagtagcagccttcaccgacgacctgcgtcgagtggat

SEQ ID NO: 23860 - DNA, 1988 bp, Oryza sativa
cgccgtcgtcgctccggacctcctccccattcggcgtcacctccatcggcttcgccgcgtcgtcgtcgacctcgtccgctccttcgtttcgcccgccgaccgccggagcaccgtcgccctcgtcatcccgaaccgcgccgccgctttcctccactccggccgccgttctcgtcgtcgtcgttgtcccggggtgagccgaagaccgccgttcgctttcccccttctctccgctctctcgggcgccgctccgctgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaatgggtttttaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgttcctgcctgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaaccccaactagtgggtactctattcatggttccactagtataaatttaggtggatgctttgctgaataattaggcaacattaggtggtttcataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtagtcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcccttttttggggcttgggacgagctggaacccaggtcgggttgccagttccgtccgattcatcgtaggccttgggttaaggcaggttcgtgagggtcacggccttgttttattatctgtgtagctc

SEQ ID NO: 23861 - DNA, 729 bp, Oryza sativa
gtttgtttcctgacttgtatatcaaggaaacaacttaagacttagtcggtcacgactgtatttaatctgtatctgtgtattccgttagggatatagattatcttttgtaacccggactccttcctatatataaggggggtccgggcgcctctaggggcagttgttggattttctccaaatcatacaatcaataacacactcggcggattcatccccggacaggagtagggtattacttcttttataagaaggcctgaacctgtataaatcctttgtctccaaacccatacactttcctagcttgatagccaccccttttattattgccgaaatctagtttcgacggccctgttccaccgaatcttctttctcaaaccccaaccaaacaagagtaagccatgtgtagtcggaggggccggatttcagctgaggggaactctgagccagaaatacttctcaatgcccttcaagacttcaaacaaaggatggcatgcgaactggttttatgttcagaatcctgagcctgctcttcccgaatactcttgtcttcccccggtgtaccaagatacttggaactctcttccaatcggagatgaagctgcccaagccttggaattgttggatcgcatgttaaaactcaaaaaacaaggcttgcaaggagagcagatcactcggcatttcatcaaatgccgactagcgccaattaaagaaagatcccgtacagctttt

SEQ ID NO: 23862 - DNA, 1187 bp, Oryza sativa
acactttgcaggaaaccgtccgacatagatccaactggaaaagatcctgatccggctgtgacagagccaaatttatccaaagacgctgagccgtctgccgaaaaccagccgactgccaaagccagccgactgccgaaagccagccgactggcgcccatgcttcggatgacaaagccgatccgagtgaccagccgccaactggagaccagtcggcaacagctgaaactgcaacaacacaagagcccccgactggaaaccagtcggatgtaggtcccgatgaagaaatccctgaagttgaagcgcaaacgacaacttcccaaggaccagaggctggtaaagactcaatgattgggtctctaaataaagaacaaggaccacctcatgttcagccaggaacatcctcaggtaacacatcttctcaagtgatgccgatttaaataacttcagcttactcgtctaatgtcttggaaatacatcaggaacactaggcgatgacgaagaaacaattcctcgcataaaggcggctgatgactcccgtcctcctatcttgctcaaatggtgggacgagaactcgcaagttgccggcattgttataaatcgtcaaaaagaagatgaggaagtgtgccagctgaagaaagcacttggagaagccactcgcattgtgaatgtaaatcttccgggtgactgcctttaataactttgttctctctttagcagaactgaaccatgatccatcatgcagagaatccatcttcgcaatgaggccaagactacaactttggaaaagctggttcctcatttgggaactcttgaagcagttagggaccaactgcatgaggccaaggagtatgctaaaaagacagagaaggagttaagggaccgaattgcccagctccaggattcaaacttcgagctaagtggttcatcaaaaggtaaccttccagatctattccattgatttatgctgtcataactgtatcctcaaatatttggatttcaaacagcacaagctaccaggatggcacaaatggagaaacagattgaagccttgaaaagagacaaagtagaactagctgtgcaaagggactcagccttgaaggaggttgaaggtactgccagctgacaatttgaactttcctctctttaatgcagcaaattcttattataaatgtgttttgtagaccgta

SEQ ID NO: 23863 - DNA, 978 bp, Oryza sativa
tggtggttccgcctgcacggcttgcctattaatccgccgttgttgggcgtttaagtcttatgccgccgttgttgggcgttacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgccttgtccgccgccgactggtgtttccgcctgcacggctggcctattatgccgccgttgttgggcgtctacgtcttcaccgaccggcttgcctttgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgttttcaccgaccggccgcctcgtccgcccccgaccggtgcttccgcctgcacggctgccctttatgccgccgttgttgggcgtctacgtcttcaccgaccggccgactcgtccgccgccgactggtggcttcgcctgcacgggtggcccttatgcccccgttgttgggcggttacgtcttcacc

SEQ ID NO: 23864 - DNA, 3414 bp, Oryza sativa
  unsure (1)..(3414): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacttttagaccctccactttgtcagattgcagcaaaactgatgctgcctcctgcatcatacgtcaacatcagattcttcactcatacagacaccatagaaatgtacttatgtaagaaataattcaaatgcaagtaaaatatacaatatactacatatctgatgcatatatatgataccaaagttcaaacgaatactataaatcacttatcacttaaatattcactccatcaacaaagcgaacaatctatctgtttgtattctacttgcattatcctgtataaaatattaggatagtgaataaaaccatttgcatgtccaaaatactgtacaagaatggcatttgtatgaatgcaagatgaagaatgcaacaaaaccatgttgcaatgcgcaacaggctcctttgttacattataatgccagcaaaagttgaaaaccacaaggcacattactgaaagttctaatatgtcagacacactgaccaaacagtttgtactattatacaattgaagcacttattacacatttgtcgaattcagcatatactggattaatgtgtcatctagatcatctgcataataaacctttcaccaatattatataggataaccactcagaaactctatggaccaaacaaatagcataaccatatccatcaaaagtgcaaccagagctaaatagacaaggagactgtcactcaggaaatagaaaacagaagctcgtaagtgcgacatagctacgagtaaagaagtaaccatgcataagcaaataaaactgtgattttgctggccaacatcaaaagtgcacactaggcgtagtaaacaatgccataaataaactcagcctagcagattgatgacatcatggaaaaattaatacaaaaggaaggatagtaaataaggaatacgatagcaattggcaaaaacacatgaacattcaatttcagatggcaaaatattgcagtaataactgggaatggtcttattagcacgacgaaacacaatgcaccagtacaactactacgagatttgattacataatggattcgatcaccccctaaataccagaatggctaattcagtgtactaagaaacatacgacagacatcttttgcatagcactacattcgatgaaacaatcgaaagtttcataaactatcactacaataattaatgctagtaaaatccaaccaatagatggtaactaatgcaactgcaacatgtttaacgcatcctagcagcatgaagtacaacaatattaactgaaaaactacacgaggcacaataatcgaagctggatgaactgcaacagcacgagtatatgaaaatccacgcaacatcacatgaccgagctgacacgttagataatagacgcaatatacacacccaaagtatctgtattcccccaaactccatcactagcaaattactcataatcaggactatcaacgacttcccaagccttagaaatcgttcgatccgacgagatttgaccatgagagaactcctaaaatggcataaatccgcaccactccagatgccgaccagagagaaaccgaaacctgcagagggtgaggagatcaggggaggaggagggatcggggagttgctcaccttgcgatgggcggattggatttggggacgtcggcggcggcggcgggatcgacccgacgagggttcgcgaagcgtggggaaatttgcttgcggcggctggattgtggaagaggggggaggaggatggttaggtaggggtgggttatatagctaggttggctagggcttccattccgtgttggggttggattcgaattctgtgagaggggggaggatctgttgggcctgaaaataggccggaccagggcttagtttggtggattcccacggcctgttttgcaagagaagagaagaggaatggaagtttaaagaagggagttgatggtgtgattgatcatgggagtaaacatttttagtacacatctcttgtttggttttcgcatctaattccctcacagtctcatgaattaacatgtcttccttagataagagattggtaggagtcggacgccttgattctctatcctaaaccctctcgaattctcaagtcctccaaccaaactaaactttttaagctcggttggcatgttcgttgtggtgcgaatggccggtcgcgagttcgactcgcgggacctcacctcgacgggttttttctcgtctttctttaggactgtccttcgggtagtcttgactagaaataacggtacacatatacacacgcgtgagtgttcagtgggactgtatgtttcctgtgcaccgaagcctaatgcctctaatctcaatcttagcgtgtgttagggacgcgcacgcgtgtgtgtgcgtgtgttgttgtggcgtgtgtgagtgtacactctgagttgtatcctctgtcaccaactccctcaaaccaaaccgacccctattattttgggctgtaataaggtccttcacagtacgtctagctctcgtgtgaacttttgatgcgccatctcggatatcggcggcggcgatcggccacgagggttcgcgaagcgtggtgaatcctgtggcgagcggtggtggttaaatctctctctagaagaagactcgaagcgggctgtatctgggctggtatggggtgaacttttttaattgggccgtaattattttacacacctgtacatgtgggccgagagcgcgggagtccgccagaaaaattatgccgtctcgaactcccgacgtcgccggagacgaagacgaatacgacggcgagtcggcgacgtcgacacgagatggagcccaatttctcccgagaaaacggcgcgagaaacgaggggaatctcctcctctcgtgatgcatcgcacacaacaattaacgccgctctagcaacctgggagtactcctatcaacacaaacacacaacagcaagatggagctagctaaagatgctctttgcatgcaacgatgcaagcaagaagaacactactcctgtagagtggtagtagcggcagctatacacgcctatacaagcgaatttttttaaaaaataatacgattttaatagaaaatcgcaaaaatataggt

SEQ ID NO: 23865 - DNA, 653 bp, Oryza sativa
aaaagatatctatatccctaacggaatcccagatccagattaatacagtcgtgaccgactaagtcttaagttgtttccttgatatacaagtcaggaaacaaacccaggatacacataagatattctatctatattcggtatcctatattcagtccaaatatcatcgccgtgtagatatgggatatccataatctccacatgtacgattccattggagacgtacgtcgccgccgaagctaggtatccactttagcaaaaggaatcagattccggccgggcacacgggaactattaatttctccggctgctcgatctctcatcgtgtcgaaacatgaattcggcaataataaaacggggtagcgcacgagacctaaaagtggatggatgcagagacaaaggatttagacaggttcaggccctctcaatgagaggtaataccctactcctgtttggggatttgaatccgccgagtgtgtattgatctgacgatcaggttgtgtctcatgccccctagagggcttcctgcccaccttatataggatggggggcaggattacaagatagaaaccttaaccaatacggtatcggtttcctaaatctactttacaatcttatcaaaccagaactttaggccgttccataatatataggga

SEQ ID NO: 23866 - DNA, 1878 bp, Oryza sativa
ttgaagatgtctcggagaggttggtttcgtcgctgccgtcaaggtttgcctgtggaatggagtcgcccgctgcaggagtcaagtcttcaggcttagctcgcttgtatcttttccgctgcatttgtaatcttttatatttttgtaaggcgtgggtctgtatgtcaacaattgtcgtttgtgtaccctggctggtcctggacaggggtttaatacacattcagcttagaaattctggttcgtgaatttctgggcgtgacaagttggtatcagagccgaccttgaccgtaggacaagccaaatgaaaaaacctaagagccctctgaatccttttcattgcatatgttctttgcaattggatttgttccgggaaaattgggatctgttcttgtggttcaagggaaaaatcttggtcgctcgtttaagtggggtttttcaaaacaagtcagtctagggttttagtaaaattattgggatttattcgtcagacagttggggtttgatgggtgaaatgcattaggtcctagctctataacatgggttgcaaggtgtttatgcttcgtttgttattattaatatgtatctaatttctcattattttgtcgttatgtgagtctgtcttatttattcgctctcatgcaaaatgatctatgcataaaatttcgcttttattcgtttcccttatttgagtcttttattgctttatttaaatttggatttgagcatgcattgattcctatccctctgtactctttagatgtcagacctattctccgatcgcaagcgccgctccaagcttcagagtcgccacccttagctttatcgtcttcttagtctgtttgcgtgctagtttttgtgtttaggtttgttgcttgtgggttagtcggcggtcgatatcatgtgtgagtggtatgacagcctttattaggagttgtgtgcctctttttcagtgttttaatcaagattaagataatggcacttaatcttataagaaagattagtttccgagccgtctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgataacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaaaaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacctgcacgagttcaaccgccttgcgcgctacgctcctgaggacgtgcgctccgataccgagaagcaggagaagtttttgtttgggctcgatgatgaattggccaaccagctaatctccggagtctatgaggactttgagaagctcgtggacaaggctatgcgccaggaagagcaacgcaacaaaatgtaccgaaaaagaacggcagctcagatcagttttcctcaagggaacaatcagaagcctcgcttcatgacgg

SEQ ID NO: 23867 - DNA, 2499 bp, Oryza sativa
tccacccccactaatggcaccagctcagtcaggtccgccagctgtgtcagctcagtcagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagttccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggtagtggacccatcaaatgtggaatcagttacaaagtggaccccaccaaagacagtttctcagatccggagttttcttggacttgcgggctattaccgtcggttcatcgaaaatttctctaagattgccaggcccatgacacagttgctaaagaaagatgaaaaattcaaatggtcagctgagtgcaaccaaagttttgaagaactcaagaagaagttagtctctgcaccagttctaattctgccagatcagacaaaagacttccaggtctactgtgatgcatctcgccaaggattgggatgtgtgttgatgcaagaaggcagagtggttgcatatgcttcgcgacagttgcgtccacatgaggccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagctgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcccggcctacgtgtcacgtcctgataaattcatcccgaaataaaaatcattctctaaaaggaataatagaattaattaaaattcgaaaagaaattagcaaacactaaaatacgtacaagaaaaattcaaatgtagcccggagaatttttgttaaattctccttggtctaaaaagagccctcaaattttagtggaattttcagagcacaaataataattgagaagaaataaacaaagttgaaaaggtttataaaaagaaaaatctctaaaagtcttcttttccccccccttcctctcttgggccggatcggcccaactctccctccctctctctcctctccccggagcccataggccctctccccgcgcgc

SEQ ID NO: 23868 - DNA, 709 bp, Oryza sativa
ctctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacac

SEQ ID NO: 23869 - DNA, 453 bp, Oryza sativa
gacagccaacaagcagattccggcagcctgcaagttactccaaaacctgggaagaagatttagaatgtcaaatcaatagaccgaatgctatgttatcaaacccatgagtgatttgttgtgtccatgaaattgaatgagcatgcctcccatttccagacaagcaaatacataatcaactattccttttagactaaccacgcataatcacaaagtggatgtgactagagtttatcaaaagactactagagtctgccttttaccttgaaggaagtgagacagctttctctggtgtcatgtacagaacatcgaatgcgcctttttcagcctgaccgctaacagagatgtctgtttgggtgctgccaacgtattcacacttcacgccatgctgctttaagctcatgacctatttgaagtagataagacccacgattatgttttcttgtaaaaacaatc

SEQ ID NO: 23870 - DNA, 40990 bp, Oryza sativa
  unsure (1)..(40990): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatacatcgtacattcatgcgacaacgcccttgctataactcacaagtcccttgtacacagttggaggtggtgtggtggatttatataaattccccatcaatcaccaacgcaagagagagaaaaaaaagaatccacatcaatcggtgctgcttaaaagtgatggttaaacaaatcttgacatactcgtatactacaggccacaaagtaaatgaatgaatggataaaaatggctcagaatacgattgcctgtcacgattgcaatcttagaatactatattgtgcactattgaccagtgaaacaaatgtattttttcggtatgaatatgagatctttcgatggttaaattaaaagcaaattcagcacaacttaaatgcctttctagaaaaatattgcgcaaaaatggtaaattagtgcaaaagcctgcaggcgttgattttatctcggacggatgcgctggtagttcagttttcatacgaagttattgctcctctcccttatcatctcgcatgcaaggcttcgccttattctccacagcaaaggcagggcagtgaataattttctagtagcatgtcattttactcctccttggtactgctgtcaagaacaaatacatcgatcaaatctgaatggggtagtatatttaattagtaaaacaaattgcattgtgttatttttgtgaggattttgcacggtatactgtaaccgcaatttaaggtattatcacttgctaatacatctactataaggtgacttgcttttttcttaaaagaaacaactaaaaattgcaagaaagcacggagacattggggagccgttaagcttcagcgataggatttcttttactgcttctcaaattgttccaccaacggcttggaggagtaggcagtttttttttttcgaacaaagagtggttggaaaatctacatcgggttgtgttctgggttttgcttttgccaagacaaaattccggaatccaccactgcctttgcgtgagttgtgaccgtgcgtaaaaagcgtagtaaaaaacatcaagagacaaaagcaaatggagtgtcatggtggtgtctagtccgaagaccacggggtaatctcttgtccctgcaaaagaagagggtaaaaggaaagctgcagcaaagctactccatgaccgttgcgctagtcgctgctcctgcgccgaaatggatcgctcaccacgctgcgcggcgtatggctgcaaattatagtagtagtaagcagccaaatagaaaaaacatagcagtaagattttgaaagaaatataaatataaatcagagggttacaaacacacaaaaaaaaacatatgatagtttaattagactacaggaaaaacatagaaatcagatgataaatatacacttaaaggaattttttcaagacattaggacctgttgctaaatttcctctaaaatttctataggaattttatattccatagaaactttaaaggataagataagatttaatcctttgttttaaagtcttcgtagaaattttttttataggattaaagtcctccaaaatttttatattttccctataaattaaaagggtcgtaaaccttcagccaatcttatgtaatgtaaccatcacatgtaacatgattctgaatgttcagattatgatttaaccaagccatttcatgttcatctcgatcgatcggccaaaactgctctttttgtttagctttggaactaatcattgtctcctacacctccttgtggcccacggccactagaggggagcaccattaggacaagtgtgggccactagaggggagcaccattaggacaagtgttatggtagatgtgactaccacatctaaatttatccacatcacactcataaattaagaggcaacttatacaatatgtcttctctagtatataaataccaatgtctcttatactctcacacccctcttgaaatttgtgtggaggttgtctcttcatttaggggtggttcaccatctctctcctcacttctctcctccacctcatcactcaatccaatgtggcatatttaggggtaacatatagagcattatagtacttgctcttataagggcctgtttggtacagctccaactcctaaatttagctctaggagttgggtctggagtggagttgtggagctgcctaaacccagctccacaattctagttcattttgtgagagagcttcacccaactctactcccagttttggtggagctgaaactatttagctgagctccagctccaggaggggtaaagctgaagttggagctgtgccaaacaggccctaagcctgcatctccatgatgctccaatccggtactctagatagtagcggtattattatctttctgtgcccataatactactagtacatgcacacatcatgatgatggatcacgccatcatgggacgaccatttattttcgatggcatccaactaaacaacgctcgttcgtgcagtacgaattagagcaggtacaatagctaagccacctgtaaatatattttaaggagattaataagaagagataaaaatagcggactacagatttttagctagctgtagcacggactctaagacgcagtgtgtgtatgacaggtgggactaaatattaatagtgtagtatgtaactattgtattgatgaactattagattgattatagatgaattagagctagtagttggctatactacgaagcttgctcttagtagttagtagtaagtggaggcaatgagagcagggttgggcaggcctgtctacgtgatgacctttttaattcattgatagaacatacagagactgtaattgcctctcccttttgcccatgatatctgcatccaacgcatcccatgaccgtgtagttgggtttaaccgttgcatcttgagataagaaaatcctcagtcacactctaaaataattttgcatgctcgcactcgactaatgcatgaaactctgattcattgccattgttacagacttacagataggacaattactttttttttcatatggcctatgtggagtttagaaaagaaaaacaaagatagattatgtgtctcaaaaacatgtgactttcaattcaacttatacaaagttgtaacaaaataaactatgaatgtgtatattagttttagtttaatttatatttgatattgcatatttatacactggtataatttgtattaatttatcttgttatttttataattattgagatgacatgagaagacgagaggacgttctctccacgaataaaaactctttacctgtttatgaagatgctgcatgtggattgtggaccatgcggggttgccctaattgagagcatctctgttcctaattgttgcggttattcggagctggtccttcgtcttgaacacagtcgccaactcgccatgattcaacgggaaaaaaaatggggccgagaggtctcagagctgcctgcgacgattcaccactttcagggagcatccagctctcctgtagcaccgaaaacacacacaggccattctttctactgacagtatgtactctaggcctaccgttcaattcgtatactactacgagtacgttgaagctactcccacagtctcccacattcacactctcgctaccctcatactgtactacagtatgagcttgtactccctccgtttcaaaacgtttgacaccgttgactttttaagtacatgtttgaccgttcgtcttattcaaaaaaatttatgaaatatgtaaaaatatatgtgcacatgaaagtatatttaacaatgaatcaaatgatatgaaaagaataaataattacttaatttttttttaataagacgaatggtcaaacacatactaaaaagtcaatggtgtcaaacattttaaaacggagggagtatataagagctgacaccggtgggaacggaggaagcttgacacttcactaccggttctctcgaaccataggattctcgctaaaccctccttaaaacatacttcttccgtttcaaaatgtttgacgccattgattttttagcatatgtttgaccgtttgtcttattcaaaaaatttaagtaattattaatccttttcctatcatttgattcattgttaaatatatttttatgtaggcatataattttacatattttacaaaagtttttgaataagacaaacgattaaacatgtgctaaaaagtcaacggtgtcaaatattttgaaatggagggagtatatactatatctatgaaaaaaaggttgaagctttggcctggtttagttggtaaaattctttgctcctgcgtgtcacatcagatatacggatacatatttgaaatattaaatgtagtctaataacaaaataaattacaaattccgttaggaaattttgagacgaatttattaagcctaattaatatgtcattagcaaatgtttattgtagcaccacattgttaaatcatgacacaattaggcttaaaagattcgtcttgatatttacacgcaaattgtgtaattgatttttttcatatttaatcctccatgtatgtgtccaaacatttgatatgataggtgaagtttttgttttggtaactaaacagctcctttatctctatgttcagccatatactactatttattgctagatttgcctctaacaggtgattatattcacaactaattaaacattttgtacgaggtaaatgcttaaacatttatatacatatagtacttcttccgtcctaaaataacgaattttgacagttcttcagattcgttattctaagatgagatttagtccatctttcttgctatcactatattttggaacgaagttatcatattgtggtccttgctgtatgtactggcaaggtttaccgcacgattatcgtggttatcacgtgtgataactttcttaaattttaacattacgatatatctcgcggtaaccgtacggtttttacaataaccacgtagttatcgcaataaccgttaaactatgggacgatggtaaccacccaaaaatagtttggggagccctgtgtgcaggtcacttggtcagagcaataataattactccaactctggatggaaacaagaggttacagtatagatcatcgtcgcacagttaaggctggacccatcaaccatatgcacgcaccatatatagctgcagcactcaacgcgattattccaaatggacccttgtttcggaccgttgccgatggtagcgaaccgccattttgcgctggctctgagggcctgacgacgtcagagttagggcttccctgggtgcgtttgggccttcaattaccgtacacgataccattaagcccaatattgtttggcccatcaactgctcagcccagagccccaaagaaagccaccaactagacgaagaaggaacaccagcactctttaccatttctaaaaataagcatttctagaattcaaaattgtactactacgatatatataagtatttctaaggtattgattccaatacatgaaaatttgtacattttcaaccaatgaaatgcttgggaaagtaatctaaacgattcaaagtttaaaatttgaccactgaaatgactttagaagatcttttttcaatgcattagtttttactaaaagaccaatctagaaattcctttattttggaaaaggagagcagtacacaaccaattaggtggcctgatcgatgaactcagaaagcctgtcgtggatactattcacttttaaactttgttcgctcgtcttttttacaaaatatttacaaagacaaaaggattccacattatttaaacatattatgtcctaatataaacatgaaactttaactcaatttagtctaacaattttgtagtgcaatgttaaaggcaaaatagtcggttatttgaaaatgtgaaacggatggagtacaatccccagcaagaaggaacatacatatgcttacaaagcctcatcaacagaagtgaacattgctatgctcgtggaatcctcaactcaaatcttgtttaggtgtagaatgctcttccggtctctttattaaggactattgtctgaacaacagtatttacaagcttttaacatataggagtatctcgctgaaaaacaaaaaaacatgtaggagtagagtaagaacaagaccagaagctcataattatgactagaggccaatgaggtgttaattctggggagatcctaatctgtcctgcaagtttcagcaaagagaaaaagaggatatgcaaaaatcttgtcgtttcagaaacataagctatactgaatttttttttatcttctgggcacaaagggtagctccaagcctaccactctgtcaagatggcgaccaccgatactgctgccagctcccagttaagcttgctgcaatttcagatatcagcatgctccacaggacgatgttgattcggtgtttcttgattctccaggggcatgtactgagccatgatcgcacgaatctctgaatccatgtaactctggtttggcatgatggtaacacaaagtatgagttagccgtagattattgcaaacataagaagaactagaaaattacgtgatcattcggagatggattagaatagaaggatgagttgtttacccgtagccgatatttgtatacggcatatgctccaattccagccaaagcgaggccaaagaaaataacccaaaggaagccccagcccactgacgaagaagcaactttgcctgcacagtgattgcgaaaggcgtcacataaaacgttctaaagcgaatgaaattatgtgtgcatcaaagttccactcctgttttgcatcaaatcaacataacataacatacaacattttgaatgaggcatgaaagaattgtgatatctttcaaaaggaatttggttgtgatagtccgttatcaaacatgacaatgatccagatcatggcgcagtcaagcagacttgcattgcatattttcaagccgccagcagatggactatcgcaaaagcaaaactaggaacatctgaaatttctacagaagtttcaaggctgagtaacaagggatgatacaagtgtatgttgggataacaatctcagaacatgatcacaaggtccagaatgccgataagtagaaaattgaacaatataagactacaagggaacaaaaaaaaaggttaggggactcactgatgcaagtgtcatgctctctcatgtataacatattacttccaccacagctgcactcatagcttccccatgtattctcacaagagcagtccttgcactggcagaaaagcttgtctttgcattcatcaatatctgaaaacgccaaccagagatatgttaagtaatcacctaacagtttcaaactattcagggtttgccagtactagtttgtatgggttttacaagatggttggctcaagcagaaatatcaatctttctatatttaaaaggaaagttttgccacatggagtaatattaccttcacaactttttataccatcacccttgaaacctggtgggcatttgcagcctttagattcttcattctgtagagttccatgattagttctgacctcatagaacagccgcaaactagaagacctctggaagagattcttactgagcaggcagaaaccgtcttcccatttttagtttccttccagcagcctccgttgttgatttggcacctaccgacaccagaagctgccaaagggccagccgtaaaccaaacaatgtaatactaatagttgaaataataaaacaattaggatgtgttatgcatagcacagtctatagcaaggaaacagtattgtttcaaacaaatgaaaaaatgattccaaagaaataaatgctgccaacccatcttgacgaaataaaatgcaaatgtgtaccttcacagtgagtgtacccgtcaccaacgaacttcacaccacgggcaatagggcattcacaaactcgcccacggaaggtgtcctacaatatgtaacacagcaaataagaatgtgcacctcaaactgaatagaggtgaatgtcgtaaccagtatcagattatcaataggtagtactacctccgtttcaggttataaaacgttttgactttggtcaatgtcaaactgctttaattttaaccaagtttataaaaaaaagtagtaacattttctattaggaatgtatagccatatatgtataggattcttttgtatccttagtttccttgtatactcctctaattgaggaccctgtatattggaaaggctataatatatggtcaccccccctctttggggagtgtggtgttccctcctattctctctacatggtatcagatttcaggttctactccttccttccgcacccctgatctcccctctgtgttgcgccttgcgccggcgacgtcccctgctggtcgccgccctcctcgtcgccatgtcgacgtcttctgccacctctgctgcgaccgacaactccacagcatcggcctccaccaactccgtcgcgaccgtcttcgtcaacccgtacgcgaccatctccgtcaagactcatgtcccgatctccctcgagcttcgcaaccccaacttcaacaagtggaagaccttcttccgctcgatgtgcggcaagttcggcctcctcgaccacctcgacgactccgcacctcctgcagcccccgacacctcatgggagcaagccgacttctgcatccgcagctggctattcgggtcggtcaccgacgacgtccttgacctcgccatggaaccggatcagacggctcgcgccctttggctcgccatcggcgacctctttcaagcgaacaaggaaccacgtgcaatctttcttcatcatgagttccgctccatgatccaaggcgatctctccatcactgcctactgccagcgcatgaagacggcagccgatgcccttcgcgacgtcgggcaccccgtcacggagtcgcagctggttctcaaccttctgcgcggcgtcaactccaacttcaccagtacggcggacaacatcgcaagtgctcctgtcctcccgtctttcgcttctgcgcggaacacccttgttctcaaggaactccgtctggccaacgacgccaaagttcagacagagaccgcccttgtcgcggcaagcagcgctgctgcctcttgcccctcgggctcctgctcctccactggaggtggcggcaagggtggaaacaagaagaagaatggcggccgcaactacaaccgcaatggcggcggtaacaacagcggcaacaacagcggcagcggtggtggaaatcgtcaaggcggcggcggcggcaccttctcctttgctgtcccgcgccccccaactggaccatgggtctgtgtctcccaatgggccggccagcagcagcagcagcagtggcgcgcccccggcatcctcgggccttttcctcaagcccacaccgcctttgccggcccgtactcgtcgccgaccacctctgcagcgcaaccggcctgggatcaggctagactggtggctgccctcaaccagatgacggtccacagccccaattcttgggtcctcgacaccggcgcgacctcgcacatgtcatccaccgatggtatactcgttacccgcttacccaactctcacacctatattactgtcggcaatggtcacactattccggttttatgtcgtggctcttcctttctacctataggcaccaccaaatttgatctcaaacatgtccttgttgctccttccttggttcgcaatcttctttccgttcgccaattcactcgtgacaaccattgttctattgaatttgatgagtttggtttttctgtcaaggacctccggacccggcgcgtgattcttcgctgcaatagtcatggcgatctctacaccctaccggcagccgcaccacccatcgccgcccactgcttccacgccacctccaccaccatttggcatcgccgccttggccatcccggatctgcagccatcctcgctctatagcgcctctctgccataccctcgtcaaagccagatagttccctttgtcatgcatgtcaattaggcaaacatacccgtcttccctttactagatcaagctccagtacttcctctccttttgaattagttcattgcgatgtatggacatctcctgttttgagtacctctggctacaaattttatttggttattctcgatgacttcagtcatttttgttggacattccctcttcatcataagtctgatgttcaccagcacattgtggattttgttgcatatacacacacacagtttggtcgccatttgaaatgcatacaggcagacaatggcgctgagttcgtcaaccgcagcaccacctccttccttgctagccgcggctgcctgctccgcctttcctgcccatacacatccccgcaaaatggcaaagccgagcgtgtacttcgcaccattaacaactcagtccgcacccttctcctgcaagcctccatgcctcctgcctattgggccgaaggtttagccacagccacatatctcctaaaccgacgtccttcctcatccatacagaactccatcccattccagctcctccacaataaaatcccggactactccctattgcgtgtgtttggatgtctttgctaccctaaccttagtgccaccgctagccacaaactcgcccctcgctctgccgcatgcgttttcttaggctatcccacctcacacaaaggttaccgctgcttcgacctctccactcgccgcatcatcatttctcgccatgttgtcttcgatgagacttgttttccgtttgctcgtcacccggtcgatgtctcttcgtttgattttctgctacaggaagtgactactcccaccgtggtcgctccacccgtcacgggtgtcgagcaaccgcggccctccctgccccgcgccacggatgacccggtgcggtcgtctttggtggctgctccctcggctgaggtcgagcagccgcttcttccctacacgatggtggtcccggctgctgggttggcttggccggctgctggggacccagtgcccacgacccggacggccaccgggcctcttcttccaactacggcacggctggtcgagcccttcccgcacgtctatcgacgacgacaggccacgccaccaccgcgcctcgacgctgcaccggcacctcccctagtcgtgccgcccccgccaagccgcatggtcacgcgctcccagaccggctccctcaggcctgtcgaccgcctcatcctggcggcttcccactccgctatctccccggttctgaccaactaccgcagcgcgctcgccgatcccaactggcgtgctgccatggcggatgagtacaaggccttgatcgacaacggcacttggcgcttggtgccccgccccccgggtgctaacatcgtcatgggcaagtggatcttcaagcacagtttcactccgacggctctctcgctcggtacaaagcttgttgggtggttcgcggctactcccaacaacacggcatcgactacgacgagaccttcagccccatcgtcaagccgtccacgatccgagtcgtcctcagcattgcgacctcacgatcatggcccatccaccagctcgatgccaagaacgccttccttcatggcacgttggacgagacggtgtactgccagcagccctccggctttgtcgacccggccgcgcccgacgccgtttgtcttcttcagcgttctctctatggcttaaagcaagcccctcgcgcatggtaccagcggttcgccacctacatccgtcagctcggatttgttgcctcgacctccgacacgtccctctttgtctacaaggatcgagaccgcatcgcctacctcctgctctacgtcgacgacatcatcctcactgcctcctccacggatctacttcgcctcatcaccactcggctgcactccgagtttgccatgacggacctcggcgacttgcacttcttcctcggcatctccgtccggcgctcctcagacggcctcttcctgtcccagcgacagtacgccattgatcttcttcagcgagccggcatgtctgaatgccaccccaccgccaccccagttgacgctcgggccaagctctccgcctccgatggcgcccccgtcaaggatccgaccgagtacaggagccttgcaggagctttacagtacctcactctcactcggccggagctcgcctatgctgtccagcaagtctgcctcttcatgcatgatccacgggagccccaccttgccttggtcacgcgcattctgcgctacgtcaaaggctctctctccgccggactccacatcggcaccgggcctgtcaagtctctgacggcttactctgatgctgactgggccggctgtcctgactcacgacgctccacctccggctactgcgttttcctcggcgacaatctgatctcttggtcttccaagcgtcagacgactgtctctcggtctagtgcggaggctgagtaccgcgctgttgcccacgccgtcgccgaatgctgctggcttcgccagcttctccaggagcttcatgcccccatcgcctctgcgaccgttgtttactgtgacaacgtcagcgctgtctacatgacggccaatccagtgcatcaccgtcgcacgaagcacatcgagatcgacattcacttcgttcgggagaaggtggctctcggacaggtctgtgtgctccatgtaccgtcgtcccatcagttcgtcgatatcatgaccaaggggctgcctgtgcagttgttcactgatttcaggtccagtccttgcgttcgtgatcctcccgttgcgactgcaggcgggtattaggaatgtatagccatatatgtataggattcttttgtatccttagtttccttgtatactcctctaattgaggatcctgtatattggaaaggctataatatatggtcaccccccctctttggggagtgtggtgttccctcctattctctctacattttcaacccaaaacaaatttattatcaaaatatattaaattattgatttgatgacactaatttagtattataaatattactatatttgtctataaacttagtcaaacttgaaacagtttgactttgtccaaagttaaaacgtcttataacctgaaacggatggagtagcatttttccattaaaattttataccttgcacgcagtaaaattattagtcttgtcctgccagcaccctccattgctctccaaacattcatttgtttggatctctataaacgagagagcaaggtaataaaaggagagaaaaatcagtacagcatcgatcaaaatcagtaaacttcataaaatgaaacataaaaatttacaaaccttgactcaaacaaacatcaggttcagttgtctcctcaaatcctgagcatactgcttttaacacagcacttttctccagcttacctaaagagagactattatatgacataacaggctacagcatcgagctaaagaaaaattgcgcaatagatactactagtgcacctctgtactgcttgttgttaacgacaagggtcggcaatatagtgacatctcctcgagagccttgaccaatctgaaaggacaaaatccacaaagatcaacctaccacagaactattgaataatttatgaatgaacagactctacataacaaaaacattatgattagtaatcaatagtctttacttgagcatcttgttccgctttaagcacgggattttcttcatcagcttcagggtctcccacacacttgttgatcctctcaaggtccaatcctgtgaaatgacatatcaaatggttcaaatcaaccatttggttcaaacaataaagcaattatgctgaacaaagttaactacaccaaccaagtgacttgataacaccattagcgcattcacgcgtgtatttcttctccttcattgggcacctaattgaaaaatcgtgtacataatcccaccacacccatggtttgtgagtttcattgccaaccttgaacaagcaaatctgaatcaggttctgaagcacaacatcttttccatcatatccaatgttgaaatcctgctctggatctggagcgcagtatctcccatgattgatacactgagatctgcactgcttgctcaggacaaaagcttccggacaataccatgtaatgtagtgaggggtgaactgagtgtaaccccttttctcaagaacctgtgctgttcctctgaagttcctcacaaaattcatttgcatgtcacatttggcaccacattcatcgttgctgtttgtccagaattcatactctacacgctcatcaggatgagggagagattccctccaatccagaaggacattgaccatatcaccgttttccagtgctttcttaaggtcgtccccaaacttcttcgttacaagtgctgaaggaacagtaattttctctatgtaatctgtgccactagactctggagagtccattgttatcaaaggctccaatctatcatcggcaacaagaacagctgcagctccagcggtttgagcattccatccctttgttgtgaagtagcagtctgcacatcacaaagaattaaagatccccactttgaacaataaaatctgctttaacagttacattacgcctaagaaacaggagaaaagaagttacagccaaacatacaaatggcatgactacattatttttatggaacacaaagatactgatatttcttcttccataaaatgtaattaccaacaaataatgcagagttgagaactttcacctcctgtttaacctaatattcagaatgaaatccactaggctggttcacatatttatactgatggccatatatacagttctatgtatagtgtccatttctagctctaaatcgccttctatgtgcagcttttctaccaataaaactgtagccaaagcagtgacataagttgtagagcaagacctttgaaattgcaaagaaagaaaataaatcctttttgaaatagcagtagccgcaaaagctaaataatttggacagtcaaagcacatgattttattccctgactcactcaaaaagcacaacaactaaacgtaagcgtgcacaatctttctctaaacaagatttgaccatggaacccagctacttacccaaaattccaacaaaccatgtaccgaacttacaagcagatagagaactgcactatatgccaactaccaaatcaggtaccctactaattaggacaaaattgcatatgaaatgacaaatagcgtgtatcgaattatcctagttaaggaaaaatccatgataaaccattagacaataaaaaagaactaaagcagcttgtaatgacagtgcacccctctgccaaacttattcactgacagaatatggctacagagtacaaaatgaatcgttttccttaaatggactgcagagtacatagacttccaagttccaaatcattttgtttgggttaggagttaagagtagaacaattcaagaacatgttgttattaacattaggtgcaaactttcagtcaaaagaaaaaaaaacattaggtgcaaactgctagttaggacaaaatgagaaaaaaaatgcgagtaacattattaaatttctcatatcctagaactagaagtgactgttagctaggaccacattcaataaataaaataaattaaaagatgcgatatttaaaatcactcacgagagggaaaataaatctcccccaataataaataaaaactgaaacgggttcgaataaatcaagaaagggggaggacctccgcgatcgacgaggaggaagatggggaggccgccgggcttgggcttgaaggagaggtcaagtcgtcgaaggacctgcagcttcttgttggccttggggtagacgacgaccccgtgcatggtgccccgtactgcggcatcccgaagttgccgatggcgcactcgtagacgccccggagccccgccggcgacgtcacccgcaggctgttcttctccaccacgaacctccccgccgcctcccccgccatggacgccaccaccacgagcagcacggcacaccccatcatcgtcatcttctcccaattaatcctcggcaaaagaggattggggatcaaagaaaagatgggttcttggatcgagctaacgatcgatcgatcagaaatcgcggtttgggtggcgtggtggcttggtagggagaaaaggcgaggcgaggctttcgcgggagcaggagtgcaataaaggaagcctgccctacgaaggatttgaccgggagctatcggtatcgctattgctaatttgctaggattgctaaagctagcggagtgagatgagatccggagatagagatgtactccctccatccaaaatatttgacgccattgactttttaaaaaatgtttgaccgttagtcttattcaaaaaatttaagtaattattaattctattccaatcatttgatttattgttaaatatacttttatgtatatatatagatttacatatttcaaaaaaaaatttaaataagataaacggttaaatttgtttaaaaaaatcaacggcattaaacatttagggaagtagggagtatgtacgtggcgagtgctcgtgggcattggggttggaagttggaacgcttccaatgcagatgtgtcactgtacatgttctattctcttcttgctcgtctcgtcttttctttgcttttgcgtctcgtgttcgtgagcgtgagtatcgatatcgtgagggctcggcgaccgggcgcctttatgctagaaaattgacgcgccttatggcgcgataagcatctaacccgtatacattttatagaacacatgtaaaaaaatatataaaaaaattaaaaatatatttttacaacatatatatttgtattgctaagatggctcgaaaaaggttatcattttcgctctagatggtagaaatttccacattagtcactaagaaataaaaaagatttggaccattagattcaaaacaaaaaactagcagttgtatatgagatccaatcatattttaaaaatcttttgattagaaaatacaattttattttaaaaatagaatttatattgaatatagttctacttttaaaatttagcatcatgcaatttacagaacaatccgctagtttttaataaaacatgaagtaaatcatattattatggaatccttcaaattccactatttttcatccaaactgtttaaggctcctttgtttgtgtaaaattataattgaattgtctactgaactaaattatataatacatgattttttgaacacttggaaaaaaatatatctcaaatgtgatacaaatcacgaatctatcgttagcgcccatatttctaaccacattatttatattttagaccgggccatatattttgttgtcttttcctttttatggccataccggtgaactctgtcaaccaaatctgcatccaaccagcctgcaagtagtaatacactcacttatgtttcttctagaaatcaccagggtcctctcaaaaataaaaatcatcgcatggattgatccactggacttttctggattttttttctcaccaaatagatacgtgtcaaataattagaggggaactaatcagctgacaataaagattatatagagagagataggaaggatcacctctctatgtttctcaaagagaggtaaatttctagaaattgtaccagattgacacgtggcaatttttggagatggttagctaattttttcaggctgccaggtggcccaataatatgccacgatcagcaccctgcaatcgatatgtaagatatcattaatctggaaaagctgtctgtccaaatatatactttattttaatttttatgtaggattgtggatttatgtccaacgcttacgtccatttaattaaaaaaattattaatatttttatacagttattagatgaataatattttatatatggcttatttttctaatttttttatgattttaataaataagacggataattaaactttagaaataagatctacgatagttacggatagatagattcggggatagcctagatgagtcaatggctcgccgtgtagtacgaggataaacctttttagatggtcaacggcaggtgcagcgacagcacgatcgccatccgacggtaagtgtcaggcaatccaggtgcccaattttcagcatccaaggtgccaattttttcagccttttttccaccacttaccggagactaattggcgtcaataaatgaagacagtaacagataaaacgacgccaagacgataaaacagtaaatggttcgatactcaggagctagatatgatatatatccatcgatggatcaattcatatgaaggcagtcagcacgcatacggcagtctgaaagcatgcatctacgacaaacaatcatcaggaccacgaatttatatcactgctaaaccaagaaaaaggtttcgctgagatgagaaaaaaccaagaaaaaggtttcgctgagatgagaaataactcaatataatcatcattcccctcctggggtttacatgcaagagaaacctacattaaaatcaaacaagggaacatgactgtcttttatattatttgcagggtcatccaagttctcttcactcagaaatcatcccggaaacgtaaatgtatcaaaagttgcagccttccatatgcctgcagacttatgcctctggttcgggtttctcaaagaaagttttcttaatccagtcaaatggctgcacaagaaatcaaaagaatattcagaaccggaaagatcatcacatttaagaatttaattgttcacaacaaaaaggtagaagacaacacattaactgcaaaactataacttcaacacagatcaaagttaagagcggaaatcccagattatgtatcttgtaaccagttgtgtaactcaagttacatgttaacaggtagagtaaccccatacataacagatcacataggtataaacgaatattctattcgcatgtttcaacaatgcagcaaaggcctcccagattctaatcacaagaggctaaaggaaagtaaggaacaaagttttattcgctacaaggagcaaagtgcaggtttcagcccaacggaattccacgtcttaggcttaaaaaactaggaacatattccatgaaccataatgaacaagttatatcatgtgctgaagctctctcagataaagaaataaagcacccagacagaaaactgtgttggaacccaagacagtgctaacaggccatgtagggtacatttagctacacaagttagtcacacagcaaggaatcaaatctcagtaaaagtaatcaggaatagtgtagtacataagtcggtcaattaaaattcaataaccggtttgcacagaggtcttgaaagagcaattgctggggaaagctcacccaaaaacatagactcttgccttgcccaagggccatatcacaaagtacaggtaaaaataaattgactgatccaaaatggcgaatttgtttggctgtatctaggggctcctatggtgagtttatgggcatatattggttatgttgaactgtcaaagattttatcagatattcctcctaggagagaacaggaaattatacatcttcactacaaaaaagcccatcagggtaaagcaaatcaaggtagtgagcagaaaactagcaggatctcgtgaaagcaaaattatattacacaactacgataactaaaagtttattatgttatccatcaaatgttgcaaaattcaaataatgggatgtatacttgcattagttaccgaattgtacaatgtaccgagtttaactgtcaatcaaagtttgtgtttttgctaaactttcttctaatatatgcctattaatcatcaggcaaaatatttaatggtatgaatatcatcacaaagttatataaggcatggtagacacagccaaacagcaattcctgtagataaagttgtggccttagtctccacagaatcatttcttcttcccccatcaatttctctatcagatcaagcggcaaatttgactgcaacctacaaaccatatacgtaatccgtgtaacgcgcagaaatcataaggtagcaaatcgaacagaggagccctacgaccgatccaacacgccacgcagatctagggaccgacaacatgccaaacaaacatgacagatcctacctacaaaaaccaaaccctaacgtcgatggggcaaaacatatctacggatcaagacatccctacaagctggggggggggggtataaaaaggcgtcgtggatcgaaccccctgacctggacgaggtagatggcggcggtgccggcgaagacgccccaggtggcggcggcggcgatgtcggtggactgggggcggcgccgtggagagatgaagcggaagaggccggagctcgacgccgggagagccatcgccgccgcaaatctcgtcgcgtcgactcgacctagggcaaggtaaggaggaggaatgcgagaggaaggagacgcaagggttgcggaattttgttgcttgttctcatccttcttccgcgtgtatatgggcctaagtgggccgacgggctgaagagctcgtggtagatgggccggatacactatgggcctgaaacagtacgggcctaaaggccttaggtggtgggttcatctggccttattgggggacagaataacttttcttcatttattaaggcaaattttgttcagtttttctctgaaaaagtaactgtaggtaaattttttttttttgagaattatacggtacaacgcagacactcacaacgcacgcacactcacccctatgaacgcacgcactcaaattctacccttatgagcatcttcgaagactaggccggcaaatccatcttggagattgacgaagtcaccacagacgcctcgctgtcgacggatacgtcgcctaccactgaaagcacaaattaaagccgttaaatcctggaaagacctaaggttctactgaggctcttataagcactagactacaggctctttcgcaactgtaggtaaattattgtgtccaattggattataaaaagtaggaaaagttgctgcactctcagataaacataatcaaattaatacaggttctaattgagcaccaacttgctatatgaaaactgaacttcttcgcttgccgtcttaaaatgtgttgccttttggaattgagtatatatatcacgacaatacagtatgaattagctttacaacaattctccttacaagttgtagtgagtcttgacgatgaaggtgaatcgagacaaaaacacccaatagtgaaaggagttgaatgaaacgtacatgcacgcatgcattcagattcagttggcgaccaaagacaaattcagtagtaaactctcgtagtgtcgatacctatcaagcccagaattattgagccatactttgagctcgtgccacagaaatgtttaatctgatcgagctgatcttaacttttttgcattgtttttgtggacggatcagagtcggtgaagtgaaaaaagggaagaaaattcagcagcacacagtcactagctgagtgtacttgcgtggcaggtggtttttatcggcaagtaaaatccctcgacctaaaaagcatgctcttagttgagaataaacaagtagacagcacatcgttctaactcgcatatccatagttccaaaccggcagattcactgaaaggaacctatgatatacaactaactaacgattccattatatgtgttgcttaatttaattgtaaaggtcatgggagtgatcattagaacaggctttcgacgtaagaaatacacttgaatcgtattatttatatttacgaggaaaagcagaaggatccaaagttcagaacagtaatgcactatctagggaatgttcggaatgctttcagaatctctgttagccaaatcaaacagctttatgatctttagatcgactttcattagccttgagtgtgttgataaccatgcatgtccttttactgatcactagctagctagcacatgccaaagaaaaaaagcaccaaggctttaattttacacgtgtaaattcatggatagaaaactggaaatggatacaaaaaatattctaaactatttgtgaaagagatcgagatcgatcgatcgatcgacttcagaccacgacttggtcacgaagttttcactgctttcgctcgctagctacatggttatcgataacttggagagaattattggatttgttgacttaattgagacaaaaacatggacgagttttgtatatgatctatctaaccgaaagaatagttcgtcgttggggtccatacaagcacgtgctaccttgcttccgctgttgaaatgatcaaagtgtgtgtattatatgtgtagctagagccatgcgacctaatgatcgacaatgtcaacttcaacctattaatgtaggcactatacaacaaacaagagactcaacttgactctctagatatatttatatgagggtcgacttatgttcttacgcgctgcaagttgagaattaaatttcctctatgttttccaattaatcgttcgtgcaaataatccatatatatgcacggtctagaactgtagatcaagtcatcgcaagtgaaaaacaaaagaccaatcaatatctattccattatctaaatatcaactgcttcctgagttccaataactagttactgagctaatatatacctccgtatcagaatatctccctccgtccgtatcagaatctaaaaatcaccctagatgtgtcccatccaaccaaaacttattatattttgagatggaggagtaatttttagctatttatctgaattattttaggatgaatggagcaattaacttgatctaatacttttattaaaattaacttatgttgataattctaaaactacaattacacgtacgtacaggagaccatacactgtatgcatcttgaccatacattggatgcaggtagacacatgtaacaagaggctgaatgaatgccacgtacgtgatggatatatgcagtaattaattaacgcagtcttccgcaggatcttaatttgtttccgatgtgaagtgttttgtctccttgcatgtgtcgattgattgagccatttttcaagtacatgacagtacctataaacgcatgcactagctagctactccctccgtttgtatatcataagtcattttgattttttatagttaattttatttaaatttaattaagtttatagaaaaatatagtagcattttcaactcaaaacaaacatgctatcaaaatatgttaaatgttagatttaatgaaactaatttagctttttagatgctactaagtttttataaacttaatcaaactaaataaagtttgactgaaaaataagttaaaacgatttataacataaaacaaaaacaaactgaaggagtaattttaagtagaatgtaagtcaatagtctaagtcttcggggtgaaagactttgataggtggaaatggacttggatggatcggagggagtagtgggccgctaatacgaaagtttgttgtgacagcaacttctgaattctgaaaaaactaaaaagcttttccaaacttttgttgtcacgggggggcaacgtggatatccatgggtccaggcaagcatctattcagagaaaggccttttagagcttgcaagaggttagtggcatgagtgcacaatctaaacaaagccacatataaaaaatattatgtgtagttcaagaaaattataaattatgtgcagtagcttaaagggcataaattaaaggctaaccacgaactggattgataccagccggcaaaaccatgtacaataaataactacttcatcaaatagttgttaactaaactatgctttaaattaaactatgctttcaaattaatcttatcaaaatcttgccatttcctctaagatatagaaaggcgttgtcattggcatgatactaaatctgttaagattcgattcacacatgtgcaataatgctaatctaattctgcaaattcagcagcaagctatactatgcatacatgatcgtaactaattgacagagcagcaacattcttgttccatatgccatgcatatggtagatttttccctcgaatccaaggaggaatgacacatatagagttaattacactatggtccaccttttgttaccaaagttttattttgggctatcctctaactcatattttcactttggacctttggtgcacttttaaccacccaaagtcattttatgtagctgcatctactctataatattgtaaagaattgcccgtgtaagttgaaaaagattaccggtttacaggttgctgatgtgtttaaagttggaaaattcatttatgtattcctaaaaagtttatggggtggtccaaagtgaaagaaaggtaaagtaacctagcccaaagtgaaaaaatgtgttaaagggtggtccaaagtgaaactttggtaataaaaggtggccctaaacgcaatttactcacacacatatatataccatgaaacttttcaccatacatctatggtgtcacatatgcacattaatttatcactaagaaaattcaaacccacgaaataaaaaaaagataaatttagctgtaaattcttttccacaacttttataatctgtttgaataacattatattttggggggtgaggaacatatgcatgcaagggacatcttgctccctataaaatgaccactctgaacaaaaaaaaagtaacagcatgagtttattggagtttttatctagacataaatttgttgtcaaatactccctccatacttgtaaagaaagtcgttttggacagcgatatggtctctaaaacataactttgacttcttgtttctataaaagtatttattgaaaaggtgatatacgtatacttttatgaaagtatttttcaagacaaatctattcatataatttttacattttcaaactcaacaaattgagagttatttatgatttatattcccaaggtttgacttaaacattgttctaaacgacttcttttataagtacagagggagcgtacgttgagcacacacacttcaatttaaagttggtttatgcgtaaaatttccccgctagctagctagattctttcttgcattttatatattgattgttatgttccaaatccaattggacaaactaaattaaattagattagatctttcatctagttatttttggagcattaaatgacctatatataggtagcgcaaaaggtaacacggagtatatattactttcactactatatattaatttcaaattatgtttcaatacttacaaaatcacatacacacaactcactagtacagcgatcaactaatacacatatttactacgtaccgtatatatattggatttcctccaatagcagtacacacatgtactacaagtattgctaatttgctatagcctcacagcaatagtattatgcatgcatgcatacacttctgcatgcaaatagcggacttgtttttcttgaatattagtagtagcaataattagcatggcaagaatgtatgcatgcacagcccttgttaaggatcgaagccaaacatgtcgtcgtcatccccaggaagattcccaaaggagccagtcatgaacccgaggctgctgggagaggacgggaagctgccggccatgtcacctccggcgagccctgacggccagtcgtaatccgcaggcgctgaacccacgatcgacgtcgacggcgttgtcaccgccgatcccaccacggcggagagcggcaggctgctgctgagcgccgccgcctcgctggcgcactccgaggacagtaccggagagtggcagttggcgaagctgcaggacggcgtcggatcaacggcttctgccatcaaacgatggcggctctgacgaagagggtcgactctgcttgtgctcgcgccgccgctggatccgaagctgatgaggttcgcgtagtctgcagcgggagcttcggcctcgacgacgaacgggatggtggaagggtcgctgcaggtgtgctcaccgtagtagctgatgacgaactccgacgagttagactcggaggtctgtacttgctttgtggccatacaaccttggtctggcctatgcgtgcacctgtagtagctcctgcagagagatcaacaactagatctttaattaaggaatgcaagctgcaaaattgcatcgtatgatgctcctgaatagataacatgttacagcaacgatttggtgctaactatgctatgttgctatctaataataaatacacagttcaagttgagcagtattttcctactctttttagtaattgcaacaactaactaatacagttcaattgaattaagcacatgtgtattggagtagtatatatctaactatgtgaagctaaccatgatccggccggaaccggaagatcggaacactattctccaattaactggagtagctaagcgagttgtccagttgcattggcaagtgttcgatcggccggtacaagggcctttaatttcttgctgggttaatcatcattacgtactagctaactaccatgcacaagggcgaagaatctggtcatgttactgcagaattagttgaataatctatacgtacataccttggattatttggggagtcctgtatatgtttctgcccgtactttcgccattgcctgccgtcctccagctccttggtcgtgaccatcctgacaaaaggacttttcgatctgccacatgttacagcagataggagcaactatcatatccagagacacacacccaaatctccactagcatgctcggcagaccacggtatgtacgtatacaagagtgtcatatatatagctagttgctcatagcttttggtcttttcaatataagaaacaggaaatgatcttttgtgagagaagaaagctactggtagtaaaaattcccccctgatcattggcacgtaaagttaagattaaaccccactgctagacaaggcaatatactcccaacgtactctccaagttgcataaaggaggtagctagcatgatgtgtgaatcgctatcatatatatgggtaatagtattactaccgcatgtggtaagcatagctagctagttgcgcatccagttgcagatgattattgagaaaaaagggttttaactttcttcaccttcttctaccggagctgctccgcctgtgcggcccggccacggccttggcgcctttcttcttcctcccgcccgatcctcttcttcctcctcctcctccaggcgacatcaccgacagcgagctggactgcagcctgctcatcaccccgtctatcagctgattcagctgcctggtgctcgccgccgccgcacagctcgacggcgatgtcccatgtagcatgctgtggagcatcgccgcttgctcgcgcatctcgagcaggtcgtccataacttcatgtggctccgcgccgccgtctccaacgccaccatcaggagacgccatgggaggagccgctactatagctaattgctgctgctagcagtctagtattactaggaaagctagcaaagtaggaactagatattctcagctttgctactcttgtattgacacctgctcatcagccgtagctagactgctagagtagataggttattgggcagcagctgcagtttttattggtgtgctcggtgggaagttgagaggaaaagtagacgacgagggcgatcgggagggggggaagaggaagaacaactcaccaaaggaaatggcttggaacatggaaggaggggcccagctggatgtgtgtcgcctgtacgtcatcgccgtgacgaggccgtgagctcatggacggtcggttcatgctccatgcacggcccggctggtgctagtgaacccctgagaaaaaaaatggcagtactggaaatcgtatataattaagatgattgtttaatcactgggaaaatgtggaatggtcctagctagctcccaactgtggtggagaaattcatgcttggttcttttcatttatatatggtatatggaatgcatagttatattgcaagtgcagcagttgtttaatttcaagccattgcatgcgttagatgcctatcttcttgtagatctgatggcagacaatttttcactactacttgcctagtgatgatgctagcactacagctgttattagttgatgtatagttgtcactcatacattttctaagtggcatgttggcacttgaatattagaagttttcacttagcatgcagtgcaagctaactgaaggacaagtagaagatatacacgtgttacctttgctccttcactggtcatgcatacaagtcatcacacatccggtacaggacgttgagggataagcaatatatcgatcatagcaactataaactctctcccctgctccctgaaaataatgtttctccatccattttgtgcactgtacgtgcacacagcagcaaattgtccaagtggagagcatctgctatctgccaaaacaacaactgctcaaagcaattttcttacgaaaacatttccatctaggtaggatgactggaaacaaggataacggaaacacccatggagaccacccccacattagtttattctagggcaaaagcccctgcctgtagtttcatttcttattatatgtgtgggaaacactttctcccacgtactttttcgttccaaaaagaatcggtttttagatgcttgtaagactactgtaagtacatattcaaggagaagctctgaacttaaaaaaaaacgggggaaacaatgaagcaggagaagagaaaatattgcccagctgcctgtcaacttgcatagccgaatagcactcgacgcaagccgacatgggaaacacaggcttaccacaggcatagaagaataattaggaccccaaccacttcctaaataatgaaagtaaataccccccatcggtaacagaaacagtatatgtgtccataaatctatgtatgaagacaaacatatagtggaccacaaatgacaaaagaaatggcacttctcggcatgtgagtatgtgacaactgtcttccagtaagaacaatagcttgaccaaaaatgatctgaactgatctttcatttactaaagcaatgttcataaacatgtacacatgttaaggatatttattacctatcaaaaatcaaaaggaaaataagacggcgggttttatacaatgatacacatgcttctgtcaggctaactaactaaatttcacaacatctccttaagtacatacccgatgctcgggggtgtcctaaacattctatcactgatgccagattctaatataatgatccgagaagctccagaccatagtatatccctaccttctgtaattttaacataatttagaactaagaaggcaatcgataaatccaattaactaaaatatctacagcatcaattatttcaacctctttcattgcctctccgagttccagttgaaagaataagtcagctgataacttaatgctggttgtcatgttgctccaataacctcctttcagcagctaagccagctgcaacagatggaggtaaacttctcatatgcccaccggccccaccgtaattcttattctcctgttctgaaggctgatcaagtgttgccacaggaaataaagactcaatatccttcagtgtcaaaacaagctcatctttgaaattttttgatttacggtgtatcgtggagcaaacagctctgcccctgtttaatttgtagatgctctcttcaatagtattcttcacctaaaaacaatataatgctttaggaatttctccatggatggtttaaatgagatgaagtagctcaggatttggtgcttacaataaaacggtggataaacgtgcttttgtcttgcccaactctatggatcctgctgatagcttgcgcctcagctgcagggtttaacaacggctccactaatattacatgttgtgcttccaaaagattaagaccatttgcaccatgctggataagcattagcaatacttgagcaggttgcatcttggaaaatgacttctttgctttctctccacttatactacttgccagacctttgaactgggcaagcgctgtttgcgattttctgtgaaaagtaacacactttcagtaaccccattgtcattgtccacaagattcaagcatatagaagaggaccctccttggtgataatcatctagcaataggactagaagcagagtagggggaaaaaatcaagttttaacttaaagaaatactccctccgttcagaaatataaggcatattatgtttcatcaggataaggctttgactaacaattgctttactaatatactccctccatcccaaaatatattaacttctagcattcaaaatttgtcccaaaataaaacaactcctccacctacttcttctcaaccaatcaaaaccctccccattgaatttctccacttactccatcttcttaactaatcacggcattctcccatttaattccacctatttcttaatatatgtgcccaaccctaaaagttcttatgggacggaagggaacattatttatgcgacacaaaagcataatcataagtaagtctgaatacgaatctaacaacatcaattttgtcacaaaaattatatcctaatagagtaattgttgatcaaatccttgtcctaacaaaacaaaggaacaaaatacaatttatatttttgaatggagaggagtataatcttgtatgcactttgcgctaccttcaaaaaatgtgtataaacagatatacaatatcattactcagctcagcatagtgagaaaactcagccttggttacgagtatctcaccttcctcctttcatccgaacataagagatattgttagcggcaagggagtgctctagcacatcaagaacatcattccagcttgaaaaaacaagtattttggctgctccgtcagttgaagtgatcctcaaaatccttcttgtcacagcttcaattcttaattacaataaatcaccaaaataaattaatcagttattgcaccccacctgaagatagactactaaggagcatgagtttggtagtttggtcagtgatgcacgtgcattcacattgcaccaacttttatgtttgtagaaaattgtgacaatataggcaggtttgtgcctattttatcagggataaaaaaacaattgtataattaggaacttactttgtgttatgagcatgggtcagaatttctctggcagcggttttgttcacgctgaacagtaccacacagtacgccattaatttaggtatcaggataaatggtttttatattgtatattcccattaaatttttatggatatactcgtttctatatttgataattgcaagtaccaagcaatttaagatgacatgaaatctatcgtatacatgttattatattaaaatagggtaaatatggattaatataatgatgttgattgatttgattctgctatgattgtatgagaaataaacctaagagttgtatattaaatacaattctactttcaatgcaattttatttagctctgcgcaaacgcatgggaaattcacctggttagttaattcaaaaggcaattacttgctttatgcaaaacagtaactattgccttctatgcaaaaccagtacaaacagacatgtgaagtctaaacaaagttgctatgcagtatctgccttctaaatgtaatatagcaggttgtaactcaataagcagtaatcagatatttgaaatgcgggacatataaacaattacaaggaaattaaataaaacctttgttccatatgaaccttggacagaaatagcgctttctgccaaatcctcaatttctctatcagcatttcctctctggttttcaactacaaaagcaacattttcaagatctgtacgttgacggcaagtagggcacataatccattttttgctcctcccaaagtgggctgcagcttgttctgtcatgtaaagacagcctgagagcagtgaatagataaattcagtaaagatcaagagtttagtatacatcagatgaataaaattgtcatggatagatcagcatggaacttggagttggaaaattgaaagatcaacagaaccaatctataatacaaaacataggcacatgtgttgcatgcttacaacagaacagaaacagtagaaacattaactacgtgacaagttgtctttcttccactgaaataaatttaagaaaaatagcataaaagtataagttgtaaataaaatagaagacaactcttgggatactcacacttgcagcaaacgaaatggccacattggaaaaccattttctggtcaaagatcttctcctgacaaattgggcatggttcattgataatatcagaagcagtttgccctgtggcagggatggaagttgctatagcaacactgttgcctgactcgggcagtgattcaccatgcttgcccagtggtttcttgttggatagcaccaatccctaaaagtaaataaaatacaatgagaatttctaaaataacagataagatgggttatggattcttatgggaaaattaagaaagataatgcctgataataaagtagattctgtattgaaaggaggcagttatatactttatccaagtaaatgatgagagctgtccaggtggaaattatacagttgagcagtgtttagaaataaatggaatgtagaatatgtaaaatagaatatcaaattcacggcagagtgcaacccatgatagcaagtattgacctttaagtatctgagttggcctcttatacgagctaaagatgacaaagacaagaatttttcacttgtaaactgcacattgtatggtataagctcttctctagtaacaatattgactgcactgggttcatcatctttctccttgagctgcaggcgtgagagagacatttgatctcatcatgggcacgcagtaactgggtctgtgctattgatagattccttgcttgagagaactccttgcgcatagcctacattagcacataatggtcagacaatatcctatctcgtggtatttttgaaccttcacattttagactaaaacatatggatcacttagtaaacaaagattataaggtttgacatgtggaaaggttcctaattagattcacctccatctttccatatgttctctagacattacaaatgcaagtgatctaacaagacaatagtaaattttacattgatgcaggttaatgataacaaaaagaagttctgctgcaggggggaaaataccaagacacagtaaaatagagataagatactcatgttttatcattccgactcaataataatgttttgtttgcttttaatttactacaaaaatcaagacacagcaaaatagagataagatgctcatgttttatcattccaactcaaataataatgttttatttgcttttaatttactacaaaaatcaagacacagcaaaatagagataagatactcatgttttatcattccaactcaaataataatgttttatctgcttttaatatactacggtgataaaatttatttcagcaactgcaattaccagctaaaacatgtcagaagagaaggcagtgacattaaaaatattttctgtacctcaaaaagcagcaaattctttttagcaattttagcagattgctctcccattattgtctttgagtgggttagaataacccttaaggaagtctcaattcgagaaggatgcctgtagacctgtaaacagcaaccatataaaaacataaaaatggtagataaaacataaatggatcactatatatgcacttttaattgccatagaaaatccaagaaatttataaaccatttcaaagtaatttccgacaaatgaaaagttgaacgaaatcatatctgacacttgataatatacaaaagcgagttgatctatacaggcagtagtgcagtacagtcttttttgacagaaataagtcattaaccatttcaatttgataaatagaaataacctagttacaggaacagagtggtgggggcgaaagtccaggaaccagaagcaaataagatgtggtctaactaccagatctctagtagtttagactaagaagggaagtttaagaaacaaaaatataagacccccaggcacaggtatggattaatcaaatgaaagcctgaaaggtgacatctgcttagctatatttcaatataaaagacatgacaagatgataccagaaaaccttctcgagcagatcttggattcttattgtcgtcaccaggttcagatccctcgttagttttagtattacgaaaaaactgattcaactcatattttcgcctttgcaagtcccttgcttcctctactgaggcaataacagaatcattatttgatttcttaacaagaaacagacgtgcttcatacccctacaagaattgatgaaataaatgcatgatcaacaagcagaagtagggaggtacctcaaaaaacattagcatataaaactacctgaaacagatcatccaattcacattggatgcataaagaaccattaccatcatagcaatttggacaatatcgctgacactcaatgtcttcatcctttgggctatccattgttttgtcaagttctaaaagtctgtccatcacttgttgccttgaactttgcagagaatcaataccagtttgaatggtatacttcaacccagcaatggtttgaaccctaagcagagaacaagacaaccaagttatccatcaattgccataaaaggttttaatttatacaacctctaaacaattaaatcactgcaaacaggaaggacaacaaattgaatggacaaactgaacataattttctgctgacctggaagacatccctgttgaacccaagccagtggtgcttttattggaagaaatatcaatcttcctaatgagctcatcagcagaatccttgttctgttcaatgcaatccaaagcatacagccaccaattcatattttgattctgtaactccatactgagagttgagacctagaagcagaacagcagaatttcattatataaatagtgatgacttctacattctacaacactgaaaatacttaggtggagagattattgttatagagcattacaaaggagacatagaacattccaaagggggaagcatggaataggagacgagaaaataaataagttaaaatcgctaggtgcaactaaaatatagcagtaaaaaaacaacctctgtgaatgatgcactgaaatctttctgtgctattagtagctttgaagtaaaaactgacagatacttttctctgattgaattgcaagtatttttcaaacaaccatcagctaagcatacagatgacgtgtggcatccagaatcattctctacatccatctcttcacttccacatacttgtgtattgatgtttttgtcttccttggatgtttctggattatcagtcatcaaacttgacctgctattctcacaaattttctttcgctttatgccacacagacctgagtcagcgggactagtttcctttctttttcgcgcaccatggacttcagaggtttgttcttttagtgggcattcttgcaaatactcagaactagctctgagcagctccgcaagattgtggttgatatgaagattcaacaaagggtcaacacggaaatcatcaaaattttcacaggccaaagctagtgcttctttatacagagagatggcctcttgattattttgttcaatgacagcaagtccagcaagaccattcagggcgacaacaattttcctgagctcttcctccccttcgacttttgctttcccaataagaacctgcataaaaaggataactaacaaccttgagcacattatcatgtaattacactgaaaattatatggtaaggtacataaaatcattagttgtttacctgtaaaatttcacccattgataaaggagtacgctgcagggagcagagaccgaaactccccacttgcgggtggcaacaagcttgtcgaagtttgagcagtgggactaggagtttggcaatgtcatcattggagaggtacaaatttgatacaacattcgagtctgagagagaaagggagtggcgttgtggtatttttttaaataaaggaaatacagggtggtattgtggtaactgttcagcaactaaaccacatgtttagctgtattttgattttgtatccaaataaaatctttaaggagtttaagagcattgtagacattattactttgttagaaagcaaagcgtaaataaagatgaaaatttcagacagcacatttttttcattggctggtcatatgagagaaaactaaaacaagaaagagaaaggcagacacaaaagtaatggatgaacatcctgtccccacggtatcaatctagcaagcagtaatgtgtgaagtacctgatattggctcgcttttgttggcatcatctctgatacgtcttataatttcatgtgcatggtccatgcaagtggcatgctgcttctgatagaaatattcttcaattgatgaaaagatgagccacgaaaagcactcttcttgtggaggcagctgtaactcccgtgaaacatgaattttagaggagcgccacatgatttccttgaagaacttgtgtgcataattcatagctaccatgtcccccttctgcaggtcaatttgatgaaaacacaagagagggattaatcaatccaaccatcaagaagagaatgttatcaaagcccacaatggcgtaacacagacaacacagaaaaaaaattggtgcactaagcaacgaatttgcagtgtctttgttttttcagggttttaagttcttagtatatgccctgtcacatcctcattttagccatccaaccattagtactcccttctcctcctcgttctctctgcattaatggaggcatgatagttgtttagcctcttgtttgatatgcctttgatttctaaaacaacagtctttttgggatggagagagtagtaattagccaaacagtaagatctatagtaatccagaattagattatgtaaatccatcattactactatgtatataatattcaagttctgttactatagataaagtgatcaatatttacacaagtggtgaacaatgcagcgtgacaatcttccattttcaataggtggcgcaacctctaaattaggtagcatgtaataaatacccatagttactggtagtagtcaacgtacctcatatgggtccctaataatatccacccaccatctatatgtgtcaaaaggatgagttttgagaaagcgaagaagcccaaaaagatcatcaagccggcgttgtattggagttcccgtgatacaccagcggtgttgagcatttagcctcattgccatctcagtcacagaagttttgctggactctaccatctgagcttcatccaaacatagccgccaccagtggacccttgttaggacagttggagtgacagggtacctagagagttgaagacagttcagcaggagttaagacagctattttcacactgatgcatcaatggtatatctaatgggctaacaatgggcatgatggggtacccggaacaaatatgttagtttgcctatctcagtttatacaaactagaataatcagtaaatgatacctcttttgatatctcaaaaaacggcgatcaccatcatgccgatcagaatcatgtgatagatcttctttcaggacatcataagttgtcaaaacaatgtcagctgtgcttatctcagccatatcacttttttgggtagatgttaagtccgtgttctttgcaccttcataaatgcaaactttcagagatcctggtcttgtgtgtctaagagcaaaaggagaaaccggtgagcattacaatcatcatttgcagagagtcatattaagtaagagtaaatgccgaacatttgaaaaaaaaatcaagttttgcaattagcattcaataaaaagctgggtgatcatgctgccgatatattgaggataatgacctagcattacctgcttaaacaagtctagtgaactagattacaagtttggtaacatgcaccacgatttgctcaaaattggacttattctagataaaaggcattttatcacgagtgtccttaattcttatagaagcatgagaagaacttgaattcaagtttgctaaactctccaatgctcagaatcaagcagaggtaaagaggacattatgtggcttacacagagaaatcaaaacaaggaaaatatgtggcttacacagaaatcaaaagttcaaaactatctttctacattctaatttgggagaaataggagcataaagaatggtaatgcaagaagtttctgatatagtaatgtgtatatttaaaacatagaaaatactatatcacaatactgttcaactactgtacaggtaaaagaaatcataccggattatctcagagtgccactgtgccaatattggtgatgggcatactatcagcgtagcattactagatatattagtttgggcggcttcaataagctccaagcacaatgtgcaaatatatttttcttctgtctctgcaatgcaatacctgtctttcttcttccttctattttttgactttagggttcctttttcattgtttgatgcttcatcaccatcatcatcatcaacatgcatttcctcctttggtgagtaaccaacacaactagcgtgttgccaagcgtcacatatgtcacactggatccatatcccctggtatgcagaggttacacttgcagctccacaaatgcactcaactctttctcttttatgcctctttatctgatctgctccttttatattcgaagagacagaacagtctgctgaatatggcctgcgatgtgcaaaaatgcaagccaaaagctcaacagttttccctaagcccatttcatctgtatttaattaagcacaccaaaagcatcctcattagtgacaaaaaaataaatgcatttgatttatcttaacaaacttaatatcaacataccagccaaaatgcccccagagacataaggtggagaaggttctggatgcatcgagacatttccactgtgaagaaacagatttgatgaaatttgaggatactcatacaaagaacgatttaaaattcagataaatgaaaagaaagtgtttaagacacattacattctggatgcaaaagacacttccactgtgaagtaacagatttgataaaaattgaggatgctcataagaagattacaaaatcccagtaatggaaacattgtatttagataaaaggatatacagagtaagaaaataaaatgcaaaacaaacaaaaaatgtgtctagggtaggtatataatgtgtttccaattgtctgaaaagaaccaaatagaaccttgacatcaactaagcataactgacaacaaacacaaagccaacaccatcatacatgaaaccaaattatcatttatttccttgcatccatgatggcaaaagctgatagatagttaacataatattgtcttcatatcagtcattataattaaatgaagcagtgaaaaggatggtcaatatagtgtttcacacatagtagggtctttactagcatttaaggaaaacgtagcaaaatcatgggaagtgtatgtgatatgtattaaactcttacttgaatggattgtagaacatcctagatttcttgtgcataaaatctatgggaacacaataaggtgcagaatgaacataatgttgatttggtgatgaaatcattgtgtttcccttttcacgttgaaccatccaattcgctgcacgaagttgataggttctgagatgaggaagcaaatcgggaagctcctcttccaacagtccagcctccctgtcaacaagtaaaagaaaagaaaatcataaggtaacagcaataaatagtagctacatgttttgtacaacttaagataatagaaaatcatatgcatttgcctgaagacagaatatgtttgtaataaaaataaagcatttatctcatgttggtataaatgcttcacacacaacgtcaaaaaaaatgcttcacacacaacgtcaaaaaaaatgcttcacacacttcttgaagtgcgcaattgtggttttagaccacccacaacaatttattcctaataacttgtgagataatgagatgtataaatgtaagggaacatacattgagggcttaacggcttcgtagaaagcagcaagatcaaactgagaatccttctttggggtaaaatcaccattagcacctccatttataggccgggcaagaccatccatcccatatattgcagccgaggtcatgacctcaggacgaacccaagccatcatattcatgaaactcttcctccacggatgccttgtcacctccaacaatgattcgcatgtagcaaaagcctgctccatcaaccccaatctaactctaaatgatgcaaccgacacggaatcagcagaccgagatacagcaaaggcatgaacacgcaatgtcacgaatctcaatctaaccaaatgggcgaggcctgatacaccttcatcgggaccatcaaaacatccagagaaaaccataccggcgatggcatactccaggatcacacaatctgaaggtaccacaggccactggccaagccggaaaccctcctccggcgcgtcgcgcacccgcaggcgcaacgagcacctcttctccctctctgcctcgtgca

SEQ ID NO: 23871 - DNA, 21971 bp, Oryza sativa
tcgcccttcgccgcgcgcctcgatttggaggcgccgccgctgccgctagggctcggcgcgtcgggctccgcggcagcggcagcgccggggcctaggcctaccgcccgggccggccgcgatttcctcctccccatgcgcgatcccagcagattaatcgagcatccgatccgggttttagctctccggaagtagaattggggggagcctcacgccctcaccaaatcaaaacaaaaaaaaatctccaaaacctagcaatgattcgtggattggagctcgcgaggtcgagcaggaatggaattcgagggatgagatgatgggtggatgaggcgtcgctcgagagattggatggtggcggaggattggaggagctcgccgctgttatcttctcgcgaggggttttaggacgaactgaagaggaagggggaatggggacgaagggtagtcccggtaaatttttgaaagtgtcaaggttttttagtctcgatggtgttatgttgtgaaaatgcaaaattattagtgctaaaagtgttaaaggaaagaaggtggccttaaattggtgaataataatcctctaaataccaagaatgcccttcgctaattaaatcaagaagcaatcagcaaggtttcggagtgcgagcgggttctagggttctagcactgcaacggcagcgggagagagatgaaaaatcaaatggataaaagttgtgcactattagcaaggaaaataacattgccttgtctataatatacatttgattctaataaaatctatcacttcacaacacttgattttgtaaaccccggatgtgataccggtttaaaacagcagtatatgcataaatagacgtcatatactttctttacaaaataaaaaaaatgattttctcgcatatcatctacttcctacctccatctcccttctcccttaatgttatatctcatcttttcattgagaaggttttcaatccattttcaacaaaaaaaatcttagatgcacaacctaaaatcaacttaacaccctcttttctattacaaaacatggtcctcgtatattaccttgttttagcggtgatggtatactatgagtctatccccgaaaaaaactgagtctacaacaaataacaaaagaaagaagaaaatcaccttcttctcaaacagagtatttgagagtcatctgacttcagtgtttacccaataccttgaaaataggagaaagacatagagtaaagaaggagaagttatagaggagtcgtgatgacgtacaggttaagaaaaggataagcaataaggttgtgtttagatccaagggtgaaaagttttggcatgtcacataggtgttgacagaaaacacgtggcctgggagatctgcttaactccagtgcaggtccaaagctcgtctttggatgtattagcgtgccagttgatttgatcctgtaatcaacaagaaatagaagcaaagaaaccgtagttaaatctataaatgatagccgatcggctagatgccgatgacatatcatttatctttgggccgatgtcatccatgtatcgatcggcagtcatgaatacgtaaagaagaactaaatctactcgatcggctgtagatattaacaatatataatccttatatcgatatatacttaaatcaagtgattgggatagatcggtcgccataccgagacagtataaatcacttggatcgaaatatatattaataattagactatatacgttcatagcatagccgatcagatagatctagcatgtatcggctaatactccgataccactctatgttaagatgttaaagcaagtagaatatactaaacaaaagcctaatatacttaaatgcggcaagatcttaacgcaaagggcagatttaacatgtcaatcaagcatataggataaagagtagttaaatcagatacgatcggctgaaactccgatgctattctaatcggcaactagaaggcaggctagggattgatattctaagcacgacttaatagatcaaacttaactgatgcagcattaagtatgaaaagaaaaataatatctagacaatcaagccgctagaagtctcatggaacggtagatgtctcatataatctagaccaatatcaatatttaacctaatcggctaccctctattgacagatattaaccgacggtaggttagatgatgatattgctagagattatgtaaaacatatgataactcgacgaattacataaacaagattagaatgtcataaagatggaagcactaatcccgagaacgcaagccgccataacaagtttacctcttgttgaagatagaaaccgatgcagctcaacccgaaagcaagaactcgtcgaaataaaatgaaagtaaaaaagggtggcgatgcgccgaaattgtattaaacatgtgtgttttattacatagggctcagggtccatttatacccgaggattacaagatatgcccatatcggacacaaccattatctctaacaaactctaagacaccacaagtctttgcggcagacttttgcccacacttatctataaggaattcacataaaatatcctagttaatagatacaattgccttcccaggactctatccatgcgtggcaatcatcttgaagtacattaacttgaacccgatgtcgcgcacaagtcgtattgtcggaatcggcaatatcggcttatttagctcgactcagactcagccgatcttgtcgtagccgatctggacttcagccgattcctgccctgttttcaactcgatctccgcttccgactttgcttcgatctaatcttctctccgatgctgatgttaccaaatttggttgtcaacaataggatatacggacacacgtttgaagtattaaacgtagactaataacaaaacaaattacagattccgcctgtaaactgcgagacgaacttattaagcctaattaatctgtcgttagcaaatgtctactgtagcacacattgttaaatcatggagcaattgggcttaaaagattcatctcgcaatttacacgtaatttgtgtaattagttttttttactatatttaatactccatgcatattttcaaacattcgatgtgacggggtgaaaaatttttgcgtgggaactaaacatggcctaacactagccttctcccctatcctttactgacattgaggaggtggagagtagtagagagaaaaaagaaggcggagagtgggctgtgtttgagggtgaggggattgagaagattgggaagatatgcaaaacgaggtgagccattagcgcatgattaattgagtattaactattttaaatttcaaaaatggactaatatgaatttttaaagcaactttcatatagaaatttttttgcaaaaaaatacaccgtttagtagtttgggaagcgtgcgcgcggaaaacgagtgacaatctccccaatctctccccaatctcctttgaggaggaggggattgaggagattgggaagatacgtaaaacgaggtgagccattagctcatgattaattgattattaactattttaaatttcaaaaatggattaatgtgattttttaaaagaactttcctatagaaaatttttacaaaaaacgcaccatttggttgtttgggaagcttgcacacggaaaacgatgtgctaagtacataggaggaagagggattggcaggagtttctattactacaggataaatttctactattacatgtgtcacatgactcacatgtagggtttaaaaaaaagtagatgtaactcatccatttttttaaaaaaaaagagttgaaggacattaaatgtctaggtttgaagttcatgataaattccatcatacatcattttttttccctctacgtgagcagcatttaaattataaaagctattaaactatatttatatccatgttttctaaaccttttaaagaaattctctttcgccataatgacaatgctgagtattcacacttgaaacacaaacaaacaaataaacaagagtggtgatggcggacaagattaagaaatggcatctataatggcactccttaacttacttatcatatccattgccatcaaggagttggagagaggtagagaggaaagtggagtgggagagaatatattctaggaagaatatggatgtgcttagttatttagaagccaacgctaaaaaacaaattgcgatgaaaaaaatatcataaaatcaaattttaaaatttaaattctggtatctgtttataagctatgaggcaaacgatgtaaccttagagttttaaagagaacgatgataatttgtccgattaaatattcctatctaggtttagagttcgtaataaatttgtccataaatcaaactttcccctttctgtagcatcactggagttcaaattgtaacgcagatatttaaccatatttatgttgtgtacttaaagttttaccaaaagaaagttccttttcaccgggatcgtaaagtgttgtatttacatttagatgcagcaccattacacccgaaaatgaacaaaacaaacaacctgttgatccaccaatatgaaacctacctaaatgaatccgaatgaaattcactctacctataagaattccaacgactgaaaattctgtcaaaattccagcacctgaatctatctctagttctctacactactatgacttgatcctgattgctcccattccagtcgtccccttgctgttgagtatccccggcaatggccaaccggaccctctcagcctcgacctcttcagcgcgccgctgcaatcctcgtctgagtcatcgtcgccgccgtcgtcgtcgaggtcgacgcagacgcctttccctttccggtcgtacagcgcggcggcctccggcgtcgtcctctcggagaagctctcgtacaggtcaggcgagtgctgccggaacagcaggtcgctcgccgagccgtaccccatcagccggtgcaggctggagccatgctgctgcgtcgccgccgccgccatctcgtcgacggtgttgaacgacgagttcctcgacacgtgcagcggctgctcgtcctccgtggagtagctcacgtcgacgtggccgaagtcgtccaggaacgcgaacttgtcgcctcgccgcccgtggccgcgcggcgccgccggtgagccgtcggcgctgtactgatcgccgtgcttcttcctgtcggggtcccggtaggagtagctgaggacggcggagcacgagccgcaacgcagcttgcgcaccgtcttggtcgagacggcgaagtcggcgggcacctggaccagcttgaagcagctggagcagatgatgaacgcgcgcccttgagcaccggccggcaatggttcctgggtggcgcccgccgcttgacgacctcctttgccgccgccgccgccggccgccgcggcgcaggagattcttgcgttcttggcctgcagcaatgttgtccccggcagctggtgcacgcttgcttgccatggtgaggggggcagcaaccgtgatggcatgacggcccatggcgcgcgtcgtggcagcacgggtgatcagccctgcaccggcggtagcgccgcgacggcaagccacgtggtggaggtggagcagcgagctgaccaggcttgcctgcacgagctatgtagccgggacggtggacagctgcgtgacgcgctctgatggcttggatgctcgccgccgccgccatggccgcgtcgcgaggagcgtagccttcttgcctgggaagacgaggagggcgcgcgtgcgtcctcggcttgttcagttcaggagatttactgaaaagttcagagaggtcgtctttcaggttgtccactgtcttcaggatcctcttctgaagcggcgccaagctttctggtgatcgacgcgcatggccatgaggaggactcgtcgccggatcatcctcccgtttcaacacagccggtgcaggttgtgagtctggggtttgaactgaacttggtggaagctcgacgacatcgcggcgtggagattgggatgtttcctctgaacttttcttgccttcagcatcagattcagtctggtcgcttcgttgaacatcttgcagttcggtgttactgtcttctctactctctgaaaattgcaccttgccttcagatgctctgtcactgcactgtgcatcagctgcagtagctgcatctcctcttgtgagatcttcagaattgccaacagcttgctgactggtactctgaacatgctcttcctccttctcagctggcaccactcgctctggctcaggagcattgttcctcgccgacacgagatcatcagtctcgcgtcggcttgtcatgtcagctccttgctgcccactgctgatttgagcttcaggagtggatccactggtgcttgcaacatcactggagcccaggtgcttgctgtgaggaggcaggccactccccaaagaggagggagcactgatcacctcctgtgagttgccggtgcggtttttcgctgcgtaaaaaaagcaacaaaatccgtcagagactgaccaaaaggcaaaaatccaagatcaaattctcgatcatgagcagtcatggagcttgaattcttacctcggagggtagtgccgcatccaccgcattggtacaccggcgcgccggtgggctcctgaagaacactgaagcatttgggacacctcacatggcgaaccactctggcgtctgagattgccatgagccgacaaggccacagaacatcactcgcatgcagcaaaaggtgtatccggcaggtgctaaccgatcaagctcgatgtctgtgttgggagacagttacaagaaaaatactcgtcagtgttctgcttcatcgaatctgcagtttctgacggaagaagagaggaaatccaggaaatttgtactacttgtgtggaattttgttgactgataatatatactaatacatagaacttagtttacatgcgaatacaatagtaaaggaaaatgcccggtaagccttaagcacgtaagcatcaagaagcgacatgtatgtttgaactttgaactgttcgtcgagggcattatgtaattttctaaatttaaaaactagtggtgtatcagaactctgatgatgtcattagtcctaattaacacaataactatagctactagtagtagtggagtactatacaagacgaagtacaggatttagacagaatcttcctcaacagaaagtcacggtttttgtgtgtgaccacgcacacaaggtgtaagccacagcaaatgaacgaacagaacagaaagagccggctattggacactacaagctggtagaagatgcttgcccatttccagttaatttccaaaacccttggtaatcctaggtacgttatctttcgcatgatgaaaaacaattaagaaaccaaaaaacatttctgaaaccttaagagagaaaaaaaaaagaacttgctgagctgatgcctaaaaacttgaagtagatgaagaaagcagaggaggaagaagacagtcgggtacaggagcacccactcacctatcttttgttttttttggtttctcgctttccccttcagttccagacgcttctcctagctcctgcttcgatctctcctgttcccaatcctcagaaactactcaatccgatcctcaagctccaaatttccaaaatcaatcctcagaagctccacgcttctcctgctccaactccaattcttccggctctctctcagatgcagagagaaagagagagagagagagagagagagagagagagagagagagagagagagggagaagagacagctccaattcttggcagttatgggtgcagtgacgccaggagaaacgatgctgatatatataaataaaaatgggagcgtcgtgtgaagaggaaggaggaagaagcagctgaggaagcaagaaatgatggggtttggggtgatgtaaaaatgaagcggcgtggtggagaaatatttatatgcgatggggtggagaagaagtctgaccgcttccgcgatagcgagtggctggctttggactcctcctcctcttggagaagaagaggagggcagggagggccaggtcgtttggtgcgaccgtgtcgccgacgccagtcgcgagtgccaccgcgtcgtcatatccagcgcccgcccgccgctgcctgctgctgctgtggcctactggctcgctcgctcgctgtggacttctggatgccaccgtggctactggcgcgcgtgtagagcgagggttttctggatgcctcatgacgcgtgtggtggggtagcgggagcggttgccgtcacgcggccacacggcacgcggcgcggatggggaagggatcgtgcgtgcgctgccttgtatcgtctttttctatgcccttttctctggctcgtgtaatcgtacgtgttggcggctgcagacgaggagtaaggccatccacaatgggtagcctcagagcgtgcccctgctcacggcgtccgcctcccgtccgcacaccgtgcccttggagggggggcgcgacccccacgagggggacggccggctcgggctcctccaatctccttttcctgaggcacggctcgaaggaacccgttgtggcgacctcggtgccccattccccgcctcattcccctgcattttcccttcttgcccccccctctctcacctgggcgtggtgacggagccggcgcggcctcgtcggtgtggtggatggcgacgagagagagaagcggcgccggccagatctagcccaccggcagccggatctggaaagagaggcggcagcttggacgccatcggccaccgcaccgcgctcctgctcccgctcccgcgctcgcgcgccgtccagcctcccaccgctcgccgtcggccagatcgcccctcgcgccgctcgcccgtcgaccagctctccggcgtgcgcggagacgggcggcggccggcggcagccgaagggcgcggagggagcagcgacgagagagagggagggaggcagccctccttatcgcctcgcggccgccggcgacgagagagaggcgagcagcgagagggagacagagaggcgggcgacagcggtggctggggagagagggagatggatgcagggctggggatggcgaggagggaggcggcggcggtggctggggagggcgaggaggaaagcggcggcggcgagcggcaggggaagagaggagggaggtggcggcggcaagctgggaggaggcggcgacgaatgggcgacgaggatagcgataagaagaagctagaagccaaaagtgggggaggaagaaaagagaaggaaaaaaaaaagaatgagctggggaggggtatttggggatttttcacctgggactccattgggccaagacacccattgtgggctatagtactctcaccgggttgttttagattttgaggaacccatttagggataccttctattgcgaattgagtttcctacgagtgtcctcagttagtgaggatactctatgagtgtctcacattgtatatgtgagtactcctactttattctcctgttttaaacaggtcaagaaaataaaattggttagtacgagaactatttatttgcaacaaattgtactagtgtgtaccaactggagtccggaatcgtgtgcatagcacagacaaagcaagttttgcagacacacgcaatcattagaaaaaaaaaacgccgcggccaaacagaacagcaataaccgcatgaagcatgttccttgcttaaacaaagaagaaaagcgcaagcatgccgtttcacatccatacgtggagcaagcgagctagagagaccaacccactttcaatgggcagcgatcacttacacgaggaaaataaaaaggcaacgatatgtgtatgatggtctttgacctcgtgcagagctagctagctctatctatctcttggcatcgtacctgtgtactataggactatctacgtgtgtgcgcagtgagcatagaaaacgaagtgccgttgatagttttggtcgtgatgttgttgccgcatgccggtgcgacaaatatcacataggaggctcaggaaggcatggaccgatggacggttcggccaaatgaatgagccgatagccacagcgttcggctatcatgatcatgaaacgaaaaaggcgtttcttggctgcaggtaggcaccgtcggtgtacacatggcagctagagcggctcgttctcgtacggcctcgtactagtacgcaacgtacgtgtggccgcgggcggcgccggtgccggccgcctctgcgactgcacggtgcgactgtgcgagcttcaccaacctgcagctatcgacctacttctccttaccaaccggttcgcgcgcggcatggcacgaggaaaaatagttttaattacttgtttactagtatcttttctaaaagaaaaagaagatagattaatgtgcaacatttatataaattataacaaacatataaattagactttaatagtatatgtatattcatcttttttataacttgtaaatgccgaatttaaacttatacttcctccgtcccaaaatataagggattctgggtggatgtgatacttcttagtactacgaatctgattaagaaacctgttaagattcgtagtgctaggatatgtcacatccacccaaaatcccttatattatgtggcggagggagtatgtttttacaataatatattagtacatactagtaatatactccttccgtattttaatgtataacgccgttgacttttcgaccaacgtttgatcattcgttttatttaaaaattttgtgtgaatatgaaaatatttatgtcatgcttaaagaacatttgatgacgaatcaaatcacaataaaataaatgataattatataaattttttgaataagacgaatggtcaaacgttgaaaaaaagtaaacggcgtcatacattaaaatatggagggaatatttcttaaaattaagtacacgagtgtacgttcactgagttttcctactcctatatgctttcctagcgaatacgcctatcaggatagaggtgaaagtgaaacgtgagcggggcccaaagatgctgggcttggcgactcggttttccggctctgaagtgacggttttttacgcgccaattctctcgcgcggatcacagaaacacgcgggcagatagagaagagaaagagacccggctgcgacgagtctaactgccaacctggcagcacttccagcaagcggaagagggtcggtcatatttatcccataatatggctaattttttttagaaaaaaagggaaatgagtaaacgacctggcggcgcggttagtcgggcccaccacccacccactggggagtgggccctccctcccgcatacacgttgcagctggacgcggcgttcacaccaactcaacgtgcgccaattcggaaggagcacccatctttcccctttctccttctcctcctcctactcccagccgctcactcgaacccccccccccaccttccttgccgccgctgccccgagggcgcgggagataacctcgccggagcaccgccaccgccgctgtcgatcttcttccccgaggcaaagccaggaggtctctacctctctctctctctctctctctgaattcgtcgccccgtttctcagcttgctttaatttgtgtgaaatttgagttgatcgatattgcttcgtgtttcggtttcttgatgtggatttggtcctttaggatgattcttctccctttttttttgtcagtggaaatgttgtgctttcctcccgcatctcatgtgcttctcctgaatgaatcctagggttgatttgtcgagccaggttttccagttttccatttttgttttgagcaatcggttaaattcaggtcggaagggagctcccctaccgccgattcctcaagcttcttacattgaacagatgatttcgatgtggagatgtggttgggagagggagaagagcttgtgccttttagactgagctttgcatgcttaatgggaatatcaattggatgaaaatgatccctgatcgggacaccattctcggttgattttttgttcaggcgttcagcaaaatgctggtagcgaactattgtttatgaattatgagattaactagggattagtgtgtacaattatcagtaacaggaggcgttgaccatcatagtgtagctacgatgaccatcatagtgtagctacgattatagtagattcttgagctaatttttaggctgaatgcatagtccctgctttattagaggtaggacattggttgaagcagggcggaagctttttactctagaaatttagaggtagactttatgaatctaaaggtcaactggaacccaaaggtttaggttgtaaagttagatgctctttgattgcttttctatgactctaatatgtgcattctgatagactgcaacggccagctgactggcattttttactttgaaacatatttctactagatactgtgattgattgtgattttgctttattgtgccattcagaactaaatgcaatatttagcatcagatatctgcatatgtataattccaaacaaagtaaaaactgaaaggaaaaatgttcccaaaagaattcagaataactttctaaacttcccatgcaaatgatttttttcccctgtaaattaactagttccacaaaaaagaatccctgtctagcccttataaaacctgttgttcagtatgttctctctttcctatagagataagactaacaccatattcattttgcttccagtctagacaaactcagcttcatgagttcaagttcaggaaaagcactggcatccagcatctcctattcagcaggaaagagcagcattttcttgctctgcctctttgcaggatacttgggaattcctggccgaaaattccacttgctcaagaccgtttgcagcactgcatctccttccatcattggaagttgtggagggaaccttctttagactactttagcacaagtcttcagtttctattagtgtggaagcttggcctgcaaaaccagcaaccttagctacgtagtaggcctttggatgatggtttcttctcagacatcctctctgacaagaactatcgcacaggaccccgagctcttcacagcaaaaataattctcccaatgggtcccccggatgttatctctgaaaatgatgagtttgatttctctgatgtttttggcaccactccagttcagacgccaacaggcatttcggtagctggtccagacagtcctgcacctttggctgagtccaatgagggggtttacaatgatcctattgtcatcatcaagcgatctcattctcttgttggtccaacatcacttgttagccagtccctgcgacttagcaatctcactctaaataaaacagaggggtcatcagaacctgcagaagaaaaggaaaggaacctagggcagctcagtgatgaagagtttgacaatgccacaacagaaaatgaaggtattgggcttgatgactttgaaatcttgaagcttgtaggccaaggggcatttgggaaagtctttcaggtgagaaagaaaggtacttcagagatatacgcgatgaaagttatgaggaaggataagatcttggaaaagaaccatgcggagtacatgaaagccgaaagagatatattaacaaaagttgaccatccttttgtagtgcagctcaggtactcctttcaggtacgtgtgtacatcaatgttcttatctctatgttgaaatcacttttagtgatatcttagtacctatgtttgaacacagacaaaatatcgactttatcttgtcctggacttcataaatgggggacatctcttcttccagctctacaagcaaggattgttcaggtgactgtatacttctagctagtacttttgtctgtcaaaagaaaatgtttccggccctataactcaaccgttttgtttaacagggaggaacttgcacggatctatactgctgaaattgtatctgctgtagctcaccttcacgacaacgggattatgcatagagatctcaagcctgaaaatatccttttggatgctgatggccatgtaagaatgccttcttcaacaatctcctcctgctacttcttttccattttgctgatatcttttttgttgcctcatttcaaggccatgctcactgactttggccttgccaaagaatttaatgagaatacaagatcaaactcgatgtgtggaacagttgagtatatggccccagagattattcttggtcgggggcatgataaggcagctgactggtggagtgttggaatcctcctctttgaaatgctcacgggaaaggtgtgctgccaacttgcatgagagggtaatcttcccatttgcattcattcattgctaaataatcccttactctttgcaacacgctgcagcctccgtttgttgggaacagggataaagttcagcagaagatagtgaaagagaagctgaagcttccatcgtttttgtccagtgaagctcattccctcttgaaaggagtaagtttcttaatgcattcgatcacagtatcaaattcctatgttgtgtttcttatctgaaaaagatggcaatccgttgtccatttcagctgctccacaaagaaggtggcaagcggctaggaagcggtccgggcggcagcgatgagataaagaggcacaaatggctcaaaccgatcaactggaggaagctggaggcccggcagatccagccgagcttccgacccaacgtgagcgggctcacctgcatcgccaacttcgacgagtgctggaccagcatgccggtgctggactcgccggtggccacccctgtcgccggcggcgccggccacagcagcttcgccgggttcacctacgtcaggccggctccgttcctccaggatgtcaagcctccctcttcctctaggctgaaagactagctagcagccagtgcgagtgaagaaacggatgaaccaagagcaaggggaaagaggcgaagggtaggaagttactactaaaatatctgtaaaaggacaactggtccatgtgaatgcacttccggagctaatctacccaggagatatgatccatttgctcagaccctgaaactgatacccaatttcaatcacaagttcacaacacacaacctagtttgcttggtcgtgttgttgcattcgcggtcaaaatcaccctatgatagactaaatgccatcggcatttacatgaccaaaactaggtccaaaactggccacacaagagtacaagatagagcaaaatcatttctcacacaatatagcagctcactgaatagacaaatccaaagcttcgacttatgttcaggccttccgccgaccaacttgtgcgacaaatccagccttgattggagcaacagacctcgacgatccacactagacagaataggcaaatgttgattcagtggcaagcaaaataacgagagaatattcggttttcatccaacaaatgttttaaaatgtttcagtggcaaagtgttttttagtcctccctctaattctactatctgttgtactctccttaaaccccgtgactttgagcaatgaaattcaggtggggaatctctcccctgcggtgacttgttaaaaaaatgttttaaaatgaagattgccttagaagtcagaactttgcagataatatcatattcctttactcaaacaatgtaggctaggcaaactattatgcagctcatcataggctaacaagcaaagagtgaaagttgacagcagctagcaggtacaaagaatgagggtaacaaattgttttctgtgcactatagaaaattcagatgctcgcaagtctgtttctgtagtcaaacagaaagcaagaatatacttatgtacagaggagattggcgaaaaaactactacctcctatccagattcattgtattaggatgtgtcacatccacccgaaatcccttatattataggatggagggagcagtaaacaataggagataatagatgtcacaaatttgcaacgttgtttaagcctcagttgttgcttttttatcatgaatttgtttgtcaaacaatgtaggcaataatgttgcaactcatcattggcagaaccatagggaatagatggtaaaatgaaattttaaaaaacaaaaggcaattaactaatgttttcacagaggagtgatcgctcatgccgaagcaaactggatgtaactgaacatgcacaagcagataatcagacggcatttacctgttcgcagcgaaggaagaacagacgattttccttggatagaatggtatcagggcttttgcaaccattgcaaatgacgtactcatctgaaaggtttaaagacgcaataagttgcatataacccttgaaatcttaagtcaactaacactaacaaaacagtaaacaacaaacgtacaacttatgatagtttaccacacatgaaaaaggggaagctcatctgttcaaccaagggaatgaagtaggataacttactgatatatctccgcaggattgcttcgaagtttttcggagcaaatcttcctttgatcaccaacctttgctgcccatcaagtgatccacttgtccccatttcagcaagcaaaaacatcatcacatgctcaggttgcctatgcatcctggtaaataatttccggttagttcatcacagctttatccattgtaagagcattcaatagaatatcaaatacaaaatacaatccaaatggtgaaaaagcgcacgttttgcacaagtccataaaattcacaaaaactgtcttcttcgtgccctctcgaagaacctgtggcggcctcatgacagttctgcgtctgtctccagcaagatctggattgttttcacgcagaatattgaacactctgcccagaagctgcaacaaaaatacccaaatcaggttttcacacgcactacagtaatttggtcattctgtgctagttctggatgacagttgtttctgtttcacaatgttgtttgagactaaaggatattgagttgcatgctagttcagtatagaattagacccacaaagccagaggaaaaagtaagtaaaattaataaagattatccaaagcaaattttaatgctctcaaaacatcgcgtgacagcagtacatgaacaatacattggaacaaataggtgtggttgtaagagcatgaaaacagtcaaaacacaaaattatggtgcatgcaaagctttggaaaatttaccaaaagattactgaataatgtgttgtctgcacaaggaaataatgaaaagaggaaaataaatgaggagaaatatataatagtagaagcacctcatcataattgtagtccctatcagttccctcccacgggtacctaggggcacctccaagcacaattccttccccttcttcctcctctacaacttggtcatctggaaagcaggagtcagtaaggacaaagaataaactgtcaagagtaagtaatcaaggattaatcctatacctaaaatgtcctccccatcaccaatgtcattaatagacaaatcaagatccacctgaaattttcagtaatgtgaagctcaattcaatctgtacctctcaaacacacacaaataatacaaaatgttgatctcacaggttcaagcacaaataatacaaaatgttaatctcacaggtttcttcttcttctttttcatcccagtgaagttgagctcaccaggctctgtgactaaggaataaaatggtacaaattagcaaagatattcccgtggcataatatttttttctacgctacattaagaatacctgtcaggttttctgtcttctctgccagcttgtccacctcatcagaaggatcttggataacaaccttcttctttttcttcttcttggttgggtcaaaaggagtaagctgtagaatatgaacaatgcaaataaataaacggagcaacggagaagacgtggaaaatctatagaagttttacacaaccatcagtaagaaatataagatatagcacttaataacttctcagacaacgtaatctatcacaacttttttaatatttactccatgaagaaggggaaagaagctgaggagtaagcactggctggtatcctggtactggtttcagataaggccggtagcctctggacaggcagaacatgatataatgctgttcgttcgtcaaatatataatcacttatcacgaaaccagagtcaaaatgcgccccttatatcatgctatgttgttgcaatgcgttgttcatatgctacgaatccctcgcccatgcgttctgaaatggtgactacacataaaacaaatgaacatcccctgatgctagtgtctcttaccctctaaaagaactcaagtccaacccttattccaatcaacagcaaacttctagctcgaaacccttcgaatggaaccgctcttaacgaaaccccaaatccgcatgaaccgcacccaaccgattaggggcgattggggagcacgttgcctcacctcggagacctcctcccgcttctccgcgtgctcctcgtccgccatggttgccgcccgccaagcctcacctcacctcacctcctccgccggtcgcgatcgaatcccctgcaaggcacgaacacgacggcagaaggatcagatccaaccgaaggaagaaagcgcgcggcgccgacgatcctatcgatgcgcgactcgcaccctgagctctcgccggaggagagcgcggcggcgacggcggcggcggcgtggattcgggtggtagggtttttcccggaggaatccttgcgcctttagctttactactggtctcgcccgtgcaaaattatgggaacacagggactctagtgagaaaagtcactccgtgtgatcaatcctggccgtctaaatttgatccaacggttcgctgtcaatggtggcgatctaagttgagcgtggagctttgtacagtgggaaaatttttgggaaaatgcgaggggcttaagagaaatagttcactttggatcgaacgaatgcaagattctacactgatttgaaaggaagggtgtgcttagttcacgtcaaaattggaagtttggttaaaattgaaatgatgtgatgaaaaagttgaaagtttgtgtgtgtgtaagaaagttttgatgtgatggaaaagttgaaagttaaagtttggaactaaactcggccgaaataatgaaatcacaccacaaaatgcacaattccaacaatcaaaattcccagagaaaaaaatcctacacttgtcaagaatcaagaattcaagactcataagttccaatcagaatatgctcagctttctgaggctgcatctaatgtcgaccatgtttagcatgaactcaatcacaaattagctaagaatcaaatgatctgcaactcgcagcttggtgaggcatatgaacacaggagcacataactaaaccgatggtggattggagtccttcatcttttcatcagaggaagctcggctctctgaagcagaatggcgcagtccctcgatcatcctgatcacatcctccatcgatgggcgtcgatctggagaccttgatgtgcaagccattgctatctggagcatctgaacaagctcctcctcgatgttttgctgcttgatcagctcgacgtcgaacacctcggctgtccactcctctctgaccaccgagtgcacccatcttggtaggtcgacgacatcgtcattgccctgcgactggagtggagctttaccggtaagcatctccatgaggaggacgccgaagctgtagacgtcggatttctgggtgatcttgcggttctcgatggtctcaggagcgcgataaccgaccacaacgcgagatgcattggctggaacactcatcagggcagttagaccatagtctgaaacataagaactgtaatcttgatcgaggaggatatttgtagacttaatattgccatgggtgagcttggcgccaccttctgcatgaacgtgtgcaatgccgtatgctgttccaaggattatcttcactctggtgctccagtctaatggtgtcttttcagtaacacccctgatacctgccgaatgttcatcagcaaatcagtacaaaatactaccaactgaaagttaactattcacatttatttaacacaagtttcatttctgagtatgagcatttttttagtgtgcaggagggctgtacaactttctattgatacaagaaaatatgattagactccctacttaagctagctacagaaggaatatggatgcagctttaggcaagttcagctgtagtgaaaaattaaaatcactaatatcctgtgttagtttaaactttattaacatcgcatggatatatcagtttacaaattttaaacttaatcagtgtaggcgttcaccttttaactaatgtgggactcttcttatgtttactcattagccaccgcagctatgagtctatacatgtaccagtgtcttgcaaaaaggatgaaaggaagaaaagcataccatgtaacttggttgagaaactgccattggtgagataatcgtagacgatgagcttctcgtccttagaatagtagtaagcacgaagtgggactaagtttgcatgtttacctaacctaccaattagttccatctgttgctcaaactctttttttcctgccacgacatcttttagtctcttgacaacaacaacggtaccatcctcaagtatagctttgtaagcagttccataacttcccttgccaaggacttctgcagaagctctcagtagatcctccaaatcgaaggtataggagcaaccctccaagaaaaccaacttgtttttctcggcgatctgaacgccactactgaactcctgttttggcttctcacttctgacaccagtgcccttacccttgtagtccacaccactctctttcttgcctttcctctttgaattacacacaaccaacacaaccacaacaaacatcagtactgcgaagcccccaacagcaactgcaattatgaatccggcgccaaactttttctcatgatgcgctgacattggagttggtgctgatgaaggggatgctggtgaaggcgtcggtgaatcaggaagcaagcatttagctagaggtggcccacataatccaggattccccaagaatgagccatttggaaatgtttgaagcgactgaggaatttggcctttcaaatcattgttgctcagattcaatagtctcagacttggaagcttgagatcagggatggatccagagagagaattttcttgtaaattcaggactgataactgagaaaggttttgtaagcttataggaatttcaccggtaaaggaattgtaggagaggtccactacactgaggttaggattcaaaaaggaaggcaaatctcctgaaaagttattgtgctgaaggtatatggatcgtaaggaaggaagcgtagtcacatcagatggaaggcttccagctaaacgattagaccgtaagctcagaacttggagagagtcaagctttccaagagtgtttggaggaattgctccaatgagaccagcacctggtacccttaattcaaatatgtgtgactgatctcctgagcattttacgccatgccaagaacacaatgatgtgctttgactccagttgagcctgttgccacgatacactgcagaggcaaagtctagaagggcttgcttttcagaggttaagtctgctacagacaagggattgaacaacaaaagtgacaactgcagtgagagcagaagagacaaaggatttctaatactgagatgatccatttgatgaatctccaaatcaggaactagacgagcagcatcttcgtttgtttatgtcaaataagtagccgatcctgttgaaataaaagtagcgagcattcagtgataacagttaaaacaactgcactaagatttcaatcgtagctccaaataagaaccgcatttcatcagaagatagcaaataaaggttaccaatcattccttgtatgcttctaaagtgcccaaa

SEQ ID NO: 23872 - DNA, 19632 bp, Oryza sativa
ttggaaaagaagtaaattgcatcaatatgtaataattacagatttcccattccaaacatgtgtagcttgcatctttcagtggtaagatttacatgaggcccggttttactatctctctagggggaaccagaaaccaggcatttagattagagtactaagcaagtcatggttctcaatgactctgtgccaatgtcaagaacatgaacatgaaattgacacatggtaaaaaattccaccctcaaaggatggcgcccattaaagtctgaagacaagaaaacatgccctaaaaaattgtgggcagaaagtaatggggaagaaggaaaaagaataggaaaatgatacggtcagcacacaaaagccaaaagcataaccaaagcagggagaaaagatgagggcaagaacaaagctgaacccatcataagttcataaccccacaaagatgagcatatcacatcatgtatttactgtttgctacttgcttagatgaaatactagtaaactagcctagatgagcctagcatcaggcatagaatgcttacactggcaacgcagtagtactggccgaaccgaactaatttatcatgcaacagctttctgcattcttaggagcaaaatggagcaactttctgggcgccaaatgcggcatttgagcaacttgattagagaagccactaggcaaatttgaaacgaaaagaggaagcaataaaggcaaaaccgaagctaatggaagattgaatatgggaaggtggcaacgactgatagatttctagtaggagttatgtgggaaactgctgcacatggcaatgtgggtgcagatttactacattgtttactgactacaagatctggagcagtacatgatttcttcatctgcacttaaagagaacccaatttattaatcacggacgacaaatgaataatgtgcagtgctccaaagtccaaagcccaagctcagaggtcagcatccagttgtttgcaaggatccacacatttctaacttgtactagcatccaaccccaaatgaaaactcagcattcagaccggaattccaggaagccaggcgcccagacttatgtataccgtatagatcaagtaactcaattctgaactcttttttttttttttgcggggaaactcaattctgaactagagcaggaacatcgtaaagagaaattacaacattattattgcctctggttaccttgctagatccgccacgcaagcaagtatgcaacgagaacaagagctggagctcaagaaaagatccagtctctgaacatttcgagctaggaaaaacagcaagattgaaacaaaaaagagtaaatttaatggaataatattgcggataagtctcctctattatttgtccgttccgtagcacagacaaaggaaataggagttctagcttctaggacggaaaagaatgttatccatcaaattcacctgaaacggcggcgtgcagtgtaactgagcagtgagcatcaatcagctagaaataggacgaatgttgcaagaattcctagaaggaaaattaagtaaaattgggtttcgacgaagtaaatgaatgaagaaaacctggaaggacgagcaaagaatcgatctttccaccccaaaaatggtacggtcccgctcataattactcgcacgaagcgtacagctgaaactcgaaatgtaagggcataatccgaaacggtcgccgctaaaaaaaaaaaaacgtttcccccctgaaaaataccttgtcaatctgaagaagaactcgtaacaacgcgacctgaaactgaaagaactctacgggagcagggcggcaaccaaaccagaatagcaggagatgaatgcgaaggaggagcgtcggggtacctccacggcggcggcggctcgtcgccggtctgtacagcacagcacagcccacggaatcccgtgaaatgcgcgcctgcagttgcggtcgctagggcggcgctcccgcttccctcggcacggcagtagctggggtagttgatccaacccacacacacccctcccttcgcggtcgcagcagagtagtgtggtaaaaagcgagagaccgagaccgagagcgtgtgtgaagtgtgaagagagaggacttcgcttgcggccagcacaggagagagagacggaaaggaggcgcatttatggcgaggaatgaaacaaggccagcaacgcagtagtatggatccaccactgtactctcttgcttacaaatcactctcccctcttttgtagcagtagcagtagtagtactactgataaatgcaagtgtaaatgctgttttgttttgttttccccttctttttcgattctactttatggttgtgtttagttaacactgaagtttaaaagtttagttaaaattgatacaatatgataaaaatattgtgtgggtatgaaaggtttgatgtgatggaaatttgaaagtttgaaaaaaaaaacttggaactaaacagggcctatgtaatactgacaaatggaaatggaaatggaaaaaaataaatttaagggtttgttttttactccaacttcataattttctaatcattttcatgcgtatgttttccgaactattaaataatatattttaaaaaaatctataaaaaattgctttagaaattatattaatcaatttttcattttttaaactgatacttaattaattatttgttttcagtgctttgttttatgcgctgaactcaacaaggctgtcgtaagaagaactacgcttagttttgatgggttatttgacttttctggtaatattcgacagtataaatgaataaatttatttacaaagttgaaatctttgtttaataaatgtgttttataaactttatatataaattctttaaaaaaatatacgttttagtagacttggaaagagtgcccgtgattaaaatggggcctttgagtaactttgcatttcaagaatgaaaaacagcccggtacaagtacataaagtcgagaaatgattgaaattggtggtggggtttttttttctataagtgggcaaaagtattactagtataccattggcaaaaaaaaaacgcaagtatcaaataggattatgatttgtatatcgttcaatctacaccatcgatgtcatccgagatccgactgctacagctatcattggagagtagtatctgagaataaacacagatgaacaaacatctctggacttgatctattctctcccgtgtagcagattgcaacggttagagtaattgcgaaatagcaatgcatgtcgtgcaacgtacagatgcctctagtaatgagatggtccctgcaataagtaagggctccttatggacaaagtaaaaaaactaaaaatagaggattgttttattgaaatcccacgaaaaaattttctagttgtgtatttggaacaaaagaataggtatttaagattcctactaaaatcctatgtaatggctttatttatggaaatttttaggatttctggacctcgtgagaaactttcgttatatctatatttctccctgaattatatgcttttcctatgaagcatccaaacaataagttctaacaattcatgtgttttagaatatccaaagattcatctaaacatgccatttcgattcctttgtttttctgttactatgtttttcatctactagttcctttggagaatgggaggcatgctcacttatgcaattttgttcaactgtcgttgcaggatcttgctggagcggtgccttagaaaagaaacatgacaaggatctactgagttgtcactgtctcaacccgacaataatagaggtacagtgtcagtacggtagaccgaatttcagttcaacaaagcattacttgttcttaaaaaaaagaaacaaagcattactgctactacctccgtcccaaatccgcggttttgcactttttatattcaatgtttaaccatccgttttattttttaaaaatatgaatggtatttttattattattggatgataaaatatgaatagtacgttatgggtgactgttttttaaaattcgttatcatatttttttaaaataagatggacgattgaactttgacacgggaacccacaactgctcttagggtgtctttagttcacactaaaattgaaaaattggctgaaattggaaacagaaaaaagtcataaatttatgtgtatagaaaagttttgatgtgatggaaaagtttaaagtttgaaaaaaaaagcttgcactaaacacggtgttaaattgggagggaggcaggagtactagtatatatactataactcctcctgtcccattttaaacgtagctatgaattttcgtattcaactttaatcgtccgccttatttattttttaaaaaaaactaaaaaaacataagttacacataaattactatttatttcatcatctaacaacaataaaatattaaccataaaaaattaaaataaaacagaaaattaaaattggatgggaaaacttattgttgtgcttaaaatgggacggtggagtactatgttacagatgtgttggttggctccatcagtgtgttgtcatctcttcacggtttttgtcaattcgtaaaaattattctatttttattctttttcctaatattggctgtattagtatgctcttaggagagtttgcaacaggttcaaaatattcaggttatgacacaagcacccacctaaccatgttctatatctactttgactaaatgccaatgcgtttttttattccatacacatgcctttcactcgcgtgaacggtagtcaaatttgatactagcacacgggtgtgagaattttgttaagaataaatgttttaacgctactgctatctagtatttcctctcacagcgaggtcagttgggtttaaccacttttccgttcaaaaaaaagggtttaaccactttgaaaagtttctgtcaatttgaaagaaatatttttatttttttcctattattggttgtattagcatgctctggtgagggtttgtaatttgggttcaagttttttcggaaccctccaccccctacccccaaaaaagtcatttattttccattttgtgaatttcgctaaatttatttaaatttgattttttttccttcaaattttaaagaatgcattctaaaaatttgatccggtggatttgtgcgtaccgaaatagtatatcatggctatgagaaacaacataatgattgtgtgcactgagaagggaatttcggatgtcatgaaaaagtatatatattctcacgtttttagcaaacgaacctaagtactctctctatttcatattataagtcatttgactttttttagtcaaagttttttagattaattaaatttataaaaaatagcaacatgtacaatatcaaattagtttcattaaatctaacattaaatatattttaatagtatgtttattttattaaaaatattattatattttttacaaactcggtcaaaccaataaaatgtttgactatgaaaaaaattaaacgacttataatatgaaatggatggagtaattcactattttttattcaggttatgacacaagcacccactaaccatgtttgtcttctatatctactttgactaaatgccattacgttttatattccatacacatgcctttcactcgcgtgaacggcagtcaaattcgagcagcacacaggtatgagaattttgctgtgaagaaatgtttcaccagtactattatctatttcctctcacggcgtggtcaatgggtttaaccactttgacagagaaatggcttggactagcttcttggacaagatgtgcttaatcacgaatcttgttttattgcaagccatgtcgcttttgtcctgtcctggaggtgatggaaacgatttttgatccaattatcgcaaggtgacgtcgaattcaggttgccgtcattgctgtgactgaaaaataacaaaacatgtctgatgtccctgcaatcctgcatagacttttcagagaaaaagaacttgcgttaggaaacaaagaggaaattgatgtgtattgtgcttgactgttcttctggaatctgcaccgaaaaaagcagtttaacgctgtatggttggaagcagaagttgagccaacaggcaacagccagccagtgattggatcaatgcagaaatgcagcagtgggcagtataggcacatgcaattggcgtctgctgacagtgtggaatcttctgcttctgcagccagggtctactacttactaatccagagtttgttatactactattaggtttgtgtttatctcagctttgtttatcatttccatgattccatcgtcagggttcagttcattgtggggcagctacctaagctagcagtttcatcagaagatcagcagaagaaaacaagtcacaggctgctacaagccaagaacctgcaggtataaggccattggaagatgtggtcaacacaaggctaacaatattattatcccaattggccactgttttgtagctggttcagtgtcaatgcagccaaaagcatgcttgcaagaaacagcatacggcctccatcttgaaagacacttatctctcaaaaggaattattaatatgtagcatataatatctgcagctgcaagcgtagtgccgatacgtatgctgcttgcattgtcatcttgcagctgtttggcatgtaggtcgatccgtatgctcatattttgtgatatactgatatgtgctgctcatgtgatgcagtggaccactggtacatgctaggtacgtatgtacgtgtattatgtcgtctgtagtacataacatgacagttattcagttaaccatcattatttttaccaggcctaatcgcacggaatagtaccacaagagcagagccagccaccgagtgagagtggtccgacgaccagtaattaatttttggctttgttagttaggctgtgtttagtttcacgttaaaattataagtttaaaaaaattaaaataatgtgatggaaaaattaaaagtttgtgtacgtagaaaagttcgatgtgacgaaaaagctgaaagttcgaagaaaaaaatttaaaatctaaacagggccttagtttcagtagcggtggagtaggtactgcgggctgcatcactagtgttgaacgataatactgtaagtacggagtattattcaatctgcaacaggatgttgttgtgttgctggtagaatcacatcgcccattattgcactgtcagtaatgcgtttcatccacactacagtgaaaacgggaaggaggtgaggtaaaaagatgggacgtgctacgctgaggctccacttctgttacgatctcgtcgaaatgtgataaaagggcgcgtgcgggccggatctagattggacgccgttgcgctgcggcaagccggcaacgggccgtgtgcgtggcctggcctaacaagtgaaagcagtagaatcaggcctgctggtaccagatggatgggctcacatcacattaggcttgctcgcttgtatctacttcctccattcaatcatttcctacatttatattgatgttaataaatatagatatatatatatatataatgttagaatgacttacattataaaacggagggagtacattgcaagcagtagaaattgtgaaattgtgtgcgtttgctgctgtgcaggcgtgcagccgcaacgatctctccctttaaaaagaagggatttgcagaaaagaaaacaagagaatattctatcctttttttcctccaaaacctttaactttctgaccgtttgatcgcttcaataattttgcaaaggaggagacaggagtcgagctccaagtcccagccctagtaggtacaggcatatcgcagtagccaactggccacacgcttagttatgttcgatcacgtaccacttacagtatatataaattatagtgcattcgaactatattaatgtgattacactttagttaaactataattatgtttgaaatttgaaagtttttcataaaaaaattatcgaaagttgcgtagatactccctgcaagaagaagaaaaaagaggggaaaaaaaggcagcctgcgtgccattgtaaagcttggagaccaaaaactggagctgttggatcatgtctcaggccggcccctacccaactttttgtcatcaaccaacttttttccttcctcacaatcaatgaatcaaagccacctgcaatttccctgttaattactccctccattgctcctttatgctcgcccggcgagccgggggatgcttcttttgctaccttgtctgcatgctgttcctggatatcacggcagcaatatatgcacagatgttcttcttccccaacactggcatcccgtccgttcagctaattgttcctcacaaaatgtcttctctgtgtggctgccatcctctgaagattctgattaaacaagtcgttctcgtcatggcaatctctgtacacatgcctacgtctcaaggcagcaacagccaacaacctaacaacagtgctcttcctttacctcctcgatggaccagtgaccaccaacaaacaacttggatcgatccattctgcctagctagattgctagctatagctactagcttttggtccctgcactgcatctgcatgcatgatctatgtcatctgtgtttaatttgaaataacagccatgatcgatctccacgaccataatgtatcggatctaggaggcgcattatcgctgacacaaacaccatatggacatcgatcaattgattaacaaactccccgcctgtctgccggccagtatgccattgcaagtgtagcttggatagtggcttcttctgttcatggttcagttcattcttatttagttttcaagatttgctccggtccataaaaaaatatctcgaggtaccgatacctcacggtactaaattgttcccgatcattggatttagctggacaagatgtgtattgttagatccaacgaacgaaaatgacttagtaccgtgaggtactagtacctcgtggtattttttattgtaccggagcagatcttttgttttcctatttgctgctcagtggtagcacctccagtaagcaccaccgaatctcttttttttcccagtggaaaactaatgcagggtttgacctctagctagccatagctgctgcactcctgtcacaaaaaccaaagttttcccatcgatcttgggccagttgacgacgcatgcagcagggtttatcttatcgtttgggccggggttatcgccactccgcggtagcgcgataaccgtgataatcgtgcgataatcgtctaaaatcgcacaaaaatcacatccaaaaatttgaattcaaaactcgtcggtttcgcggtttcaccacgataatcgcacggtttaccgcgataaccgcgatattcgcattgttatcgcgggctgtgtagctgaaatcatgtaaatgtaaaataaataggataaaaaaaaaatcaaaaatacggttaaatatgtgtagaaaactagaaattgagaataattggaagaatatgtaggatacttaaggcccaatatcctcttattttttcaatttgtaaaccatttttggttttaccctcaaatttgaatttagcttactctatttcaaaaaaattcttcaccattggcaattacaaatcaagaactatatccatgaattttttcagtttttttttatttttttccggaattttgaatttggtcaaaattcatccaaacatatcgccggtttcccctatcgtacccctgtgataagcgcgataaccgtgataatcgcgcgattatcgtgcgataagtgaaaccctggcatgcaggatcagacacaatctcatgtctgcatcgatcgttctcattgttggatcattcatgcggattagtacatgtgtgcttacacaatttacacgcccgatacgatacatgcatcagcgacgagcagcagacaggaagacagcggcaaaaagggagaggtgacttttgctccattcctagtacgttgcacgaagcttcatccccctttgctcgatcgaactagccatctaggcgaaaaatgtcaacttgcaaatcttaacacggcgactacaaagccttctacttcctttaagctcgtattgctgctgctaggatggtccaatgggcacccactccactctagtagccattgctttaatttatcagagcaaattaatggaccctgcatacatcagctgcacacatcctccctcttctatcaagcattttcttatggacaaatatactaatcccatgctcaaatgatgtatttttgggaatgaactagttggttggtgtatgtaactgtaatcgatcttctggttaattaatttcagtttaaagtttctccagggtgaactgaagaggcgtatgtacagcatgcgcagttgctgactggggctgcatgcctcagtcgattgagtccacgtttgtcacgtacgtaatgcgaagtgcaaagcgcaaatggcgcatgcagtggcaaacacacgcatcaggacggcgtgggtgaggtggattcactcagtagctgggacctaatccaaaagaaaacgaggccgatttaatctggacgatatctttgcgctaattcgtcgctgagatcatgcacacgctttgtttaatccagcagcatcgctcgctttctgcacagggaattgtcgaccaaaaggcagcacgggattaaagcgcgcgtacgtacgtgcgcgcgcgtcgcccataaaatccatgcattgcaacctctcgatctctctccatctcgctgtctgcgagcgacgacatggccgctctcgccgtgctgctgctggtggttgcggcggtggagggcggcccggcgtggtcgttctggccgccggcggccggcgacgagccgtactgcctcagctggcgggtgatggtggaggccaacaacgccaagaactggcccaccgtgccgccgccgtgcgtcggctacgtctggagatacatggcgtgggggcagtacgcccgcgacgtggccggcgtcgccgaccagatcgccgcctacgccggccagctcgccgccggcgacgacggcctcgacgcctgggtgttcgacgtcgacgacacgtgcctgtccaacctcttctactaccaggcaaagcaattcgggtacagagattgtgagattgtcatcactgatcactgatcagactagctaacatacgtgtaatctattactccatcctgtttgagttcacaacgttttgacttttgtcagagttaaaatgtttttaactttaattaaatttgtagagaaaagtagtaacattttcaacctaaaaaattttattataaaaatatattcaattattgatttgataaaaactaatttagtattataaatattatatatttgtctataaatttaatcaaacttaaaataatttaattttgaataaagtgaaaacgtcttataagctgaaaccgagggagtaactgttaattactccaattgcttgatgatcgatcgatgtggatgcagggcgtatgatccggtggcgttcaagaagtgggcgagcaaggcgatctgcccgggggtacctggcatggcgcagctgttccagatgctcagaggcagaggattcagagtcttcatcctctccggccgagaccagcagactctcgcctccagcaccgccgccaacctcgccgcggccggcttcgccggctacgaccggctcatcatgaggtagacacaataatatactccctccgtttcaaaatgtttgtcaccgttgactttttagctcatgtttaaccattcatcttattaaaaaaaaattgtgaaatatgtaaaactatatgtgtacatgaaaatatatttaagaatgaatcaaatgatattaaaagaataaataattacttaaatttttttaataaaatgaatgaccaaacacgtgctaaaaaatcaacggtgtctaacattttgaaacggataaagtataaaaacatcatcagaaaacataattgggcctaaattaatacatacccatattgggcctaacttagtagtactggatcgaacggcccaaaagaataaaaaaattaaggcccatgttccatatttggcaaacgggggtaagcgtcagtcaccaatcagccagcctaaaaggggacagacatttccatggtgtgtgtacgtcgcactgtacgagatcgatcgtgccagtttctcgtcctcatggccacgacacatttcgtgcaagatcatgataatggaataagaaaacagggagctggataattagcatatattctcaactgcagacaactagtactagaagatatagctgattgctaatttgctttcgacggcacagtgcgtcaaaggatatttttttgtaagtacatcgaatttgtgtggactgcaatctggagtagctcgcagtttcgatgatttgcacgtacgtgtgccaatctcatcagctgtaggtagcctctcaccgtctgcatgcttaataaattttaaagttgattttaagagttaattttgttagtctattttcagtattgacttttaaaccaaatacataattttagtggtttcgtttattttgagcatgataacttgaacaatcaggatattacgttcaaaattaaatctattatatgcagaagcgcggagtaccggggaatgagcgcggtggtgttcaagtcggcgatgagaatgcagctgatggaggaggggtacaggatacgcggcaatgtgggtgaccagtggagcgatctgcagggtgacttcgtcggcgaccgtgtcttcaaagtgcccaacccaatgtactttgttccatgataatatgatactctaatcgcccatcaaacatgtgttcgcacatacgcacttcgttacacggagtatatatgtaactatttcttttttagacagaaaaaaaaggttgagtaaattacttaacaggtctagcttgtatacgtagctgctgcactatcaatctatcactacttgtgtacgcatgcaagatgcatggcaatagccagacaggaagaagcagagtcatctttcttctctgaaaccactcgcacagaaaccagtgttatctctcgcggaatcctcgatccttctcctagatcatcacacttttcaagtaaacaaacaaccacgtgttgtgttgataaccaaattttacactggagacaagttatagcaagctttaaccaaaatgaaacaatatcagaacttttcagcgaagaccagtctaaccgtcattacgtgaccgatcagatcgaacaatgcactgcgatcagaccgcatgtatccagacgatcagaccttcagcatagagtccgagtctaatttagatacttctcgtgtttccttgttttagatcgagatttcataattgattcatgagcataattggatatgggaaagaccctaaaaacaagtttcgccactcctataaatataaggggaccaagactgattgaaacaacaactaataatcgtcaaatcaatttagtatctaacccaggtatattctatatctctccccttcttgctatctatcccaagtctattattctcaaatcccccaattgtttgtcatatattgtctctacgacgttagatgacatcgtaactaggctgccgagtctagaacaaaccgacgtgtgtttaccctaacaagatccctcccaggtgttcgttcggtgacttctacacacttgctacggcggcgcatctccgggtgccgctgcgggttgcacataacgtgctcaaggtgcagcagcacaattctacgttcgacacagttcgtaaaaaacaataacatagaaacatgctttatctctaccaaggtttacgattccgacaggccctttcgtttcgggcactggcgaaattcggaatttcgcgaaattcggtagaaaaccggtaaattccaaataaatttcataaactaaaatttgaatacaaattccctgagtttgccgacaagttttagcgaaattctgatcaaaatcatcgaaatttcaatcagtaatttgtaatagaggtaatttgctgaaatttttttctttcctgatgtaaatttcagtaaatacacataatacatctttttttcaaaaaaattatatcccaataggttctatgaatatcatagtatttataagatttttttttatcaattcaaatttgaatttgaatgaaactcctcgaaatctcagacggtttctactttcgagcctcgtcgaaacatcgaaatttcgtgaaatccgaccggatttcgttagaatcgtaaaccctattctctactacttttaaaagcagagtcattatcctcctccaaaaccatcacactttctcaagtaaagcaaaataaatgtggctaaaaaacatcggtacaaatccgatgatttctttaccgcggactcgtccttttccaatcctcccgaaccatcatattttctcaaagaaaaagaaaacaacatttctttttttgcattaagaaaaaacaaccatgccttgaaaaaccacctatgcaaaaaccggtgatcgattaaaaaacgatgttcccactcgaaaattgactaaaagaattgggtagaaaaaatcaaagccataaaaccgttcgttttcgtcttaactattgtaattcatgtacatgatgctggttaaaaagtactagaataacgttttcagatgcggtccaatttgtaccaattggggggaaaatcaatatctatcttctgattagatgttctaactaacgaatcaacacacatagcttcactagaacgcaacgcgataagttatttatttttttcagtacgtaattatacttactgtcagtaaatttttcaagttaaaggccacaattatacttacccttcgacatgcggatttacaaatgaagctcccagttagctaatccgccacgtacgaacacactccctatgtaaacacgcccaaaaaaatattgatagcctagcatatatctagttatctataaccagtgatggatccagagaaaatagtggagctaactgaataaactagataaaacataaacctctatttccctagatatatgacaaataattttagaggagcctcagtgggagctcttatgttcctaacatcggtagtggggactcgagatcccttaaacctatggtagatccgctcctgtctataccaactgaagaatatcatctgtaacgattcgagcacatgttacaatgtaacagctatatacgtgacatatcatctataacggatgaagattgggatgctcatccgtaacggccgtctataccactcattacagatgagtgagtccgtaacggttctccgtaacccgttacagatgacctgacacatggttgagaatctgtgtgctagtggtacgtactttccaagtcgacccgaggtgggcccgggcgtgatatttgtctcttccccgcggcgaaacggccggcctcgccgcacgtacgtttactcccagcctcccaaagttggcatttcatcgatcgaactctagctgtacctcctgcctgccctgccctgccctgccctgcactgctcgatcgtacacacagtttcattccatctccaccagctaaaagcaagccagccagccaagctctgtcttccatcttgcatacatcaacgtcagaaaaatcatcagatcgagatatcgacatggtggtggtggtggcggcggccatggcggcggcgagcttgtgctgcggcgtggcggcgtacctctactacgtcctgtggctggcgccggagaggctccgcgcccacctgagaagacaagggatcggcggcccaaccccgtccttcccttacggcaacctcgccgacatgaggagccacgccgccgccgccgccggcggcaaggctaccggagaaggacgacaagaaggcgacatcgtgcacgactaccggcaggccgtcttccccttctacgagaattggagaaaacaatacggtacgcacgtgtatatcgatcaacgatcatatatccctgctagctgctgtttgattggttgcatgctactactgctctgcccatgctgtgtgatcttcgtcttcctgcctctacataaaacagaactcaccctgtttagaacaagaaaagaataataacagaattgctaggtttcttgcgacatttttttttttgaaagaaaacttttgattttggaccgttagaactgctataagattcatgtaggaaagttataatgtgattgtacctttgctatatttgattttttttaaaaaaaaattgcgccagatttttaagatagtttttttaggggaaaaggagatatattactcatatatggcgtcaacacgcgctaaatgcatgatgaaattacaactgtttcctagccaaacatttgacaaggattcacatctagctttatttgctaacaaatgactgatcccattttggctgccatggatcttcattagcttaatctccctgctcccagaaaggagatagttaggtcatgtgtgtgtaaggaagaagaatctgcccggtggtaaaggagtaatcaacggctgtaatcaatcgatttaattactaataatcattagtattaatcatttccaactttcggtaatgaatggatttaaatatatatagtgaagatttggttctttctacaaagtaaatagtggagtactactactatatatgaaaagtttcagagtacgtatactatacgtccgttcattaatagagcaacaaaagcatatgcatgctgataggaaagtttatctatccctcgtttttgcatgctgactgtaaatactgcatatatgtaaagtcaaatttattttttaatctatgcaagtagaatttaaacatgcatttaagtataacgatactactatatctatattattaaatattttcttatgacttactaagtgatatgcaccaaacaaggagccgtctcctttagggtagttgtcgatttcgagcattcatatcaattgaaaaagttattacaaaaattaaaaaaaaacaagtcactcataaagtgttattcatgttttatcatctaataacaacaaaaatattaatcataaaaagaattaaataaaacggacggtcaaacgttgaaaaaaaacccacaactatatttagaatgagacagaggaagtaattgataccagtagtgcaatatagggcatgtttagatcccctagcaaaattttacatcctatcacatcgaatgtttgtacaaatgcattgagtattaaatataaacgaaaaaataactaattgcacagattacgtataaattgcgagacgaatctttaaagcctaattgcgccatgatttgacaacgtggtgctacaatatacatttgctaatgacggattaattaggcttaacaaattcgtctcgcggtttacagacggattatatcatttattttgttattagactacgtttaatactttaaatgcatccatatatccgatgtgacatatcaaaactttatcccatatatctaaacacagccatagcattattgagccgtcagaatcatgggcagtctctgtggtgttttgtactgtgtctgggtttgcttcatttaattgcaccgagttccatcgacgagctagcgatagagagatttgccatggtatgtcattaccacgggaaagttgtgtccttttcaggaatcgtagcttgccagcgttgcacgcacagccagccactgtacgactgtctagatagccggccgattgcacgacgtgatcgatcgaaatatattttcctcgtcgattgatagcgaagttcatgtaactagcaaacagcagcacgatctcagctcacatgaaccagcaaattataaacatgcccccagtttggagcaaattaaacggctccaggcatacgtgcggtgtactcctgttcataaatgacctgcgcgcactgcagctagctagtgcaggtgtgtgactctttgatgtggatttgatccgtcctcccgatccgctagcgtcaatggaggagctacccagctttcatgtcagctagtgtagttttgtcatgttgtgaacattcgtccaagtagactaatggtatattactaccttcatttcatattacaaatcgctttaatttttttctagtctaatttctttttagttctttcagtaaagggaacgaagaatatagcgtgtactttcaatttccaagcacatgtttagataaaagggatagtttgaaagctttgtaaccgactggtgcatcttaattttgctcttggtgttaggcccggtattcacgtattcagtagggaacatggtgttcctgcacgtgagccggccggacatagtccgggagctgagcctgtgcgtgtcgctggacctcggcaagagctcgtacatgaaggccacgcaccagcctctcttcggcgagggcatcctcaagtccaacggcaacgcctgggctcaccagagaaagctcattgcccccgagttcttccccgacaaggtcaaggtcggtgtatcttctcaaggatagtaaaatcactggctcgttaattaatcttccaaacaacatctgcaagcttagtttgcaaatgatcgatcgatctgatgtattttcactaacaaattagtgtctcttaatatgcaaatgtgatcatgtagggtatggtcgatctgatggtggactcggcacaggtcctagtcagttcatgggaagacaggattgacagaagtggcgggaatgcactggacctgatgattgacgatgacatcagggcatactctgctgatgtgatctccaggacatgcttcggtagcagctacgtgaaaggcaagcagatcttcgacatgatcagggagctgcagaagacggtgtccaccaagaagcagaacctgctcgccgagatgaccgggctcagcttcctcttcccgaaggcgagcggccgcgcggcgtggcggctcaacgggcgtgtccgcgccctgatactcgacctcgtcggagagaacggggaggaggacggtggcaacctcctcagcgcgatgctccggagcgccagaggcggcggcggtggcggcggcgaggtcgccgccgcggccgaggacttcgttgtggacaactgcaagaacatctacttcgccgggtacgagagcacggcggtcaccgccgcgtggtgcttgatgctgctcgcgcttcaccctgagtggcaggaccgggtgcgagacgaggtgcaggcggcgtgctgcggcggcggcggacggtcgccggacttcccggcactgcagaagatgaagaacgtacgccgccgacacgcatcaaattgttggcattgaagctcgccgaagctgatatgatcgtgctgtttaatttgcagctgacgatggtgatccaggagacgctgcggctgtacccggcgggcgcggtggtgtcgcggcaggcgctgcgggagctcaccctcggcggcgtgcgcgtgccgaggggcgtcaacatctacgtcccggtctcgacgctgcacctggacgcggagctgtgggggggcggcgcctgcgcggcggaattcgacccggcgcggttcgccgacgcccggccgccgctgcacgcgtacctgccgttcggcgccggcgcgcgcacct

SEQ ID NO: 23873 - DNA, 20918 bp, Oryza sativa
  unsure (1)..(20918): unsure at all n locations
tcggcctttgtgcgcagcgggctttcagcccatttaaattataggccgaaatacaggcctgtccatgtgtgtaggccgggattttagttcaaaattcggcccatatgctaaggaggcctactttacagcggataatatgcagtgtaactgcaaacctagaaactatcgatgaatgaaaataggggggcgcgatcgcctaggatccggcccccctccccctatactcctccctaccctctcctattcctcctccccttctcctctttctactatagtagaccacacaatttttttttgaaaaacaaaagttagaaaaatttatgtatagaaatattatatataaaaatttgaatttaaattcaaatttgaatcgggtatgtaaacttttgacttataaactttgggtctataaactttaggtgtataaactttagatgtatagaaactatatatagaaaatatttgaattcaaatttaaatttgaatcagatataattcaaattcaaatttgaatcgggtatataaactttaggtctataaattttaggtctataaactttttaggtgtataaactttagatgtatagaaataatatatatgaaaaaaattcaaatttaaatttgaatcggatatttgaattcaaattcaaatttgaaacgggtatataaacttttgacctataaactttaggtctataaactttgggtgtataaattttagatgtatagaaatactatatatatataaatatttaaattcaaattcaaatttgaatcggatatataaacttttgacttataaatttttggtctttagatgtgtaaactttaggtgtataaatttactaaaataagaaagtaatgcggtgtcaaaaaaggaaacaaggtggagaggtggagggagggaagggagggggcgcaaaactgatctccctaggcgatcgctcgcccagtagcattcctgatgaaaatagacgtatgagatttatccacatcacaattagtaaaatattcattcctaaaattaactattatgatgtagtagaacagaagtttcactactgatgatgacgtgaataaatttcacacatctattttgtatatcttatgatagtattaggtttcgactatatttttgtagtttacaagctaaacttttctctaaggtcgtttgataatcattatagctcccgaatgtcgtgacaaacataattttgacgcgtcgggcagggttagttgagcattgagtgcttgtcatggagaaaatgactcagggttcaggtggcccccattcttctcacggattgagcttcatttagttgcatgcatgtagaccactagactactccatctgtcccacgatataagagattttgagtttttacttgtaacgtttgaccactcatcttatttatttttttttaaatataaaaaatgaaaagttgtgcttcaagtattgtggataataaagtaagtcacaaataaaataaataataattttaaaaaaaattaaataagacgaggggtcaaatgttgtaagcaaaaacccttatattatgagacggagggagtagttgtacagccaagtagccgacagccacccactcggcatgagcgtctaggcgcgctgacaacttaatccacattaagaggagattaagagaaaatgaggtatagtgcaaaccgttctacgagtatggcctcgatcacaactaatgaagatgaaaatcaagttttaattattataaacttaacaaatactctctccgttttttaatagatgacgccgttaactttttctcatatgtttgatcattcgtcttattcaaaaattttatgcaaatgtataagatataaatcacacttaaagtagtattagtgataaaacaactcataacaaaataaattataattacgtaaattttttgaataagacgaacggtcaaacatgtgagaaaaagtcaacggtgtcatctattaaaaaatggaggtagtatatttttaaatatggcatcaggttttgaactgatagcaggctcatctattgactattacagtgggtgaaagctgttggttatgatgtgggactgcccagcatttgctcctcaagctttaaacaaggaagacttggttgcattctgaaagaaaaagaggtcaactgcagcaggtcacgcggcaggcagagattctacgacaaagcatcgctttactactggagtatacaggttttcaggagcacttgagttttttcttttgagaacggagcaaagttgtatgtgctgccatttctcggttacaggcaaggaaatgcatagaagttgcattgctctgtccttgtctctgctctgccccgcgcaattaactctgcaccctttttttttcctcgcttaattctcgactgtttgtgtaattacataagacaaaattgctagtagatccaagcttaatggcagcacgtgagatactattgtaccccaatcaaacctaacacatcttaacaaatcccatttgaaggaaggcacataataacagcgtgtttggagggttttgatcaagtggccaatgcagaagtagttggcagatggtgcctactggctagaattcggcgatctaacctgaaaacgaactgaaatgcgcatgtgaagggagtagtttgagcgagtgtgattgttcttgcaacaaagaaagcaaaggtaattaaggtcgatggaatttctcagattaaatggcgctttaaaatggagatgggtatggtaggcaatcaatttcccgggggaaaaagaagaagaaaagaaactgacatgtcgctaaaaaaactgctccgcctccgcgtcccccggccgcacgcgtcgcgctctgtgctgctataaacgacgagagcctcgccgcgcactcgacgcgcatcttccgaaatagagaaattgccacggatcgagggcgaccgataatggaaggcgagcagcagcagcagcagcagcagagcgtcgcggcggtgaggccgtcgctggggaaggcgccgtcgccgtcgttccggctccggaacggcagcctcaacgcggtgcgcctccgcagggtgttcgacctgttcgaccgcaacggcgacggcgagatcaccgtggacgagctggcgcaggcgctggacgcgctcggcctcgaggccgaccgcgccggcctggccgccaccgtcggcgcccacgtccccgacggcgcggcggggctccggttcgaggacttcgagtccctccaccgcgccctcggcgacgcgctcttcggctcgctggacgtccccgaggacggcggcggcggcggcggcggcgacgaggagatgaaggaggcgttcaaggtgttcgacgtggatggcgacgggttcatctccgcctccgagctgcaggaggtgctgaagaagctcgggatgccggaggccggcagcctggccaacgtgcgggagatgatctgcaacgtcgaccgcgacagcgacggccgcgtcgacttcggcgagttcaagtgcatgatgcaggggatcaccgtctttggcgcctgaccacttcttccatccagggtagccatggcatccgctcaccctcacctagtaagtttcctcactgaagaagtccctccaaacattttttcaagtagaaattatgaacgtgttagggattgaatacggaacatcggggttgaaaccacacgccctttacgactacactaataagtttcctcactagtttttgatgaagataaaagcttccattgaattttcaagtcaagttcaattcacaccgatttgctagtatgaaattcaacatttttcactgtgtactgcaggcttctgaagttctgaaaacaaagacgtaagagaaggcactagccaatactagatcgcagccaagatcagtaggttcggtgtaatctttttaagcttaaggcaaggcaattccacttttgttgcagctacgaccttatccctgttagtgcctgttttgtgcatcggaatgcagtgcagggcctgagtttcgttttctgtggccttcattcgcacaacttgttgtgtggtgaggtggtgttgatattatacatctacatggacgtacgcttgctaatctagcgaatagtgatgtggatgttcttgaccctagctatctctaactttcacgtcaaccttaaaaattcggtgtttggtttttatcttccctttcaatagcaatccttatgtttcatttagattattgggtggattatattgctgtggtttatcaacttgatagataggtaaactaaataattcaagaaataaaattatcaaatagctgaatacaagctgtccaagtaatagagtagaagaaaattttgttgagacaacatatattttgaagcgtaaagcaaattatctgtttcaatatttgggcgaaaaaagttgaaaataacatggtcactttcacgcttgcattgcatggaaatggaggcacccaaattgctcggtaacttgttttcctggaggatattactactccatgttaggaccctgattgaaagtgaaacacaaaaattttacagttgttattttgtagaatataaggagccatgcaggtccccaaaatgcttggcaacttgtttatctgtcttttttttattaaaaaaaggtcgttacttcatttacattcctgattgaaacacaaaaaaaattgctgcagtaaatttgtaggaatacaaaaggtaccacagcatagcatattagcacatcacactagtactagctagtagcgccagtgtgcccacaggccgtatatacggcccagttcggcgtgagacttgctgggctgtggcgaaaggctgagtgacaccaatattgggcctcagtagatatcaaaaggaataagtctgtttgtctccctcttgtctttctgtttattgaatcgtctcactcaaccgtaaaattgggtataacacttctctcgtctttcaaaactggtgcacaacataataaacttatttggttttactgttgagagaggtgatttaatcgggagcaagagatgagggagggccattaaattattccataacaaaaggccttccagtcgcgcactagcccaacacaattgtgaaaaatggatgagacagatgggctgttagccacaggccggtatcagaaaatccaatggcccatggacgagctaccagtttgttacggcctactaccgtaagagcatgtataatagcagcctataagctagctataaatatatattttaaatagataaatgaatagagataagagcagtacggactccaatacgtaatgtgtgtatgacaggtatgatcagatattaatactatagtaaacaactattgtatgaattgtatattatattagctatagataatttgcagctattaattggctatactattaaacttgtcgtaagtgtcaatgtgtcatactgtcatgtcagtactgaatcactgctagtagtacactttataatagtgtgtcattgacgaagtttgtttgttttttttttacaaaaggtcaacgttcttatcggcggggttacaaggaaggacaacgtgttaatcatccattagcagctggtctttgcatcgtgtgatgaccatcatttctcattgaacgagtgaccaactcgatgattctgtcagtcccagtgagcgtgattgttttggttgcatatcgatcgccccgaccctaccgaaacacatggaaaatatcaagcggctcgacattttttcgttgaaatcaaaaaagagaacttgtgcaactgtttaactttaattgcactaaaacacttttgaagtcccaaaatattgatatctatgtgacatatcctaacactctaaatttaaatacaatgtgttcatctatcactagatgataatattttaatagagatatagtattagacaacatagaagaaacaagtgtcattttaacgtggcattcgaaaccaacttacatcggctatgaaattttattaggaaaattggaaccatgccattataattttgtaaaatttgagatatgtcatcctgacccacatgtcattgactcatgtgggttctagatgtcattgagataccgatgacatatctcaaactttgcaaatttataatggcatggttccaatttacccaatttttatttctacgtcaacaaagagacaaagcacaaaacaattgtaaagggaagcttaaagcgggcgcaagatctgaaaaatgactatagcaaaggtttactatgttcgttggtctcacaaatgacaaacacgaaaaaaacgttgcgtcagctcatacgtctgccgtggccacagctctccagatccgttgaaccttagcatgtgctactttattacgcagagaaactaatccacatcaacacaccatcactcgcacaaaacacactaataaatgaattcacacaatcctaagcatcatattttatcaatccgtttaaaaaccattgaaaacgtaacagcgatacacatagattctcaacaagatgaacacacaggtgccactctttttccccattgtgagccaacagctataacggtttactacatgggacaccatttctttcccaatcattcgtgcttggtcacagtcacccgatgattttgtccggtctccgcgtccgggcccacctgacaggcgtgcccgaccctcggatcagatcggacggcccagatcgatctgccccgccattttcataaacgccaccgcccgcacgaatcggaagactcgagaggggcggtccatccacgtgaggaggacacagttgcaaatttccaaatccaaaccctcgtcggcgtcgtcaccgtggcggcgacggcggcggcggcggcgatggtgcccgccgggggcgggggaggggagctggagaggagggtgatggcggcgctgaaggcgtcggaggcgcgtggggaccagccgctggtgtgggcggtggaggtggcccgcgtcgtcgccggggagggggcggggctccccagcgcggacctcgccgggatcctcgtctccaaccttgcttcgcgcacaactccccctcgctgtggaagctcgtcggccacgccgtggcctcccgcctcctctgcccgctccacgtcctcgcgctcctcaccccgaggtcggcgggggtccccttttcccagttcgttcgtggcgcggattcggtgatcttcccaagcattttgtgagtgactccttggcgatggtgggtttttgcagggtgctgccgcagcggcgggcgcagcctgaggcgtaccggctctacctggagttgctgagaagtaacgtcacatcctcctttctctccatggaggccgggcctaatcgagacaagtaagagttctgctttggaatgtgacatcggaaagtgtgcggtcatgaactttctcaagggcacagcacaatcagtagctatgattgaattttgaactggctcgaaatcacgaaatctcatgatttttgatcggttttcaacaaaattgtaaaccctgcaccgccaaattcaaagtaggggtatactgcaattgcctgtacttctgtagtatgaacaacagagcagaacgtactagtcgcttgtatcctgctggatgttgctaaaatggaattgctgtttttttttcctcaggataacaaagtccatcgatgatgctttgcaactgtcaaagatttatggattttctggaatcgacaatggacatgtcatcattttctttatgatgtttgtaatcaccaaactgatcgattgcacacttgaagactgtggctttccatccgggctgacagaggagcaggggagcatttacgctattgaagggccacaggatatggacttagatgtcaaaggggtttcaactgagaagcaaaacgagcaccgtgcacaactacgccggaagaacactgttatggctttagatgtgttgattatgatggttgctgataggaagatccaatcatttctgcgcttgatattcctgaacatgtaagtcatgctcagttagaggaaattgctatccaaatatccaattctaagttttttttttattgattcatatcatcgcaaatttcctaagaacctttaaagaatacaccttttctcctgacatactttgtgcgtgacgcacattacaaatgcctgctaatgagacagtttttctaggttaggcctgaaaagttcagtgtgttaagccagaggttgagcttggttgaagctcacaaaatggaattggagacactattgactgctaatcataaaattgatgatctgttgatgaatatgtggagggttagcaatacagcctatcaaccaaacaacaaaaggcttttgggtgttcttggtaacatgaaatatggtggctccatgctgggccagtttactggagctgggagagctgcatgctgggttatatttgacatatatgttgagaatgcaattgatggaaaacatctaagcgccatatctgctatcgaggttctgaaaggtgtgcatacacaatccgattaattgacataaattttgcctttgtttttctgtattcattctttaaaatggctgcaatacattgaactatctgtgtgccgtgagttcatcttaaatgttggctagcaatgtcgatgaacatggtttttgtaaccaacaccgccttactgtcaattctttatgagataacatgtttttattgactaatatcatgttgctcttaatcagaaatgaccaagacactccaagcaattaatgaggcgagttggcaggaaacctttaaagctctttggatttctgcccttcgccttgtacagcgggtaaatagaccttttctgtattggctattattgttgaatacacacacacacacacacacacacacacacacacacacttctattgtgtctcacatgtaaatgttctaaataggctagagaacctctcgaaggaccaattcctcatctagattcaagactatgcatgctattagctcttattccattatcaattggtgcaattcttaaagaagaaactgatgtccatggagctcaaggaagcaaaagtcttccaaaaacatcaggacttgtatcatcactccaggatttgatccagtattcaggacttctagtacctccttcatcagtggtaaatgcagccaatgctgcagcctcaaaagcagcagcatttaaggccaactataagtctggaggtggcaaccctggcatgatgggccaaaatgactcttcgacaaaaactggtacacttctgatactcaattgagatttgatcttatccataatattctccgtgtctatatatacttcacatttttcttcgttgacacgagtatccatgcctttgtgttagtggtgatagtagagattttttttttaaaataacaatctttctttgttcacaaatactcgcatctttctttctttcacatcttttatagattggcactaccacttttcctttttgttctatatgcaaatatatttatttttgtatgtaaagttgtttaggccttttgttcttaccatctatcccttttcagttgggaatatgctacatcttatagttgaagcctgtatttcaaggaatttgattgatacatcttcttacttatggcccggctatgttgtatcatctgggcatttgaaagatgcgacattaccccaagaatccccctggttaaactttatgcaaggagcaccactttcaggtccacttattgatgctctgattgctactcctgcttcaaggtatgcagttatactagcagcgagtaacttagtatagaaaattataaattttatgggctggtttgctgcactgcaatttttaagaaagaatactacctattgcacaacgagttatacccctggctaagcaaactctctgaattcttcaggtcaagtgtgttggatgcaaaaaaaaaaaagaaaagaaaagaaaatccaatgtgtgctgaactttccaggtttacatgtcaggaaattatatatttttatgacaaaaatggaaatttaattcaatcgaagccattcaccattaggagtttggccttgaatggttacacttacatcattgatgctactaagttcctcatctgaaccgaagaactacattagttccttacatctctctgtatgatatggtggatatccatattattagagcattttccagtgcatgcattgccctgtaatgtccgattggaaactatcctggagatggagtagttcaatcgtagccatcaatacttctctctgggagacgacactctgagagttggggggaacagatccccaaacctttcctaagatccatctacattgatctttactatctccttgctctatgacctcaatatccttacggtcacttatttggcaaccttttggttttcacatgttagagcctgcttgaaaaccagcaaatgaatagtagccaagtgaaccacttatcctgcagctaggaactttttcctattaccactttgctgcgtgtagacaaccaatgccacaagcaagatgataacttaaatgtgtaacgcttctgccattttccaaacaacgtaaacattaagatatactctgaaacaattggagcttgaattttagaaaagacactaggactagcacttcacgtttaggaactccatttttaagctgattcttctcgattcaatgattctttttatttcccaattcatgctcatttttttggtctattgactggcattgtcatgttcctgccttaatttgaaattctgtttcagcaccacagaattggataggttatatcacatagcattaaatggttcagaggaggaaaaatcagctgctgcaaaaattctttgtggtgcatcatttgtttgtggttggaatatccaggtacctttattttagattaattatattgtgtaaagaagtttggaaattgtttatattgccatttcaacttttatgttcatatggttaaaaaaatctcaccttattgatacaatttaactgaaatacaattcaatcgcatttgatgtgtctactactgccatggccatgtccacatgcaaattcgtctttcctattctttcctatatgatgtatgccttatcttactgcacgcttacaagtggtcatgcccctgatttgaccttgtgcttatgagcaagccaaaaaggttcatttgcacttgcatactttttaacctaaaatgatgattatttaaattttacttgtcgtctcaggaatatgtggtccgcatggtggtcaagctattatcacctccattgccctcaaattcctcaacacagggcagcatgagccactaccttgctcagatgtctacattaaatgcactcttgcttggtatttcttatggtgatgctatccacattatttctttgtatggaatggtgagcaatacatcatgtactatcacctgcacaatttattctcaaaatatcaaactggtgaatgttttgcatagtttttttattcattatagttcctttattttaatcttctgaaaggggaaaaaaatatcctcctgatttgttcttcacttctcctcaaagtaaaaattatggaactgcctacaaatcaatgcagctgctgtaaggccacaggcaaattattaaacatgggagctgatcttgtgtagtcttatatatcctcaatttcaaatcttctacagtttgcctctcattgctaacattttatcttcttattcttttgtagttgttgttgcagtaagctgtaatgtctatcatttgttgttgctaacagttaatgactgccatagcttaccgtgtcgtttggtccccatatcttttttttttgtgagagccattgtacatgatatactgaaaccatatattaatattttacttatgactagcataatggtatacacacattcattacatgatacatgattattttcatgtctatatcatattagctattatgctaactccatgtctgcacctatatgtatttataccatttattatttgtaaaatacaggttccagatgttgctgcagctttaatgccaatctgtgaagtttttgggtccataccacctccatctaaccacaagcctgccattgttggtgaaatatcagtttattcggtcttctcttgtgcatttctttgtcttcttcgactgtggaaattttataaacccccacaagaatactgtctagctggacgtggaggctcagttagattggagcttactctggactacctgctgttaatgcgcaataaccatattgactttgcaaattcatctgccagtagtagaaactctagcaacaacataggtccattaaatgaggttcctgctcaaccactttatattgattctttccccaagttaagggcttggtattttcagaatcaagcttgcatagcttcaaccctttctggtctttgcaacaaaaatcctgttcatcaagttgcaaacaagattttgagtatgatttgcagaaaaatgaacaaacctgttgtatcatctggcaatctttcatccacttctagcagtagtgtcagtggttcctctgtaagtacaccagatgattaccaaaggccaacagttcctgcatgggaatttttagaagctgttccttttgttcttgaagctgttcttacagcatgtgctcatggacggttttccagccgagacttgactacaagtgaggaaactccatttctttcatgtcaccgtattgatttgatccccaagtcttaatcttatttatgtgctgcaggtttgagagatcttgtggacttcttgccagcttctattgcagcaattgttagctacttcttagcagaaattacacgaggaatctggaaaatggtcccgatgaatggaactgaatggcctagtcctggtgcttctcttcattccatcgaagcagaaataaaggaaattctcgcatctgctggcattcagattcccagctgctatccacgtattacctgcatcctattcttgtgcatcaatttagttgcattgcttcacacctaattactgataaatttcagctccatcattatatgatcttttaagttcattccatttaatatcacttcatgaatatagtttctttatttcattttgcaggtggtgtaccaccaatgcttcctttaccaatggctgcgctggtcagcttaacaattacatttaagcttgataagagttcagagtatatccatgcgatcagtggccaggcactagagaactgcgcagggggcagttcctggccaagtatgcccatcatagcagccttatggacacagaaagtcagaagatggcatgactttatcatcctctcttgtctgcgttctccattcggcagagataaagatgcagttgcacagctcatccaaagttgcttctcatcctttctacggtcctcgtgcagtgggtctgactttactgcaaaccgtggagttggtgccttaatgggagatgcaatcaccggccaaggtcttcagcttcccatggctcctggtttcatttacctgagaacttgtcgaacattccatgacacctactttgtgagtgaggtaatcctgaagcaagtcattgagtgggctgacaaacttgcaaatggattctcttccagtggccctccacagttaaaatcaggacgcacgccactatccagcgctgcatgtatggcgcatcaagttgcgatgcttggtgggggactcctgtgtgttgcaggtggacctcttctggtccaggtattgtatgaggagaccttgcctacgctgctgctatcagctcgagaagagagtatgaaagaccctggaccagtttcaagcacactccaaggttacgccatggccaacatgctcttcttctgtggtagtctgctctggggagcggaaagaacttctcctgtcatgaaattgtctttcctgtcaagaaggccacgagtggtgggaaaccatatggatttcatggcgggtgtattggatgggcacattcttctgggttgtgaccatggcacctggaaggcatatgtatcgcgctttgtgttcctggtggtgaagtttgtcccgtcatggttgcgggacattaaactggacacgctaaagaagatagcgtctgggcttcggagttggaatgagcacgatcttgcattggctttacttgagcgaggaggacctcaggcaatctccactgtagtcgacaccttgttgtgatctttgcctcttgacatttcccacccattatctgacataggagtttttgtaatcacatttgaggccaggacttgtgtagagatgtcttctggttcaggatttctcagtcgagctatctaaaatttctgaattctgtcagcggagagatgctagctaatcttgtttgctgggtgcattgctaacgttgctattttcagggtagcattgtgaacccaaaatcatacagaggccttgctcgacaacgtatccagttagaactttctgatctgtctatgtacatttctgtaggtagtatatttgtgtggtctgtaaaactgcagtggtagctgtatctcaacatatgcttattttcgacaaaatttaaaccaaggtagcatcagtccaaatcaaacaactaagattttaacaataattgccaaaacataaattgatacggccggctttgccgaagcctaatgtgccaacggtgggcctgttagtaatgttgaatccgaagttcaaagttatatgatatccttgaaccgtaatatcagtaatgttgaatcctactttctcaaaatcaggttaaataaaagacatgtggggcccaatcatcgtatattgttttatttaacctggttttgaaagatgggggtttcacttcaactattgcggttcaaggatttaattcgaactcaatgataactagggaccacaagtaaacttaatccgaccacacgaaaaagaatacaaggcctaatgggctaaaactgggcctcacaggctttttattattaaggaataatcgcgaccatgcggaaaaaaaaaaggaaacggaagaaatggcgggaagtccaataaaaagacccgccgcaacgctccccgttccgttctacccggccaaaaacaccaaaacaccacccatttcgccaccacctcccgatcgctccgttccgtcctcccattccccttccactccaccccagccgcctcgcctcgccttcttcttcccgaagccgctcaatcgaactcccctcgccgaagccgacgcgggggcgcgaccgcgcgcgcgagccccataccacgtacgatggaggcagctctgaaggcaagtgctcgttgccctaatggcgttcccattccctaataaaccctagccccgcgatcccgcgggctaaaaccctatctggatgcttgaactggggcgtttctgctttttttttttcagacgtatttcggcttctcggggttccgttcgtaccagcgggagatcatacagaaggtcctggaaggccgggattgcttggtcgtcatggccaccggcagcggcaagtcgatctggtgagttagttccctgtggggaaaattttgctgtggctgttcccttccttcgtgcggtgccactgtttgctagctatcgtggatatttctatggatgtgcaagttagatcgttccagtgatgaaatctaaattggaatgctgcatttggttgatatatgggttgttgtatcgccgtgtaatgttcatattggcgtttgtgtaatttgttgattgggcaggtaaaacattctttcagaattgggtttgtcttatttctagtgtgcatttatgctatcttagaaaaataaaacataatgattttgatagtaatatagagcctatgagctatattaagtagttaagttcatcttcattgggtatacacatacataaatcatctaattcttcttccaggaaatcattggattagttattgattgctaattgatttctttttattgcagttatcaaatcccaccacttgttacaaagaagacagctgttgttgtcagccctcttctgtcattgatgcaagaccaggtatggttcaaatactcattgcagatcattattgctttgatctttgttgattgtttttacaagaaaacataatcgtgggtcttatctacttcaaataggtcatgagcttaaagcagcatggcgtgaagtctgaataccttggcagcacccaaacagacatctctgttagcggtcaggctgaaaaaggcgcattcgatgttctgtacatgacaccagagaaagctgtctcacttccttcaaggtaaaaggcagactctagtagtcttttgataaactctagtcacatccactttgtgattatgcgtggttagtctaaaaggaatagttgattatgtatttgcttgtctggaaatgggaggcatgctcattcaatttcatggacacaacaaatcactcatgggtttgataacatagcattcggtctattgatttgacattctaaatcttcttcccaggttttggagtaacttgcaggctgccggaatctgcttgttggctgtcnnnnnnnnnnnnnnnnnnnnnnnnnnnnnnnnnnnnnnnaggttattcatactgcctaccaatttgtgctcccacccttaaaactcacaccatccagtttaataaatagctgaccttttcttgattgcaattctctttcttgtttgcagaacggagtacaaacagttgcatatgttgcgtgaccttctagtgggtgttccctttgtcgctttaactgcaacagccacacaaaggtatagatgttgcactattagttgtttccctgcttggtaaaattttcgcccattaataatatcatattattatgtttcttctctatttaaagtaagaatagtgagagtgtatagctgtatgttttttagaggggtataattatatctctattggcacaatactccacatatcatagaagctggaaatggcttggaaaacttgtaacttacctccattattgtgttcatatgtaaactgacagcatgtctgaaactgtgaatcaagtgatagagtgggggctgcgcggtagctggtgactttgggagaaatgtcattttccatttcacattggcactaaattttggtcttgatgcgtgtaaaatatattgtagacagaaatgcagggatttgattatactcccttctgttcatgaaaccatgctgttttggacactgacaagttccccaaaacgtaactttgaccactaatttctattgtaataaaatatattgatgctcattcttttcaaaatagacatgttcacttgttatagcctcgtaggttgcgttacctttgtttacagtggctaattctttttttcccttccaatcaccaaatatatagtgccatataatttttttttgaccagtgccatataattttgtagggtacgtggagacattgccacttccttgaccctgcgcattcctcacattgtggtaggatcatttgatcgtcctaaccttttctatggcgtgaaatcatgcaaccggtctatggcctttatcaatgaacttgtgaaggatgtctcaaagaactgtactgtgggtggctcaacaataatatactgtactaccatccgagagactgaacaggtttacagcttatggtatcatgcatttacgtatttttgaactttcgtaataggtgcacatgtgatgacttgtaagccgttttctttcaggtgcatgaggcattggttgctgctggaatcaagtccagcatttaccatggtagaatgggaaataaagctagagaggaatcacataggtatatcatctactttaatttctttgtgcacatttcattatgctttccactttactccctttttgtttgcataaagaatgatttgcataattgttttgttggctacggtttgcataactgtattaaattttattgatcgtgccacaattttcatgaggaaaaacgaacatctatgaatattgcagtgctataatttgatctttaatgtttgtagaaatattggcattctgttacgtatgcactagatcatgaagttattagactagaaagatatttagacagatgaaatgagtagttaatacctttcaatttataatatgcatgctgcctttgcaatattggtctggtacaataggggctcatcataatttatgcttctcctttacagatcgtttgttagagatgaagtacttgtgatggtggctaccattgcttttggaatgggaatcgacaagccagatgttagatgtgtaatacattatggatgtccaaagagcctggaatcctactaccaggaaagtgggcgttgtggaagagatggactgccttcagtctgctggctatattaccaaagaagtgattttatgaaatctgatttctattgtgctgaagctaaaagtgtatgtgaatattatgtgcatcgtatctctgttcatgccaaagtgatatatcttacatatttgcagcctagttctttcagttgcttactattttagtgtctcatatttttttggtcactgatagcaaactcatcgaaaagccatcatggagtccttcatggcagcacaaaaatattgcctgcttgctacatgtcacagaaaattcttgctgcagtactttggcgaagaccgcaccactgactgtggtaagtatatatgttacatttaagagtcagtttgaactcatctagtaatgttttccatttaaaaagagtaagatatattcgagtcttatttcaactgctagtggctcattggtttttgacatatctcttgatttgcaggtaattgtgaaaattgcacaaggacaaaaaacgagagggatttgtcaaaagaatccttcttgttgctgtcctgcattaagtcctgtggtggacggtggggccttaatttgcctattgatgttctccgtggatcacgtgtatggtttctatcctgatgtttgtgatttttgccagcttgtgacataaattggccattagcacttgattggataagatcacctgtgtgctgataatgtttttgggaacaaagatcaatgtgaatagaatatttcaaggaatgtatatttaggtcttatattttctgcactatcctggtgatcgttcaagcttttcataatcacaaattagttcattataagataataagatataagtgatacaactaataatttttgaaaaaaataccttagccttgagcagtagtaacaattttgtaaaggattatgtttcatggtaagtattttctcattttgtaggtcaagaaaatagttgaaaacaattttgataaacttccattgcatgggcggggaaaagactatccaccaaactggtggaaagctcttggcggcctgcttttagcacatggtaccatcgtatgcctctctctacatatttttagtcattttcttgtgcaagctaagatacatgttctgtatgctgacttgaagttttgtacatatgtacagtgtcgttttcttggagaaaataaatggttgcatttttttaaaataatagtatcaataaacattgtgatgctgcagttcattcttttagtaaaagtagtgtttttcatgaccttaggtcctcgatcatatggcacggatgcaaacagcatattttgtacagagtaggcaccataatagctcatttcatctgaccctttttttgggatacccttcttctcgtataccttcattcctagagaccttttttttagagctcaagatctgtatttttctaccatgtttatttcttaaattgtctcttagcactgaaattcagatttcggagtatcgttttgtcaatgctgtactgttaattaatggctacagtgagtgaatttattcatcaggtgtcacaacaatttgtcctgtctttcattgtcactttgatttgttatttctttttattctgtgtgcagattatttgaaggagactgtccatgatacatttagatccatcaggtgctgtgctgactattttctttttcactgcataagataatattctacttgttctattttgctagctcatttcgaatttattgactccagttaacccaagcatgaatgctcaaacagccacaactcactgattccttgtgtctatgttcagtgttagtcctaatgggtacaagtttctatccactgctgataaaggggatggagcatcgctgtttttacagctgactgcagagatgattgagctagaggggcatggtggttcacagtgtaaagaagagggcttaaatcctttgggcccatcagaatctgaaaaaatttctgaggtaagtttctcagaggaattatttgtaaaattcattattttagagttctttagtctcattttggatctctttcaggatgaattgaaaatctaccaagtactcttgaatgtcaggatgcaacttgcacaagatattggaacggcgccgtgagttaaatacttaaatgttgacaacaataggtttaggtttctaggctctttacttattggagcaacactgaattgaatctctttaatccattatttcaggtacgctatatgtggtgatcagacactaagaaactttgcgaagttcaggcctagcaccatagctaggttggctaatattgatggtgttaaccaggtatcacttcagaaaataatagtagctaacacacttttatgccataacacagagcactaaacttttttgcggtgcaccctactggaaaatacgacggatgtgatcatattttgtcttaatactcataatgtccgacctttggttttcagcacttcatctcgcattacggcagtattttcatccaaaatatcacacaattggcaaaagaattgaatcttcctgtggat

SEQ ID NO: 23874 - DNA, 1257 bp, Oryza sativa
ttacacatgagatagcctcacagatccgtcttgccattacaaagcttggatcacatgaaaagttgaagccaatcaaagatgaacttccagaaaatgtaacccttcctccatgcatgattagactactgttgttaatatctaatagatctgttgcatcaacaaacaactgcttcttatgcactgccaagttagatattagttcatccaaagcgttcccaaggcctaatttacctggcaaaatgcaacatgatacttgcaggtaacttatgagatgatccagacattcttggcaattgagggacttggattgtcggatcaagtttttggtactgttcctactgatgggatccagtccaagacatcagaggcaccaaagaccacctccaatggaggtgaagttggcgcagatgtttgtgatgcaagccctttgacaaggagaggccaaactgatgggtcattgatttgtggtgatgagccagcaagtaaactacaaaagatagacgggcaaggtgtaaattctactgccgcaatcggtgccacagaggatgcaatactagaactggttgaaggacgcaatggggtaagacatcttttttttctgaattttcttcgattggaattcatgttgttcctcgttgatgatcttagttgttgcaggtttcgttggaggatgttgtcaagcacttcaatgggtcgaaaagagaatgtgtcgtcgagatgttggacaatctggaaggcaattttctggtgtacaagaagaatggctgctacatgattatgtgaaattaaagatctgaaggaatgttaccagttggttgtcaatgctagtaaccccatatctaggaacatatacggtctcaaatgatgtatatataaaatttagtggtaatgagtgtaggcttctttccctctttatccgtatgaaaaattcacctgttcatcactaacaactgatctttagttcattcagttttttctgcttgttcagagtttagaaactagtgccgtttggccttgaaggatcatcatatccagtgaccctgattcgttgtagaagaatcagagtctgctcctagcctcaaatatgatcaagtttttttcttttttgtttctagttggttttcagtgaagactagtgtcagacacagcctggctgcgatggagcatggacttcccggtgcgatacgttcagttttgggcggaatatggatagctatcaatggcagcgatcctaatttcggcccagctaggatcgtt

SEQ ID NO: 23875 - DNA, 4813 bp, Oryza sativa
  unsure (1)..(4813): unsure at all n locations
gtaatgcagggtacgtcacgacggatgagcggcgccgacaggtacccgcaactgttaacccccccattctccttctcctgcacctacttctgatttcgatgtgttacaaggctgcgtcgcgcgctaaattattgcatttcgcgttggcttttaggaggttgttttgcctgagttccatcacgtggagaaggcggatggtgacggtactgtcaatggactgaatcaggttcgcatttgcaaatcctgttcgatgatggtgactgctttgtaaatgttgtttgcttctgaaacctcaattggtgccaatgcatcgtaaggtgctcgcattatctactcctatgatgtaataaatgagtggccaggacgactgatacttgtctaatccttgctacctgcaacttagaggtgaattttaagtctagcgtgttagctttccgaggacaacactgtatccttgttggttattgcctctcaagggaaatacttaaacatttttttcatgaattatgaaaaaatagtttgcaaaaatgtatgaaaaattagaattagtatttgtagcagttggtgaattgccaatgttgtgtggttgcatctgcaacactaacacattctttttccccccttcaggatgcaccaaagaagacgcccaaagttaacagcggagggctgcagaagcataagcaaactgatcgacacacctcccgtattagcactaaaccaaaaggtactcttcagttcattttctgcagctaaggtttttagatgtgactaaaatgttgccaatgctagcatgtcattcatgaattatagatttataggctatacgaagtaatctggtaaacttaacaggaaatctagcatttcgggttacacaaagaacagtgatagtaacatgaagattatatatttatatatggacataatttcaactgcatggtccttcatcctaaatattatatgtgaactcaagttttcttcagtcccacgctcttgcttctcaccatttcccaatactttactttacatactagatgcaaatgttgtttagaaacaatgttgtcattgtgatactaacaatatgttcactgctgctctttgtttaagaagtctatatgctgtattccagttattcctgattggtcttttattctgtatgatatttatagtattctttttcatatctatacacagttcttccctcaccaaaagttgacccatcagaggctgtgaaggagtcaactcaaggcacaagagtatgctttctagcattcgaatttgtactttattttgctacttttgtgacacgttcagtcattaaaatggaattctaaggtcctgcagtaacagtagtagtaagtattatgatgctagaagttatcaaatgctatattttcaggtcaaacacatatttgtagatagtatgcaataacgccaaaaattacctttccttttagtcgtactgatgtaataacatgccattattctaataatatgatgctgaaaaatactgtgtccctgtatgtttgaaggacaatattttaggacaatgctgaaaatatactgtgtcccagtatctttcaaggacaaaattttaggacaatgctaaatatactgcatcctagtatctctcgaggatagcttcattctcatagagcgctctatttttcttcctgagaatttttttttcaacaagaggtactaacgagcatgcattgctttcaggaggttagcaaagttagaaagagactagacaaaggcacaaacacagatgaagtggaaaatgagaaggcttgtcaacttgaatttggtagctactgtctctggtccagagaacacaaagtagtcatgaaggactccattgtgaaaaggctaaaagaccaactatttgtggcacgctcatattatccaagcattgcgaagcttgaaggacaggaggaacttactgtgctaatgaagcaaaacatacaagaccatgagagggttcttagtgtatcgactgttgatgctgatctaccgtccttgtaagaattaaaattctggtgcttactcttctggtctttcacagttcatttcattgtcatcttaaagttgcagttatatgttactgaaactggatctggatatcttgcaaattacaatgccatttaaactctttatctcttaaggggaaatagttttttttttttgagaaaaatgtgcattcatctgaaaatagtatagaatcaaccgatgaataattttcccatcatcaatatataagtctactttcataattttaatgatatttatcaattgatttcagtatcaacaagaagatggagcagatggagcaaacaatagctagagcaaaatcttgcactgtagattgtcgaaatgttgacaggaaacttcgtcagatacttgacatgactgaggatgaagctcactttcatatgaagcagagtgcattcctctacaaccttggtgctcagacgttgcctaagagtcatcactgtctatctatgaggttgacattagagtatttcacatcctcttcactgggttcaaatgattcttctgctcgcaaatttagtgctgcacatggtaggcactatgtcatactatctaagaacatccttgctgcttcggttgttatcaactcaacagtgaacagttcaaaggtatgtggatggtttttattctttacagtgtttagtttttgcattatattcgaggtgggtgttgcttatattcatgttggtcttttcgcaggacccaaaaaaaatcatttttcatatcttaactgatgctcaaaatttctatgccatgaaatactggtttgacaaaaagtcatacagagaggcagctatccatgtcgtgaactatgaggatattatcaaggagaagttaacaaagtttaatgtgcggcacctgtatctgtccgaggagttccgtgttcttgttaggagtactgagcaacctgctgggaagacaagaatggaatacctatcattatttagtcactcacatttcttcattccagaaatatttaaggatctaaataaggtggttgtgttggatgatgatgtggttgttcaacgtgatctttctttcttgtggtctcttgatatgggggacaaggtaaatggtgctatcgaattttgtggtttaagactgggtcaagtgagaaatctcttgggtagtacaacagttgataccaagtcatgtgcatggatgtctggaataaatgttataaatttggataaatggaggaagcacaaagttacagagaactacctgctgcttctgaaaaaggttggtatagttctggtctatttattttcttgcgatagcatatgataagaaaagggcacaacaaagggtgatctggaaagataatgtagtgctacttgtgtttttccagtctcagtctgaaaattatttgtcccactgttttttatgcacctcatggttactattatattgcacgtattaatctgactctgttgtgttgcagttcttgacgaaggatgagacatctctgcgagcagcagcctttcctctaagtttgttatctttccaacacctcatttatccccttgatgagaggttgattctatctggacttggatatgattatgcaattgatgaagacgttgcacggagttctgcagcattgcactacaatggcaatatgaaaccttggcttgaattaggtataccaagctacaggagatactggaagaggttcctaactcgagacgataaattcatggatgagtgcaacataattccctgacaaactgacacaattgaacctgggaatcagaccaaccgatagcagtgtgcatcaacgagtctcacccttatgtggcgtactgactggatgctatagctcccaaaagcttttattgtgcactacgactacaaatacagctgtggaacaggagaagggttgctatcgttggtcataaatgtcggcagaagagtggacaaagcatgttctattcattaattgacaggattgattaactattttttttgcgatgggattagtctcaaatatggggactacatgctttgcaggtattgatgatatgaatgagtcttcaagtaaaggtgggtgtcagcctcattgtccagatactcgttctcttggaagaaggcactgtccagattgttagatagggtattcaacgagcttcgggctcatggctgtgtttcacgccccatcgattcatgacggtttttcccttcctcttctgccaataagggtaaatatatgtaatcctgatagtcattgttttttggttcttagttgttgtacatggattatttatcgaattcttcacacggaaagtctgctattggaagctttcgacacctctgtgattaacctctactgtacatttcgacttgttcttcctcacttggtgattcattcattataattgaaatttggatatgaatattataaattgtactccgtccgtcctaaaatataagagattttagatggatgagacatatcttaatactacgaatatgaatagattttgtccagatttttagtattaggatattttacatatatttaaaatctcttatattttgggacagtgagagtattatcatgggggagaaatgcagctacaatcattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23876 - DNA, 517 bp, Oryza sativa
cctaaaagccaacgcgaaatgcaataatttagcgcgcgacgcagccttgtaacacatcgaaatcagaagtaggtgcaggagaaggagaatgggggggttaacagttgcgggtacctgtcggcgccgctcatccgtcgtgacgtaccctgcatcacattcacagtcacagacaaaccaaatcaaacaaaattatccggcggcagttcgaaattacagaaccacagagcaatcgaacaacaagtcgatgcccagatccagcggaagcggcactgatccgagcacgagggggcactgcattcccctcccccaaaaccctccccactaaaatggttccagaaaggcgagagggttacgaaccggattgagagcggtcgaagaggaaggcgaggggaacgagcagcgagcagaggaagagcgccagcacggccacgcgtggccccctccgcctcttcgccggcggcggcggcggcggcagcagccgtcgccttcatcgccacctcgccccactactgacact

SEQ ID NO: 23877 - DNA, 536 bp, Oryza sativa
acacgagcagcgcacaggcgcactagccagtcccatcggtcattcgaccggtcacagaacggttgagtgcactgcacgccgcattaaatacggcgtggcgcgatcgctcgggatgccataaatgcggtaggtgggcacctggaggcggacgcctaacccaccgtacgtggtgacctagagagggggtcgggggagcctgacccctagtcacgggagggggcggccgccgcccgacctcgggcccgatccccctcggggaggagccacgtggcgcctggggcggcattctccctctagtctcggccagggagtggccgccgccctacctcgggcccgacccccctcggggaagggccacgtagcattggagggcagcatcctccatccagtctctgggaaggagtggccgcggtcctaccttgggcctgactcccctcaagggagggccacgtggtatcgggaggcagcctcctacctctaaacctgatacccccgggcccatatcaccgacaatatatatatatatatatatatag

SEQ ID NO: 23878 - DNA, 1939 bp, Oryza sativa
  unsure (1)..(1939): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctaggaataacacaagatatcgaagaagtaaacatggtggcatgtaccccaggtcatgacatatccaatgtggctgaagactctgacaaagaacaagaactcaactttttagcacgtaccccagatcagccaatctcaaagtcagtagatgcctctgacaaatccggagaaggtaatgcagtgcacaaaactccctcttcgcatagaggtaatgatacccacaagcctgtatcagtttttcattttcattcataaccaaccacatgcacataatatgactcactcttactgttttgactcataataggttaccaacaaacaaaacttagtagtttctctccgtactctatgttgaaagagacgagtggggcgtgaggagtacgcatgtacaaagctcccacctaaatccaagaggagaattattggcggtccttctgatatcctattcgatcggccaaagaggtcgattaaaccaagccatttggtgaaatcaccatttctgagcaagcaacactctttcgtcaggcatgaccagaaggcacttgatgatttatgcacatatgcaatttcaatcgctgatgcagaagctcttaagtaagccacctatctgaaacacttgatgatttatacacatatacaacttcaatagcttatgcagaagctctaatgtaagccacctacctgaaatgttcctttctttcaccactaattgtaaagatatcacatttaacaggaaaatctgggttcacatctcccaacctgtccctatgtcattaagcctacatgacatacaataggctattcggctggacactcaaatgcaagaagaaacattcaatgttgcagttcaagtattagtagcggatgcgatacagagatttggaggaactgattttgtaggctggagacatttcttaaatcaagattttgcagtaagtgcttccaattactctagatcgactatttcaatttttaaatatggtgtgttttaacataatatggcgctgtagatgtttgcaacagctggtgatgaccagtggaacccagaggaccatctcccctcattcaaagatgactccctgataccatatgtcgtacctagttgccacctggtttgataattaacagcatcttgaaaaattcagtacatcaagtgcaaatgttcaggccactaacttttgcaatgtcaatattaatttgcagatatttattccactacttcaaccactgcactattctctatacgcatttgatatggagaaaaaaaatatgcattcttgacccactgagagacgcctcgaaaagataagaggatacagcagaaagacacttaaaaacaaaatttcacatttcatctgctctgaaggagtgcatgaagcttgcatttccagattggggcgaggatataccaaactgggtttctaagttcccttcggtcatcccagctttaaacaacaagttccagttcatgctcccaatttgatccaaattaatttttccattctactcatttatggtcattacaataataacaattttggtaggctggattgtgcctttcacgtgctctactacatgcgaaactgggatggaactcgccttgtgaaccccccaaaatccgtgagttttctgtacacactaggttc

SEQ ID NO: 23879 - DNA, 1170 bp, Oryza sativa
tcccgatgcagagcatgatgaaaaacgtttttggctcccacgaagattcatccgacactacctccagcagaaacaattagctatgttctgctccaatacgatgcttccaaagactacaactacaccacaaactctgaggcacaacagaaaatagaaaaaaaaatccaaactagtgttcgcaaatttcctacaatgtttgccaaatgtaaatattcaaaatatactacatgttctgctgacaaaatttaataataataaaagttccattttatgctaaacgaaatgctgacaccaaccctgcagaacattgaacagaataattacactcacttcttcctctcataactagatttctgaccacatgtaatcttatagtggccatgaccaccacattgcttgcagtacctaatctgcttcgttgactctttttttcctttggcgagattcttcgactcgtccttggaggtactctcactaagccttcttttttgctttgctagatgtctctcccttcgacatcagtctggtactcctcggtcgtccacgacttcttctaacctcaggagggagtatgtcttcttcgttgacatcagtcatgtccacatcaactgaatcctcaccagcagaaacatcctgtccaatgccgtcctcatcggctacacaaaagtcatcaggcattccatgctccgagtcagaactgtctacactatcatccaattgcacaccagtaggtttcttcccaattgttctatctccgcaatgaatttccttgttgtttacaacttgcgaagtacacatgacctgaagttctccaatcagctttgtcaacacttccaatgtcttctcatatgtttctgaactagtaccaccaagtctaaccatatcaagtgcagacttgtgcaggagggtgttccgataagttctcgatgatgccgcctccttatccttcaagtatgactcctccaagtgctttgggattgaatctctagcatcttttgtccacctcttcaggatatacttcttcggtatttccgtgaaaccatactataccataacctgcaaaaacactatgcattaacacacaaaaacacaacagcgttatgagaactgcttaatattcaaacttactctgataatatgggagcatataattcccagggctgcaggaat

SEQ ID NO: 23880 - DNA, 12771 bp, Oryza sativa
cgcgtggcggccgcttgagaactagtggcccccccataacatgttcagcagaaagtaccatacaccgatatatcatacggaaatcattaaaaaaaacatacattggatgtatcgtgctcctcaccgtcttccgcttcaatcctatcattgtagaaattctcatacctctttgcaaatccatgtagcgaagaggatggtttttcatacttcttcagaacatgattcatgctctcacttctttgggtggttgacatcctagcaaaaaagaattccctgaagtaagctggagcccattttttcttcatgtcccacatcctgcgcaaatacacgctagactcgagattgtactgctccattcaatctgaccatgccttctcaaactctgcctctgtttggggttcatttaacacccggtggaactcctgtgtgaaactgcttcttttactgtaaatgttccccaagttctccttagcactcttcagaatatgccatttgcaaactctatgagtagtttcaggccaaaccgctttgatcgccacctccatttgatgacagttatctaaaaaataagttcacaaccattcgagattaaaaacagaagacatatcattaaacacaccactgatccatcccaaaaaacatatacctgttaaaattgttgcaggcctcttcccatgcattgcatcagtaaatgtttggaaaagccacttgaatgcttcgattgttcgattgtctcctccctcaacaaagcgcaaccaaaaattgctgtttgaaaatggttatttacaccgacaaaaatcccaaatggcatgttgtacctattagtctgatatgtagtatcaaaagtgattgcatccccaaaatgttcaaaacttaatctggacagtgaatgacaccaaaatatatttttaatccttgaagcaccatcaatctgtatggtgtaaaagaaattcttactacggcattgcatttccctaaaaaaattcagtgtcttctgcacatgatagctacactcatcccttctgatggcatacgccattcttgtcacagccctccttgtaaagggggttaaggacggcccgccgagcatacctgaaagtaatccatacatagctgtaggtgtcatcccattatctaccatttcctttatgttcctctttgtcccttcatcaatgaaattatgagacctgaagtgcttagtatgctgcaggtcccgtttcatttcatggttatgctcactaatgaatgcagaaactctccacttttgactttcagaagaacgatttaacctgaccatagccttgcagcctatcctggtcggcggaccagtgacagaattatctctaccctgcataaattacaggaacaccttactacgtaaaacctatcgaatgatgatcctacgcatcacactgtagaaacttgccaatcctacgagaatacgaaaccatggttttcaaaaaaaaaaagaacacactaaagatttttacctcacgaatgcagcagaactcttgcatggacttcacgccttcatctttgtatctgttcttggatctccttataccaaaaccagtgaacctagcgtacagattgtagaacgcatagccattagagtcctcattgaaggtctgcccaatttccggcaacagaatggctgggtcagagagtgaaataggcagcagatcactatcttcctccccctcaaccacgatcctaggatcaaaaaacgagaaatcaggaaacaatgcagaaaggggaattgtacactacaatcacactgacataaaaaaatacctttccaacggaactacgtccatgggttgtccactatgatcctcgccacctttctccggccagccttcttcctccatacctatctccgtgaatattgtttctgtccagcacggactctggtagctaccccttttggcaaacagaatttgctctagggtgtccttttttttcagctggttggatatatactgacaaataattacggtttattttccaccagctgctcaacaacctccccgaaaatcaaggctcctacgtgcgaagcatgttattggactctggaaagtcagccactagcaacattaacgaattctgatgaaaccataccgccacaaaaatagcatctataacaaatattccgaatacgcaacgctacactcacagaaaccaattcgaaatctctgctccattcttgtacaatattctgctcgaagaacttcatcttggtgaaggattgcattcacgatgacaacagggagtttgcagtacacacaacttaaatagataaatgaaaggataacatctcaattttatttcacttcccaaatagcagaagatacagatttctcaactcagatactactcgcttttttctcatagaatataccatacaaaactagagacagttcgtacgactaatctacggccgtgcagaaagcaagcccttattacaattttcctgatcatcacactattggctacatattttccttggacacatgttcgcaactattactgttgccccgggttgtttcgttgcttctgaaattcacgtcgcaagccacgcgaatatcacggagtgagcaccaagcacatctcttcctaggattcctcatggaaagaggatgacatccatccaaatgaatgacatatttctggagggagtggttcatcacttcactccgggcagcagtatccatgcaacgcacaaaaccattcctgatgaccaaataacgcaataaccagtcagagccaaacaaacaaacaagagaaaaattttcaacagaacataacctaaaactaaacttctatgtgtacctatctgcggcaggcttctgctgcttgtcaccattagctgtaatggttccattttcttccttcgccagattgtgctgcttgctactactcactggcgacgacgcgcctacggccaccaccgacttctgctgctcgacatcacgcgccgacgagcctccgcctacttgcgccgcggaaggcgacgcaacagacctcgccgacgacattctgccctttccaccggaggggttctgctccaccaaaaacctgcagaacaaaatcttcttcctcacaaatccgaaatataattctgctcctcattttctgtcctacatcaccgtcaacttaaatagagtatcaacagcaacctccacactaactactctcctggtcgcacggccatgcatgcgtgcgggtcaacaatccatgcatgcagaacattcaaaatgactcgccatgcagaacaccacgcggtgatacgaattttcaaagaaaaaaagaatattcaagtttctgcatcggtggatcagtggatcttttctcaccaaccgttagtgagttaaagcccgaaaccctgatatgagttgggcaggtgtccgatggttacaataggagtacctactacagggagtagtatataggcttcctatgtatatatatatatatatatatatatatatatatatatatatatatatatatgtatgtatgtatatatatgtatgtatgtatgtatatgtatgtatgtatagatataaatatgtatgtatatatatatatatgtatatataaatatatatatgtatatatatatgtatatatatatatatgtatatatatatgtatatatatatatatatatatatatatatatatatatatgtatatataaatatatatatgtatatatatatatatctatgtatatatgtatatgtatatgtatatgtatatgtatatgtatatgtatatgtatatgtatatgtatatgtatatgtatatatgtatatatatatatgtatatatgtatatatatatatgtgtatatgtatgtcggagaatgaactcctccaccagggaaccgtgaggcccccctttgtgtgttcggccgggggcagcgggtgagattcgagggcttggtgagcggagctgtgtgatcttgagggggttagccccccccccccaagacgatgagacaaaagaggtttatacaggttcgggctgctgagaagcgtaataccctactcctgtgcatgattgattgaatgtagaacacaagtgcttggggttgcgagacccaagcgccagttcgccccgaagtcccccctccaccactaggcctggacctccttttatacctcaaggggttaccacatgggcccaacaacctaacctaactccggtggagaagtattataatctttgcattaaatgcatgtcttgtctcttgacttgggaagccaagcacacgtcgtcttgatgatggggcctgtcaaatcttgccgcctgacatggggggtgcccctgtcagtcaccatttaatgggtgaagacttctaggctcctattacaccgagaaacgggagccttgcttttaccagagcgggaggactgactctggctgggataagaggatgagaacctctcaccatcactatttgatgggacatgtcaggctgcacgccgcctgacacacgagcagcgcacaggcgcactagccagtcccattggtcattcgaccggtcacagaccggttgagtgcactgcacgccacattaaatgcagcgtggcgcgactactcgggatgccataaatgcgggtaggtgggcacttggaggcggacacctaacctaccgtacgtggtgacctagagaaggggtcgggggagcccgacccctagtcacgagaaggggccgccgccgcccgacctcgggcccgattccccctcgagggggagccacgtggcgcctggggcagccttctccctctagtctcggccagggagtggccgccgccctacctcgggcccgacccctctcgggggagggccacgtggcattggagggcagcctcctacatctagtctctgggaaggagtggccgccgtcctacctcgggcctgactcccctcggcggaggaccacgtggcatcggggggcagcctccaccgactagtctttggggaaggaggggccaccaccccacctcgggcctaactcccctcgggggaggggcacgtggcatcggggggcagcctcctccctctaaacatgatagccccgggcccatatcaccgacagtagcccccggcgttagccctgaccaaaaccttccccaggtggtcagggtgacgccactttcctagtctgatgataggtgggcccgatctcttattctttctttgctggtactaggacccatgcgcctttttcgccccaacctaagggcgactcgctagcccataccttaggctgtgaaattattttatgtatatattcagcaaacgttgttagattctctcgggcccgtgaccttacgccgcgtacctcacttgcccctgccatttgttaacctttgttcatgttctacttcatctattcaaacaattattttcgcgagtgtgaggactgaactttccatagccagcaatcttcacccgtgatcaagctaagctgggcgccatagccagccggcggggccaaagccagccgctgtggaagagctagcataggagggcccgggtgtcgacggtacccagagcttgacgcaaggctaggatagagctaggaatcgtagcccccgtactttaagcaaagaatcgtttgaatggatgaagcgaatacaaactttttgttaccaagggaggcaagccggtgcgcgacacataggtaccgcggagaccgcgaggaagagataggcgagagataaatataagcaataataattttatgcaaacgattatcttcgcgcgagtgtgaggactgaactttctatagccagcaattttcgcctgcgatcaagcgaagctgagcgttgtaaccagccgatggggccaaagccagccgctacggaagagctagcacagggggccccgggcgtcgacggtacccagagctcgacacagggctaggatagagctaggaatcgtagcatccacacttacagcaaagaattgcttgtatgaatgaagcaaacacaaacctttagctcgaagagggccccccaccatgggttccgaaccatcttgggaagcctgtgaccacttagcaaacgaggttaggttcccacgagcctgtgtccccacactacacattctgtttgctctttcctttcggtggcctccttccaatctcttttccttctacatgcacgattactttcgcatgagtgtgagagccgaaaactctagagccagcaatccccgtccacagttgagccaggccgggtaccgtagccagccggcgggaccaaagccagccgctacggaagagccaacacactgggtcccgggcgtcgacggcacccggggctcaacttaaggctaggataaggctagaaaacttagcccccacacttagtgaagaatcgttcatgtagatgggggagaggttgggctcttaccaccgagggagcaaacaaatgcgcaacacgcgggcgtcgcagggccatgagaatagaatggggggaaagaaatataagatttcaagctaatgaattgaaaaattgaaaatacttgaagcttgaaaggacgatcagttgagccgggccgggcatcgtagccagccgacgggaccaaagtcagccgctacagaagagctagcacagggggtcccgggcttcgacggcacccggagctcaaaactgcaagagtcctcccaggagtgaaccgaggcagcagcaggttcatgggccaaccccgcgcttggcccctaagggccatgggaatgacgttcgccatgacccggtcgccaccacccgccacctctatgatcgccgtgcagatctggagggactcggaggggtcggcgccatcgtcgtacttctcggtgaggcagggctggagctttgggggccctcggacattctgaagactcgccacaaagaccaggtagccaagattacctggtggggatgtggggggccttgccccctgcctggggtggcacgacactcctgaggatgttgcgccttccccagtagcggcggcgcgacactcaccacaccggcgctcgaaagaacctcaaaaatcacgaacgcgccccctacctggcgcgccagatatcggagaatgaattcctcaaccagggaaccgtgaggcccccctttgtgagttcggccgggggcagcgggtgagattcgagggcttggtgagcagagctgtgtgatcttgagggggttagccccccccccaagacgatgagacaaaaaaggtttatacaggttcgagccgctgagaagcgtaataccctactcctgtgcatgattgattgaatgtagaacacaagtgcttggggttgggagacccaagcgccagttcgccccgaagtctcccctccaccactaggcctggacctccttttataccttaaggggttaccatatgggcccaacaacctaacctagctctggtggagaagtattgtaatctttgcattaaatgcatgtcttgtctcttgacttgggaagccaagcaaacgtcgtcttgatgatggggcctgtcaaatcttgccgcctgacacggggggtgcccctgtcagtcaccatttaatgggtgaagacttctgggctcctattataccgggaaacgggagccttgcttttactagagcgggaggcctgactccggctgagataagaggatgagaacctctcaccatcactatttgatgggacatgtcaggctgcacgccgcctgacacacgagcagcgcacaggcgcactagccagtcccatcggtcattcgaccggtcacagaacggttgagtgcactgcacgccgcattaaatacggcgtggcgcgatcgctcgggatgccataaatgcggtaggtgggcacctggaggcggacgcctaacccaccgtacgtggtgacctagagagggggtcgggggagcctgacccctagtcacgggagggggcggccgccgcccgacctcgggcccgatccccctcggggaggagccacgtggcgcctggggcggcattctccctctagtctcggccagggagtggccgccgccctacctcgggcccgacccccctcgggaagggccacgtagcattggagggcagcatcctccatccagtctctgggaaggagtggccgcggtcctaccttgggcctgactcccctcaagggagggccacgtggtatcgggaggcagcctcctacctctaaacctgatacccccgggcccatatctccgacaatatatatatatatatatatatatatatatatatatatatatatatatatatatatatatatatatatatagacacgggataggaatgaaagaacttcttactctctccgccaacccaaaaggaaagaaaagaacagaacagccggaggaattggtcaactcatcatgctcatgacctgaagactgcaggtttgaatcgggctgatggctagtctaaagacattgaccatctggagcgaaggacaattggcgaagttagttagagaaagcttgaaagataggattttctcgtgtggtaactcgtgaaatgccgagttggtacgaattctgggaaatccttccttttactctctcttttgaatgagtcgtggtgcgcgtgaacaaagcaaccctattaataggagggctagctcgggggcaaatctctagtattggtaccgggggccggtgtctagggataggagccgtcaaagggctagtcatcgctagaaaatccgaaacaaggctatcgctagctttattggggaatttctaatcttagtaggagctttccaaagaaatggaaaagtaaggaattttctcgagattgttttcgcttaaccaaagaaagaaagagaagaaggaaccatttttactaataaaatactataaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgccttcgttcaatatctatagtattctcggatatgatagattcatcgcttgttcgcacagtcttattgaagaatttggaatgaaaagaagagtaatgcttcctagggtcttggcttatacctttgcttctcttctctagggatctatacttggatatgcaactttaggtagtcagacagtcaccctcgtatcggctggatatatatagatcagtggtcgtaactggttatgcttaaggaactgtaacaacaaaaaaaggttcttcgtttttcaactggctctaatgcaaatttaaaaaataaagaagagttccgtcaggcgtactgaatctcaagacgttcctcaaaccaatcatatactttattgagataggtaactaacccgaaccccagaagtcatgggtgataattggtctgatgcttcgggcgaagccaattcccagggtgtgacgggcggtgtgtgatcatacgtctataatgcattgtatgtcctagaatagggcccttttggcgttccttcgtagatctacggatttcacccctacacacgaaattccactctcctctgtctcactcaagtgaattggtttcgagagcattccgccactttttggtgactttcactttcaacccgattcacccccaagacgatgttggcgcagaagcaataaaagtatgatctcgttgtcgctttcatcaacccggaacgatagtgtaggcgagcccggatgtagagatggatgatgtgtaaccaaagaagcagtgcccaaaatgcctctagaaagatcagacagaagtaagacgagctgtaattgtacgtacatgtaaaggagcttagtatggagttgcctggattagatcctcgttggtccttgaagaagaaggcggaagacttaaacccttcatttcctaatttttggttcggctctcctaaagaattgacttcctagagccacatgtttcgtcgtggtgctgatcgcgtggtttgcctcttcgtccaattttagaatactttttgattttttagtcccttatcaacatttcatcaatatctccatcttccttgtcaagttccctaaccccctttatagcttcacgctgtttgaatagttccaattaatggaatcaaagtcattacacgagtgagtttagcaagtggaatatctgactttgaaggagctgctgcgaggtgtatggtttgagtacaattaattcatttttttatgtatatgtatatatatgtatatatgtatatatatatatgtgtgtgtgtgtatatatatatagacatatatatatatatatagaagaagatcagagtcaatactagaaaaatcatttttctagacgatgacatttttttctaggcaggtagggctctcagagctaaatgaccacttgcgaaaattacaaccgtggggtgaaatcgttatccgcctgcaaaaatctattttcgcaggcgaaccacttaagcgatccgcctgcaaaaattccatttatttttgcaagtggacctcttaagtggtccgcctgcgaaaattggcgtggcatataaatagatgcgacatcaataatattttttctaagtcctatcctctcttctcccccagctctcctctctccctcagccctcagctctcctctccctaagctccctcagcgaccgtgggcgttctggggggcggcgacggcaaggcgcggggccggtgggcaacggcgagcgcgaggtcagcgatggcgaggcatgggtgggcgacggcgatgcaccggggctacggcatccaccctcggcgcggctccccttccctcccttctagatgtggccaaagagggaggggagggcggtggtggctgcggttccactacctcccagatccggccggagggaagggggagggcggcggcggcggttcccctccctccccaggtctggccagaagaaggggggagggcggcggcggttccccttcctcccaggtccggctggagggagggggagggcggtggcgagcggctccacttcctctccctctccctcccaaaaccctaacctagatcggccggaggtgggtaggggcttgggtgggattaggcccataagtttgtatacccaagcactatatatatttcactaattatccttgccaactcttatctaacttgtggctaaggattacatagtcagataaattgtgacatgtgacaccttagttgtaaaagtttggtaaattaaaacaagctttcgaacagcccattcttcaacaaaaatatttcgtagaggcatttaattattagccctgcagaatatcgaaaactacaatttcaatacaatggaaagtacatttgtagtttgctttgttttatatttttacattaatcttgatgtattgttattattttaaaaagaaaatcataatctcataacagtttacaacaagtaaaccttgtttttccacttctaggttagaacattattcgcttcaccataagaaaagaaacatacaagtgtgagttgtttgtattgattcggtgttaaataaatgattgatagataagaaaaatattagccacttgacaagtagactcccccttagaatatttaattaactagatatgttaaatattattttatatttaactgtccaagctcgaataattcgtagtaccataaagctatccctcattatggtagcaacgcaagagtgctgaggtcaccttgatgacgtttaagaaaaacagagagatcacccagcttgatgacgcagcgaaattatcctgtttctatattgaaatctaacaagaatcagaaaataaaaaaatattggagcggttaccatatgatcagcaatttgtcgagttggaatagcatttacctaaaccactaataaagcatatacatatgggttgtagaaattcaaagatatgttttaactctctctttttttatgtgggcatatatgccaaagatgatatgttggcaagagacattattgaaacctaattattaatgacctgtttaggacttcagttagcttccccaatgtttttttttttttttgaaatgcacatggcattctcttcatctggaagctagactggaacattttgagctgtgccttttggtttcaacatatgggcaacattcccatgccacacatccataaagaacatcaatctggttaaagagatttgataaacaagacagggatttgggatatttggtagtactagcattgtacgcagtggcgttttgggccaattggaagactaaaaaatacagtgcatggttttaaagtcatgcgtatgtgatttataatcatgtaaaaatattgtttatatgtgttgtttactattggattattttggttttaatttgtctttctacagaaattggagaggcagggaagttaaagacatgctgttggaagacaagtggcaggctgacagcagaagtttcaaagaatcggagaatattaaggacggcgggatgggcgctcgctcgctgcgtccacgtcggattttgctacagtagctacagtgcgcgcggggtggaaattatgcgaaaaagccctccgatttttcgtaataatgtataggtccctagcgtcctgtgtttgaagaggaataatcgcggacaggggcttttttgtgatatgtgaaagaagaggggcttttccgcaaaacagcatccactaacgcataccccccacagccctagctgcc

SEQ ID NO: 23881 - DNA, 4386 bp, Oryza sativa
cgtcggagagctcgaggatggcctccgtcagagcactgatgtgttacgtcgtatgctgtggctgaccgatggccctgtcatctgtggggtcctattgacagcctctgagtatgttgttttttatgttacatatttttttgttttgtttaccagtataagtagctcattgcctgccaatcttctctttcccttctgctttttcgccatttcctttgcattgccttttggtgcccgttcgctgttcttcttgtcgtctgttctagcccattctccgctgttgtgctttcttcgttcgatcatgaaccctggggggtgaacgcgtgtgctggtgggttttctgtatctagcctagctgccttcctttgtgtctgtgccgtgtgtttcctttttatcctgtgattaggcttggtgcatctcaggtagccatgtactggcctgtttgttgcacgagacttactgtcacagagtttttaggttttaggcgattttccccgtgttcatatttcccttttcacagtggatcattgcttatctctgttgttcttcttttagtaaatacttctttcagtaaatagatggtggctattacatagatgaagcacacggtcgttagttaatgacaaatatcattgctttttttttcctggttctgattcattattggatcatgtttcgccactcagagtgtgtcccgtggtgttttcttttcgtgcagaaccatgtggttcatttgcatttttgagtctttccttaagtgcatctctgtacgtttacatgtttttttttgtcccttcacatcgattttttttggcgcaggtgcttattgtcgcggtcaggtccgtgcgatacgttcgttgctgttgtgctgctgttccctttaccatcagctcctgttcaggtgagctttgtttctttgctatttctttggggcagacatcctttttgttttgtagtttatttgtgccttgtggtttggtgtatgttctttcttttatctgatatccagcttaaattacattcttattccctgcaggttgcggaccgcatctcctgtgcccgtacatgtcggctaaggtataacaattggcctttgttgcttcagctatctatacattattcgagctgcgctgttccttgtgggttatatgttctatatgtgtgcacgacatttctgtttttctatgcgtttagttcctatatggaagggggtcgtgtggttaggcctgctcgttgacgggatcgccgattgctagagcgtagcagcgcttctcttagatgtatggtttgttgcggtttgttttttttagatgctttagattttatatcttttcctgggtggaaagattaaatcgtctgttgcttgtttagcatcttcctctaattcagctgccagcgaatatgtttgggagactgttgctccaccccatcagggtatgtgatttactgatctgtgtgcgactgttgttgtggcttgtttatatttatgtagtcgttgctcatatatttttctcgctttagtagacgatggatttttccctatctaccctgcatggtattcttcaaaaagacggcaaatgtgttcaaaaaaattggccatgaaacgattggaggctacaggtttttccattggatctttggttttctgcatatgttcttgctgacatggcttacatggatgttatatctccttccctataggcaaaaaaccttgccgtattgctcctgtctcttgcaacaagtttgacagtgattatgccaagtttttaagaggttgctttcatctctgattcgtttccattcccttgtttgcaatgccagcacgcttggtttaaacataaatttctttttttgaatgcttgcatagagacttcaaaggataggtgcgattatggccctcctgagtatcgctgccgtatgtgcgctgctcagttctggtaccaggaacagtgcaagaaagattctgctattaccaagcgccgtgtctgttacaacctttgttgcaaaggcgggaaaatttttgtccctccatttgcgcagccaccagaacctttgaattcacttcttaaatttgatggagatgctcgaagtaaacattttttgcaacacatacgtcagtacaattcgctgttttctttcacttcgatgggtgcagatattgacgatagtttaaaccagggtggtggtccttatgtctttaaaataaatggccaggtctatcaccgtataggttcgctcttgcctaatgaagataatccaccaaaatttgctcagctgtatatttatgatactcaaaatgaggtccaaaacagaatgcttgctgttcttggtgaagagaatggtagctgtgatctagatcctgagatagctgctgaattgctagacatgctagacaattgtaatcctttggttaagcagtttaggctcacgagagatcggctggctgaacacggtgatgaacaattagcaattaagattgtaggcgctgatgaggaagggcctgttcagccgatgaactagctgggttaattgtaagtgatttttcattggaaaatgcaaaacgtgatataattgtgcagagcattcctggtccactccatcatgtatctagcttgcatcctgcttacatggccttacaatacccactgttattcccatatggtgaacgtggttttcagcttggtataaatttgaggggggttgatttaaatcgcactgatatacgtactaaggcttccatgcaagaacattattgttactgttgccactatcgtcgagaccagttcaacccatatttatgttgcggtcgtttgtcctcccaaagtcaagttgatggttttgtgtgttttgaggagggtagattgacatttatagatgaacaccagggcgattttagatgcgaacacgttcaaggcattgcagatgcagtcgccaaaggttgtttagacggtaatagtgttggtaagcgacgaattctccctgcaagtttcactggcgggagaagatatatgtaccaaaattatcaggatgcggctgctatttgtcgtgtgtatggtgcccctgatgtgtttaccacttttacttgtaatccgaaatggcctgagattgaagaagcattgcgcattgagccagggcagcgttcgacagattgttctgacattgtttgtagagtttttaaaatgaaacttgatgagatggtttctgatattatggctggtgttccatttggtcgtgtgcgtgctggttagtgctctttttttgcccttaacttagctgtgctctttatggtctattgttttattgatttttatttggttgttttgcctatgatatgtttgtagttctttatagcgtggaatttcagaagaggggccttccccacgtgcatatactggtgtagcgtgatgcaccaagcactgacgccacaccatttgttgtggatacatacatcagcgctgaacttcctgatcctaatgaaaatgagcttgattacttacttgttgaggaatttatgatgcatggtccttgtggtgatgccaatagaaagtgtgcttgcatgaaaaatggggtttgttctaaaaagtatccaaaagattttgcttccgagacaactgtagatgataaaggtttcattgtttatagacggcgtgacaatggtagatttgcatataaaaacaatgtgaaacttgataatcgttcagttgttccgtacaatatagcgctgctgcgtaagtttgaggctcatatcaatgttgagtggtgcaacaaatctaaaatgatcaaatatctttttaaatatgtcacaaaagggtctgatcatgccaacataaagtttaccaaagtgagaaaaaggaagttagggcgtgttgcagttgacgatagtggtacaccaagctctagcaaaaagatgcgtggtgctgatttcactgttaagccgccaagggatgagatagctgagtttattgcgtgtcgatatttatgtgataagcaatctatgtggagattatatgcatatgatattcattttagaaacccttctgttgaacgtttagcatgccatttaccgaacatgaacgtggtctcttttagattagacacaaatttagcatctatggtttcaaatacatttttacaaaaaacaacattgactgagtggtttgtcgctaatgatctgttcccgcaaggccgtcacctaacatactgcaaatatcctacgatgtttacttgggaagatgatttaaaaagttggaaaataaggcagcacggctataagattggtaggatgtattacatccatccttctgcggccgaagcatattttatgaggatgttgatcatgtacgtaaaaagggcactagaagttatgaggatattagaacatatgacggc

SEQ ID NO: 23882 - DNA, 15290 bp, Oryza sativa
  unsure (1)..(15290): unsure at all n locations
tgcatacattgtttgttcgcaacggtgtttctatgtcttcttttaatttgccaagcatcaattgtgatagctcctttcaatcagcaaatagattgattgacgatgaaatgtcttatgatatagataatttatgtgtgaatgctccattgctatatgaccagcttaacgttgatcaacgaaatgcatatgatcgtattgtgcaaagcgtcatgacgaaatcacctgctttttactttgtttctggctatggcggcactgggaaaacgtttctgtggaattgtattgttacctaccttagatctcaaaaaaaaattgttcttgctgttgcatcatcgggagttgctccattacttttgcccggcggtagaactgctcattcccggtttaaaattccaatagaggttgatgaatcaactatttgccatataaagcgaggtacaatgctagctgatcttattaagtccacttcacttattatatgggatgaagctctgatgactcaccgtcgatgttttgaggccttagataggacattgcgtgatatccttgctgaggatgatccttctgctgcatgattaccctttggtggtatagttgttgtgcttggtggggactttcgtcagattttacctgttgtggaagggggtattagatcaaaaacaattgatgctgcaatatcaaggtcccctctctggtcacatgtgtctattttagagctatcgataaatatgcgtttgcgttcaagctctttaagccctgaggtacaacatgaaatcgctgactttagtgattggattctttgtatcggcgatggtacaacagctgcaagtgctcgggatactgacactgaaccaacatgggtggatatcccacacgatctcttagtcatggataatgatgataagattggagctattatatctgcagtctatactgattttgctgaacattatagtgatcctatatatctacaagatcgtgctattgtttcacctacaaatgatatatgtggcactattaattctcgtgtactagagcttgtccctgacgagatgaaagaatacctaaactttgattcccttgcaaaaacaaatgagaaatgtgatgatttagatgttttgtatccaatcgaatttttgaactcaattaaagttaacaattatcctgatcatcaattgtgcttaaaaaaaggtgtgcccataatgcttttgagaaatctagatcagagtgctggcctttgcaatggaacgagaatgattgttacaaatctaggtgaccgagtaatagaggcgcgtatcataactggttccaatattggtcagactgtttatatcccaagaataactctatctgcaaacaataagaaatggccttttacattacagcgccgtcagtttcctgttcgtgtgtgctatgctatgactataaataaaagtcaaggacagagtctatgttcagttggcatttacttgaaaagcccaatattttcccatggtcagctatacgttgctctttctcgtgtcacttcccgtgcaggcttgaaagtacttatcgaagatgacaacgggaattgcacctcccatactcgaaacatcgtttatcgcgaaatattcgctgctcttagatagttggtggttgctgtcgttttgtttattttattcctacggtgtacagatatactcgaaacatcgtttatcgcgaaatattcgctactcttagatagttggtggttgctgtcgttttgtttattttattcctacggtgtacagatatacttgttttgtttatatctaaaagtttgctatgttgttctatggatcatgtatattacctggttatgctgcgcttttgtttgctgtcttactatactctttgccataggtgatgcaccgcatatttatctgcttattttatgctttttttgcccttttgcatgaccttgttttttgctttcctatagatggctttcgatttgctgtgtgacatatccctagcaagcagaggctggaagatccgtgcaaggatagcaagaatgtgggactacactggtacagctaacgatgtgcctcctatgcatgttgatctggtgcttgttgatgagaaggtatatctcattagtccgaatgcagggcacctttatattccctgtccaatttgatttgcttacgatttaaatgcttatgtagggaaatgcaatgtatgctgaaattccaggcgttgaggctgataagttcagaccacttcttcaggaatcgaaagtctacacttttagcaagttccttgttttgcctagcaaacctgcatacaagcccttccctaacaagtatatgatcaagcttactccatggacaaacgtggaacaggtcaatgaagttcctgctgatttcccatcccatgtgtttaatttggttcaattctcagatctaagccagcgcgttgggatgcaagagtacttcactggtttgttctttcctttaccattactttccattatttatgctatctatagcatttatcaatttacaaaccactgttcttaattctttttagatgtgatcggtatgatcattggggtatcaaagctagcctatgtccgaatggcgtctaaaacgtcagacacacctaagagggtcattgctctaagggatcttgcgtacgtagcctccatgatttatttgttgttccagtctttaccagcttgttgtttatgaccctgacctctaatgcatggccaactattttgataaccgttcattcttccgaataggaactgtgaggttaaacttgtcctatggggagagcatgctctcgactttgatgctgatgctgttcatagtgttggccaagataatgttgtcgttggtatctttgttggtactcttatgaaagcatataatagtaagcttttctccttctctgcatgtttagttctctctttattttctggtgccggtgttgtatcttcaatgtacatttgtttttttttgttgtctccacaatcatttcacctatgtattatgtacatgaagaaactcttagtggaggatcagcctgcaaatggtatttaaatgaggacataccagagataaaccagttctttgataggttagttaaagcccctcacaacagagttaataattttttagagttctaccccctttctctaacatgtcgttttccatgccttgattagcctgggtgatagtgctccaaagatccagtggatatcagccggagcaaagtcctttggttcgtcacaacgcccagcacagttggagcataaatctgttgctgaccttaaaaagattgatccatgggaagctgcggtaatcactgtaaaaagcatattatatgctttcgcatatgtatttttcatttagttcatctacaaggttattgctaaacacttcctatgcagggtgctggcttctcatctactgtgaccatagctaagttgagcccatctcagtcatggtggttttcatcctgttcccgttgtcatagagccgcaactgcatatggatctagctataaatgctacagcggttgctcatcagttactgccattccaaagtaatgttctacagcatacatgttcagctccttttttatatgtctgcttggcctctatgacagaaatttcatttttatatgttaggtaccgtctttgcctgataggaaccgatggaactgattcagcagagtttgtgctgtttggacgtgttgcgcagcaagttgttggccgtcctgttatgaatcttatcaaatttcagggcagatcagacaatattcctaaagaaattgctgctgttgtttcatagaaatttacctttgctgtctctgtcactgagcggagccttatgcataggaatatatcttttcaagttaatggaattgagactttctttggaagacagggttctattccgcagcctagggaacagggtccatctgcaggcccttctactcctttggctcttgttgcttctggtatgaataaggatgacgcctctcaatctcatgagttaaccccggtcaattcatctacttcgactgctgatccagtcgatgaacttcctggtgacagcaagaagcggaaatccattgtccgtcatgtacgcccttccattcatatcccatacattacctgttgctttttttatggcccttctttttatatgtctgattgctattccagcctctagcagcacagaaaaaattgacctttgaaacagctccatccagcaaagaaaacaccagcccggttgaccctcctgctaggtacaagtgtttttccacacttcttgttcttcttatatgttgaaactttctctatgttacatctgctttctaatttttatggccaacagtaaatgtggtttgcctctgctacatagcagagcacggtcagtccctccacttcaatcagatataagcatccaacccattctatttagtgaggaaccatgcattatgaacatattaatgtaggttccttgttgatctatattcctaatcatcctacctaggcctaatagacctaaataagtcattgctatttctcttgcttccatatgccattccgtacctctggtctactctgtactttgttccaccgtataaattgcctgtatgctaaatagaaccactttacattactatgacatggcctgctagctaatcgaaagaaacatgctcatagacaactacagaacattatttactacaggcagattagttgcttacttgttatcttttatatgggatgtaatgcgctccaaaatgatctgcatatggcctaccatcttttgctaccactgaccattgcacgcagcctaccagttatatcttttgctatgcataggcatatcatgtaatattactgatcatgatggctatctgctatatttctcagttcttctcgcactgatgaccaagctgctgataagcaacatgctgtgcctcatgaggttgatgtttctcagattgcagctgcctctgctgaaccaaatactcaggttaagcataaatacaccactttccagctaattcagtggtcgaattttttttaagtgacactaggcaaccctaattattcccnngttctatagaagtcaaagatattccctgccaactgaagccaaaaagaaaaggtataaaactacatattccagctgagaacgaataagaaaatccctatttttgtactagcggtggaagcatgtcacattcattgttaaatagactgcaccatttcgctttcgctgctctctcatttttggttcttctagattaaccaggtgttcctctctgcttagtgttgatccaggctctacaggcacacgcaagactaagcctcctgtaccgaaagggaactaaattgctcaccttagcttttgtgctgatgtgagtatcttgttctgttatatatctatgggcacggcattagtttcacctagattgctgatcactttaaattattttttaggggaataataccctacatcagcgatcccaccctatgtctacatatttccttaatcttactgttggcgatgctgcttgacatggcacatcgtatcagacaatcttttgtttacatgattgctggcaccactgtgtccatgcatgtgcatgtttggtcctctacctgctgctctttcgccctttagtgtcggtgtgctttccatataaccgtagcagagacttcctatgaaacgctgccatacgactgcacatcaccccatcttttgcttgtatgttataaccatgactgtcaatgtccatatggtgctctgtcagtcctatgaactcgttcagcaaacccccttctgttatggatcatattaatgcactagcgttctatctgctgttgttctgttcatattacatgccttgcagctgctttggatatatctagcacttgtgatacactatcgtcattaaaaacttatgtttcatgtgctacgtgcctgtgcaggaatttgaaatttgtagcatttccatcctacccagctaatgtgataagtaggattttgtgccatcctttctgtcctaaagaaagggtgggcaaaatttgcagctaaaaatagcatacgcgttggatcgaactgcattttccacttctacagggcaagccagatgcaaatgacatgcaaatgaccatcgatgttctgtagaccacacgtgaatagtcaatgtattcaggaccacttaccagctctaccgccactgctatgttaattagtgttgcaccttaagattattatcataggtactgcagcaccttacaaatatcagacatatgtgtgttagcgctgcaatctatttatctattgccgtctgctttcattacttttcccccaccaacactttttaaccgttcttccctggctatcagcttattgggcggcacacgtgcgtacaggcggtgcgccaagggcgcgccccaacctctagttaaaggtaacagagggctccagagaatcagattcatgtaagattgtcactagctagcatccatggagaaaattctctacgtgctcttgagaatttgcccgatccttatatgtccatgaatttttatctaatgtattatatgcacctgagttctccttttgattatgttagttgaccgttaattttttcaaaggactatattgcccccgtcatacttaatcagttaattgtctgctagcctagtgataaaaaagacaactctcaacaggagtaagattcaattgtaaaaatgaagggatagaattaattgaccacaaatttaataatgaaattaaaattttaaataaatttcaaatgaactttgatgaaatccgtacagcattttgaccaaaatttaaacccaagtaataaataatttttgttctgaatttctagcttaaattctcgtatggatttagtaaaaataataatttattcaaattaagttttgtattttaaatgttgcatatttctgttcgatttgatttgattataaattataatttttcacatagatattaatgagtcatgtagcatgtgagtatgagaaggggtgatatagttatttcaaaaaaatctaatggtcaactcaaggtttaactaatggatcgggaaaaactcaaaggagataaggcaaattttagggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggttttctaaatctactttacaatcttatcaaactaggactttaggctgttccataatatacagggaaacgtaatacccaagtcatgatctgttacatattttatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcaggtgcatcgactagatgcaccgagtggtttcgataattgtagtcaaccaagcgacttaatatgtagcatatgtggtatgaatccctgaataatatgatccaagtgatataccgactgctttgtaaaatatgatgagtgtaacctaaagttggctacatcattgaaaattcacatagcaaaatagctataaagaagcttgtatgttgtgaataaagaaatttccatagtattgggcatacgccatgcgcacactgctttaacagatgtgcttaagtccctagaagacacatggttccaccacacctggaaatatatggcatatgaggtataaaatctgagtaaataaactcataaaggatttaccaaccgcctggaaaatgaccacaatatataatcagcctaagccataatattggtcaataaaaatgcacacttacgtggcaaaaagcaatgatattgtatccaatcaattgcttaaaaacccaaacaacaccatgactatataaaaaagtcagcggggcagctatataaagctttactgtttgacaccttttaagatgcattataccaactcctaaaaagttgagtaactgcgatataaaaggattttaaggtattgggcaattgatcacgcgcactttggcctaagcaaaaagtgcctaagtccctaaaagaacgtgacaggccacacctgaaaatatgggctgcagatatattaggcctaggccaaaaaatatgccttcgacaccctttaaaggatgacgcatgtaacatgctcccgagtaataaatcttttcgggtgatatagaccaagtgtagctcatatgaatagcttctgatctgagtgattatcctttatgggatactccaaaatagatataacaattgaattccgactggcacaagtattcagttgataacccttacggggaataataaatagtccagtctttgagcatagaaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcagctgttgtagatgcttcacttggaggagagttgatgttgttgcccaactcgtctaaccgaaatatttgaagttgttgaagtagaatgtctgctccgaagcaaagatgaagataatgactcctggagttgactcgttggctgattaattgatttcttcagcttgacataaaatttgtcaaattttgagccttgtatttgtgtagcccccgactctttgatcagttgggaaacaactgaacatagagtcgagaactgtagcttcttgtcatcgaatagtcataacttgagtgaagatatgtgttgaggatgtccgagtagaaatattgaagattggaacaccacttgttgtaataaaataatacggcatcatatttagtgacatatgccgaggtgtcgaaactcttgtagtcgtcgtggttggtgaagtagcaaagcttgcgaagtagaagcaataaagtttgccggtgccgaagataataaagatgaagtcgctccaccatggtgacaaagttgcatagctgtaatgaagtgaacacgagtcggcggtaacagaagcaaaccggtggtgaagacgcgcagttgtgaagataaaagcaccagtcggcggcggcataaccagtcggcgacggaagacgatgatgtccatcagtagtggtagctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataataggccaacgtgcaggcggaaacaccagtcggcagcgaacgaggcggccggtcggtgaaaacgtagacgtccaacaacggcggcataataggccagccgtgtaagcggaaacaccggtcggtggcggatgaggtggccgatcggtgaagatgtaggcgcccaacaatggcggcataataggccagccgtgcaggcgaggacaccagttggcggcgacgaaggcaagccggttggtgaagacgtagacgcccaacaacggcggcataataggccagccgtgcaggcgaggacaccagtcggcggcgacggaggcaggccggtcggtgaagacgtaggcgcccaacaatggcggcataataggccagccgtgcaggcgaggacaccagttggcggcgacgaaggcaagccggtcggtgaagacgtagacgcccaacaacggcggcataataggccagccgtgcaggcgaggacaccagtcggcggcgacggaggcaggccggtcggtgaagacgtaggcgcccaacaatggcggcataataggccagccgtgcaggcgaggacaccagtcggcggcgacgaaggcgagccggtggtgaagacgtagacacccaacaacggcggcataataggccagccgtgcaggcgaggacaccagtcggcggcgacgaaggcgagccggtggtgatgttctgattgatccattcctaaagcgtaggagataagcttaaagccatgaatcccttttatgcatatctggatctggatcctacagaacaaacagataggatgagtagtacctgatgtaaatataatactcgagaaaaattcaagcattttaaaatgtttataaatatgtatttctcctcttgtcaattgtgatttccccgagcagatgactccttacgtttaaacactctgcccgactagtcatagtccccaagcatcgggagtcggcctaggcacttcccaaacatgcatatgagtgacatgagttcgtcattaatggaacaaagtttcacggatcagaatttactactcgggtacttttgccattattaagagcagaaaataaatttatctcatctctatgcttttgatttattccgaataatacttagcaccttgcgttactcggtccatccaacgagcccccgggtgctaggaatcagcccaaaggcaaccatccattggcaaaccaaacggaaagcataggaagatagaactccataactcgataggtacttttgtactcagattatgtcgcaagtaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagtgaagatgcccactaatggcggcacaataggccaaccgtgtaagcggaaacaccagtcgacggcaatgaaggtgagccaacggtgaagatgtagacatccaacaacggcggcataataggccagccgtgcaggcggaaacaccagtcggcgaaggccagccggtcggtgaagacgtggacgcccatgaacggtggtgtgaccaaccgaccgtataggcggggacgccagtcggcggcgacggaggcaggccggcggtgtagatgacgatgcccatcaacggtggtgtgaccaaccgaccgtataggcgaggacatcagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacaacggcggcataataggccagccgtgcaggcggaaacaccagtcggcgaaggccagccggtcggtgaagacatggacgcctatgaacgggggtgtgaccaaccgtatataggcgaggacaccggtcggcggcgacggaggcaggctgccggtgaagtcgtagtcgcccaacagcggcggcataataggccaaccgtgcaggcaaggacaccagtcagcagcggacgaggcggccggtcggtgaagacgtagacgcctaacaacggcggcataataggccagccgtgcaggcgaggacaccagtcggcggcgacaaaggcgagccggtggtgaagacgtagacacccaacaacggcggcataataggccagccgtgcaggcgaggacaccagtcggcggcgacggaggcaggccggtcggtgaagacgtaggcgcccaacaatagcggcataataggccagccgtgcaggcgaggacaccagttggcggcgacgaaggcaagccggtcggtgaagacgtagacgcccaacaacggtggcttgatatgccagccgtgtagacggagacaccagtcggcggcggcgaaggcaaaccgggcggtgacggtggctccagcagtacatgtaaagagaaaagcaatctctaattagcatcaagaaaattaatcttgtgtacgtaagtctgcatatatgaagcatgcatatattttttgattggccgattgatctcctgtagcatgaacagtacacacatccacacatgcacgtcaccagacagattgcaggctgccatccgtgcgtacagatcacggtccgagtccggatcaaatccaacttggaggctttacgtgatgggaatcagactcaggtgaccatggcgcatgcaaaataaggaatcacagatcaaactgagattagaaaattaatctaatctaatctagttagtacacactagaagattaattagaagtatatgcatgcatgattaggtagatcgtgcatgtatgttaatctgctaaatcaactcatgcatgcgtgaaatttctccgagcaagctataggcggctgctcccatgtgcccgtggtggcgtggtggccgcaacgcatccgtcggcgctgctcctggcgatcgccgtcaacagctccgttttaacctcagccgaccagcccatagaaagcaaggaaaacaccagaagagcaaatcacaattagaaattaatctaataacagttagatcaaaacaccgaacccgactgaagatttgagccatcgagattaatctcgccgtttcttctgtagttgattccatcacacttttcgatgggtaattcgacgcagcccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggtttcctaaatctactttacaatcttatcaaaccaggactttaggctgttccataatatacagggaaacgtaatacccaagtcatgatctgttacatattttatatatataagttatcccctataactagtcggataaccatgccgtgtgggtatggggtacccataatctccacatagggcatgaatgagattgagaaaaattgtcaaggggtacacactagtttggataggaagatagggaaaaaaaggagatgaagatcgaggacgtttttcccaagatggaccgtgtgactgatatatcgaaatacaagcagtacacggtcgcaaggtctccaccacggagatcaaggatgccttggccgttccacaccaaatagtgatgatatgctcatgcatgtaacatcgtggagtcccaatctaaatcaggtttaacaatttgggggtgtgtgtctggggaggggggagcggtaaaattagaaattgtagattttttttccaaaatttggatcaaattttttgatgaaatttgagccaatttaaatacatttccacaaaaatgaaactttctacaacgatatctatatagtcccttccccggcgcccgcctccgcccctggagagcacggagacattggtgtaacttcgtgtgatgctatgcctgttttttttttattctcgatgcgaaactatgtcttctctctcttttcgccgatccgaaaatattaaaataataaagacggtgtccagtgacaaattatgacatttacagagtgtcttcttctaaagtttaacttggtgtcttacatgtaaaactgtaaagtgacaatatcatatagcaaatttaccaattaactgcgcatataaaattaattattttatatccactgattatactgaccagccaattacatattgatctctattacacgcatggagacgaaggagagctagcatgacccttattgcatatatatctcgcatgcattcaggttacatacgtttagacgtactactacgatatagcttgatcagtatacagctttattctcggcacacacatatatagtatactcccatgcactaatagtacgtaggtacatgcaagggtatatacaatttaatccattttatcaacgacagttgctgtgctttgctttgagcttcttatatatggtttccagttctgcatactctttgtgcttagcctgcctgtaattctccagtgcttgtatcttcatctggagggctgcattttgattcttcaaggcagcgatttcagcctcgtacgatttgttcttgcttattgctagctgaccacatgcttcatcctgcatacatgcataataatgcattggtatttatatatatagattcaatcaaaattaaagtacatatattaattctacatttgtgtagtatatgtatggtagctagttctacatatatatgttacgactgttatatactgagagagagagagagagagagagagtgcatagagaggaggggaagaagaagggtatagtatgtaccattatattgagctagatatatcgtagctagttctgtttgcagaactacaacacttgttcagtggctaacttagcatgtttctcgcttcctacgtacgcttaaatagacaaagcagcatggaggcttgcagttagttttcgtttcactactataaatccccaggttccctagggttaaaattcgttaccttgtagtgaatttgtccatgttgtcaacttcttcttcctcatttttcatacgtacgttttccgaatgttatgttttattgaaaatttctataggaaagtagctttaaagaatc

SEQ ID NO: 23883 - DNA, 12505 bp, Oryza sativa
ttatgctctcatggtagtgtgttgcttttttggggggattctcctctacttctcgaacaatgtataacgttataaaatagatacgcactaaaatatttagagaaaagttatcatatatatatatatatatatatatatatatatatatatatatatatatatatatatatagagagagagagagagagagagagactgactgagactttgtagggtgattgaatgtaggagagccattgtgatcacttgtaatctacgatgtaagataagatacaaatgaaaaggtattaaaaatatggttaacgtactaacaacagatgctagctagcgaatacgtgcgacaacggtaagttgcgcaccccgattagagtttagagctttggtgcaagagcgttgcaggtgaacgagagcccattgcagtgcgcatgtctccacctaagcgagagcttcccattccccagtatcacatgaccacaagaatcctaaaacttttgtctcgaattcaaaagaagacttttaattcaaaatctagaaattccttcacaaatttagaaaatttcaactcaaatatgaaaacttttgtctgaaaaattcaaaatttttaattcaaaaaccaacaatttcatataaaaaatttaattgaaaatccaaaacttatatctcaaaaacataaaactttcaatttatgatgccttatcccaaaataaagctatttctccacctaccacctcctctcaaccatttacaatcattatccatttaatttattcatatatattctcttctcaatcaatcacaacatttctctaacaatttttacctactttcttaatacccgagtccacctctaacattttgagcaaaggaagtattttctaatttatggttaaaataaatcaacggtggatacttggttgggtggcttaggagctagtatacctccaagcacgataaaattagttctcatatataggcatgtcattcacacatgatcgtcaggaaactataggatcgtcagtccagtgacttcaatgtatgcatcatctaattaagcacaagacgagcagaatatttaatttactggatatatatgcgttaaaagctattctctaagcaagttgtgatcaaactatatatacccacgcaagagtgctgagatcaccttgatgacacattgaaattattcgtttattagctagctagtagcttggatatatatattggggcaaacgctccctgttttcatcattatacttacaccaaaacaattaattactagtacattttttttcacattataagcagggccggccctgggattcttggccatcctcaacgtctgattgtatggaagcttacagaaaggaacaaattttagtttttaccatgtcaaatcaacctgacggtaatatatagaactctgggagcatgcacgtaatcaactagagctaaatcctatttcatcacattataagacattttaggttttgaatatatatgtgtgggtgtatgtatatatatgtatatatatgtatgtatatatatccatatatgtgtgtttcatatatgtacctacatttatatagatgtaagtggaactaactcttgtgcctgttcgttcgaaacaattagtaaatcaacttggaatggcagaattaattctactatcaaaaaattaggtcaagttggagcaataattcatttttataccgctaacattctatacttctatatctatatacgttgggaaaaaaagttgttccaaaatacttttacttgcgcacatgcatatataccaaagaagatatgtatgttctctacacagtcaaatctaataatttaagacccgtgtttagagcatcaacaatggtgtccctactccattcctaatctttattttttggaattttagtaagaaaaaaccgctccaacagtacccatactattcattccaaaaatcaccattcccttcttcattctcgctcttcacaaatcgggaatcgttctcaatctcaaattttgtctcctgagcgagactgccatccaagaagaggggcgagtgggagggcagcgctagatgggtgattgtggagtcagatggcacgatgataaagcgcgggttgaggtaatacttttaatattctcaaatcctcattagataatctcaaaaggagatttaggaaagagatttttagtcatctattggccatgaggtttcttagcttcgtccgggaatagtcgtctcttgaagagaaagtaaaaatttatgtcaaaatgagatatatatgttcaatgttcaatgtcaaagtgagcacaaaaagctcaaataattgctgaaagttttcttggttattgtttttctcaaaaggagttaatttgagaatcaatgataatgcaataagtctacatgtagagtttttctttcaacctatgtactattgaatatattgtattataaattgtttgaaatcatgaatcttgattgttgacttaagcttaattgtaacatttttggttcatgtttatactcacaatgcatgcttgttaactcgttgatgaatttatatcttttgttttgcaacacacgtccttgaattgctcttgttatatctcaaagctctttgaactataagtggtgacttgcaaaacttgataatatcattgtcaaagggggagaagagatacaaaacatgcatgttttcagctgggggaattttctttcttttcaaaagggggagaagttctatgttgattttttagcactccaatgattttttaccacttatttgtttttattttttcaaataacaaaacaacaaaattttgatcggtttatcaatgtgttcatcaagggggagattatgaaatcaaagtgtgcttgattgttattttgtgatgaacaattgatatgagagacaattggttttaatatttggtggatgattagcgaggtggtgctgactgtgttagcttggtcatacccatcagtggtggccggacaaacccacgtggtatgtgcggtcaaatcggctagcccaatggtttgatcgaccgattttgtattggtgtcgatttcgggctgtttatttggatactcgtgattatctcatgtttaggacttctagaagatttctatatgtatataataaaattgtgtgctaatgttgagtcaagttgagaagaacttatgctcggatatggttgcctatttgattcatgtgtaggaatatcttgatgccatgggagagtattgtcgatgatggatcaggatttaacttgggagaagatgatgtccagatgatcgggatatcatggggatgcttaggctaaagaacaatggacgaggttgatggagattccatgcggcatacgatgggagattgtgtgcgtatggaaagtggagtcaaactccgaaggagtccaaatttgagaagattagagtttaagttggaaagagataagtttgtttcttatacgggaatgtttcctagtggattaggacttcttgcacaagttggattcgtggctttaggctatctacctcgagtgtaagtagagaggggggctaagccctcctggtatcgatttgtacgagttgagctgagagaaaaagttagggtttcgagtttagttgaaatttttgaaagaagtgttgtagttcgcactttgtaaacgctaatataatcagtaaaggttgaaatttttgaaagaagtgttgtagttcgcactttgtaaacgctaatataatcagtaaaggttaatctatttccacgagttatttaatttgtgtttgctcggtttcgagaatcacaccggcaagtatacggcaaccagaccgatggcttaccaatggtcagaccgatgggtatagggcagttagacctgcggcagcgacaggcgcaggcggttcgataggcggtcagactggccgatcaatactgctcagaccggctgcaagggcatggtcagaccagggctagccagttagaccgatctccaacgattggaaggtaacttttaattccgcaaaaacttttggtttttggtgttgctgccattcacctcttctctgatgtgtttagtttttattgtttgatccatgaaataattgtataccatatttatattttgagtgaagtttagtttggacctctctttcttgccaccgcgccttagaccgatcggccaaactgtagtggcagccttaagcaatgatgtagtcagcaacaacagccattttctctatgcacattaagcctgatggccttaatttttcactgatcagttttccctaccggcaaaagaatgacgttcagcgggttatatggctgagaatttgcttgtcgctcaacccgtcatgaaacactcccccatcatacattttccatttccgcatcatcctactcctgtcaggtctctttcaaggcttgttcggttaatcccaaatgagagatagaaaaattgagcagattaattaattccaagtacagaattattttccttcaaatcccattcaatccttttatgttggggattaagcgaataagacctcaacactattatttttcatgttggtttttgcaaattccctgccagtatttttgttgtcacgaaagataggaatcctagtagatgtcagaagcattagcactcggtaacttgaagcgctgactcctgaccaatctgtatatgttttttctgcattggctacatataaaggatatatgtcatatttatgacttgaggaaaatccaatggcccacaatgattatcaattatcatggcttctatttcgcacgattgatcatccatcctagcaatgattcataaatcaaattttgcatttcttcttttctattacaccgggggccgccgacctactatgtacagggatatgatcaggtacagttgtacccaaaaattttgcaaaaaaaaaccccaccatatattatagtatatgttatgtatatgtactaatagttgggtcaaatgggtaatatttgagtttaaaatggcattctagatggtatggaaatttctcgactgagccgttattgtttctgcaaaaataataatataataatatattgtgttgttaacttttatggtaatgcttgaaaatatcgcaactggttctatgcaaactaaattaaaaaatattgcagacaacaaaatacttaaatgattttcttggttacatgctttgaaatcgacattttctacatattcagaataaagatgtaatatcccgtttataaaaaaaaatcacatcaagtatacttttaattttatttttttagtatatattttgtagttctagaaatttattgcacactatactcactttactaaactatgtccatgttagtttttcttatcaaggcatttatcattaatttatatcaagtctatatatagtaccgtctttttttaagaaaaaatacaaagatttttttcttaacttcatacccacattttaaaaatctttcatccaccaccgtattacactagtgatctaaactagttgacatctctttatcacgttacacataagagtatcatctaggtattatgtaagaaatatatatagcttagaatcaataaacaaccaagacatcaacatgcacacaggatcaaaggccaaacataaataaaacatttgatttcatacaacaacaatgctgaccacttacatcaatattgatgcatgcatggagatgaaggtgagctaccatgcatgacatagacgtatggcacacatttttgctgctagctagcggccggggtcatatccagcttattacaaatatgtatagttatactcacatacatcactcatatctgtaggtataaaacaggggagtaggtatcataagcatgcatatataagtaacgtactccctctatcttaaaataaagggattttatccatgtaactgtatatttacatggataaaatacctgatatttgaattatttatatatatagtatatatatatggatgcatgcgatgacatacatgcacatagattatataagtatatataataaaaactcttccatatcttaattatccgcagcatccgggcctactcatttgccacctgagagcattgtgcctggcctccaggttgtggtagctggtttgcaggttgtggtggcaggcttgcaggtttctgtagctgctgtgcagcttgttgtattcgctttccaggttgtagtactccctgcgcttctgctcctcgtagctctcgtggttctgaagcttcatcctaagcgtccggatttgctcttctaatcctgcgatttcacggtcctgcagcctgatgttgcctttctctagcacctctgttgcttgtcctctctgccacattaattgaacatggatggatcggatggatgcaaattaaattaattgtgtgcaatcagaaaaattcatcaattaattctacctattatttttctgggtatagtatatgactgtaaacgtactgtaagtaaatatgagctagagatgaggaggacaagatcaggaagaagaaaggaagtaattataataaccatgttgttgtgagatcgatcggtagcaagttgatcagttgcactcacttggttccttcagaatactctccttctaccttagctttctagttcatttgttatggcctatcagagaccctgaacatcgcttaaatagacatcgcatgaagagtggcaggactaactaattaagtaatatatgcattatgttctccattgtaattaatttactgatgtgtggatggattcgtctcaacatgtagttttctaagatgctcatgttcaaaattaaacaacaaattttgtatgatcgatgcatgcatccacctcaaataccgttagtgaggagttgcgttgcgtgtacatgagcatatgcatgcgtctgtattgagtatcgaaaattggttttgccaaatcccatgcaattatgctgcatttgatttatacattaatttaaggaattatataaacagttttttaaaaaaaaaacacacaaagcacaaacgcaggcactcacaacccatacacactttcccctataaacgttccctatgaacacctaaaaaaattaggtcggcatatcttaagatcgacaaatttctttttttctactcactacctaagctcaggttatgcataccttttaagggcataatgtttaccaagtttgtgcccgtttgaactagatgaagaagctgatgacagttgatgaatgcatgatgtattgctttacaaggatgaattaaacactatataatatagggatagtctagatctcatgcatgcatacgactaaaatttaggcacttctagctcgtatcccccatataaactacttaagcctttctttattagataaagattgaacaaagaattattctaacttaaacacaaaataaatttacaattggtaaaaaatacaaaatacaataacaagactacacttaaaataaactaaaattgcatatacatagcagaatgattttagactaattagcagtatgtaattttaggtaattaaaaaatttcaaatttacttcttacgtttcaaaatataaggcttgttttgttttgttaagaaaggctttgaccaataattagcttattagatatactttttatgacataaaattatttttattcatattgaaaagtactacttatatatgatgattatgtttttgtattgcacagtaatgtcataatagataaattgttggttaaagttttatctatatcgatactaaaatacaccttatattttaaaatggatgtggagtgtaacctctaaatgaacagagttttggataaatcatagttttggaagtatattcactaataatcatatactaagatagccatgcatgcaggagtgctgatatcaccttgatgacggcccgaaattattccattaccccattagatctagatacaagagaatatatgcgccctggtttcattattaataaaccaaaacaattattaatcctacatggttgaatagcaaatgtagaattgtaattgggactccctagctactatacgacaacttagtattatcaattatagattttagaattaaataattaaatagatttaaaaaaaagaaagaattaaaaagtacggtcgtggattctatatataattttgacattaattattttttattttgataaaaaagtatgtaatataaatgtgccatgcgaagacagggattactgcgattatagtatcatagtatggttaattactcaagttgaaagaacatttacctaaaccattatgaagcagtacctatgggtcctaaaaaaggttttttcaactattgcttttacttgtgggcatataggcatatatgcaaagcgctatgttggctttacatgtaaacctgattattaagacctaatttaggagcttcaaaaggtttgttaagttaaactaagtatagattcagacaacagatttaggtcacattgatttagacaactttggaaactaactatataaatgatactttcattggttttcttatatagtaacttttaacttcataagggcacattgatcttttaagggcaaatatgatagtcaattaattgacgttgaccaataatagtgacaaaagagagctgagaactaactgaatagtggcaaaagaaagagttccaaattcttgatggtctttttgttggatatttgcttgcaaattctatatgttttttttctgagaaatataaaatttcaagttaagaattatacatttagagatctattgaaacgtatgggtattttgctagtaaataccttttggtttcaatgggctacactcgcatgccacacacatccataaagaacatcgatctggttaaagagatttgctaaacacgacagggatttgtgatatctgatgttgactgccattacatgcaggtgtgcgttgggccatttaatttggaagactcagaaaacagcatggtttttaaattatgtgatttatagtcctgtaaaaatcttgtttatatgtacgttacgtgttgcttaatattggatttctttggtattaatttgtcattcatctacagaaattggagaggcggcgaagttaaaggcggctgctagaattagacgagtgttagtagtggagggatcaagtgaatcagattcatgccacgtactgtgcatccatccagagaaaattgctacaagattaatctgctatgcccctaaattttgtgtcatccgttacatgcaccagagacttttttcttattggtagttgattgttatttttctttaaataactacatattgcccccatcccatacttatatgctagtgataaaaacacaactgtcaactgaaaaaagattcattaatttgtagaaaaaaggacatatgaaatcagctttgatgaaattcatacaacattttcataaaaagtgccacacaatttagtgcctgtagaaagtgcatctactttcttataggcatgcataaggaaatatctctacgaaaataccgcaaggcatatagacatttcataaaatgtctatttgtttctagagacaattcaccaaaagacatttagggcctctttgaatcgcaagattaagaaaacgtaagaataggaaaaaggtaggattttagggcccctttgaattggaggaaaaacataggctttttggaggattttaatcctatagaaaaatttcctatgatgccctttgaaacacaggattgaatcatatccaatcctttgaaattcctatggaatggacaaccctatagagattttggaggaaatttagcaagagctttaacctcttggtaacttttatttgagtctatctctctcatccaattcctgtgtttttcctgtggttcaatcaaacggtctaaggattcaccaaaagacatttagggcccctttgaatcgtagggttgaaaaaatagaggaatagaaaaacacaggattctgacaggtattgaagtgtaaaacagaggattgcaaaacacaggaatgatcgtttgattggaccgtaggaaaaacataggaattggatgagagagagatagactcaaagaaaattttccaagaggttggacctcttgctgagtttcctccaaaatccacatgcaatgtgtcattccataggaatttcataggatttagaaagtttcaatcctttaaatcaaagggccaaatagaaaattttcctataggatttgaatcctatgaaattcctacataaatattttgattcaaaggggccctaaaaatacaggagtccaaaggatgagaaatgtcacttaagttttcaaatatttaagatgatagcacttttctattgaattttctaacatccggtgtgcagaccatacaaaggctaacctgtttaagagagaaccgcacaagttgctgagatcacctagatggcgcatcgaaattattccgttatagcttggacctggaaaatgccccttgatttccttactagaagtcaattaaaacagtgcaaaaacccacttgtgttaccgtaaagtttatttagtcaagttgaaaagtcttctctagaccactaaaaatctctatatgtgcatgggttctaattacaaacgattgttctaaattcttttttacatgcgagcatatataccaaaggtggtatatatattttggcaagacatctaaaccaaattataaattaagacgaggtgatgtgcaggaatgcacagcacagcgcatagtagtctgcgcatgatcctaaatgtaacattcctattttacttaatttacttataatttaaaatcggagattgattagaattgatgaatcttatacatagttttcagaaagaaaatgaatttatgttacacaatatttactcttttatacaatagatttttttcgtatatacttatcattcttatatagaaatttatttggagcgatgccaattaattatatcatgtttttcttcaactttctcatgtcttcaaaatctacatgccaaaaatatcccaaatttccatttggctcctcgccacaaaattttctacccatatctcttttagtaaaaagttctgctccaaaaagctcctaggatacaccatgtcattgaatgaatattggctgtccgattgagaagacaacaaaaatagagagattcaatattcatcggctgtttccaggttattggtcttcctttctctcacacagtctctgtgcaggtttccttgatctgtcttcctatctcacacactctctgtgtgtcgatcgccttctatttttttctctccctgtcaagagcaaatgaacagagaaaggagaaaagacaaaccaagagagtgggaaaatgtggcaaaaataccatctcgctgctctcaatgcacatgtgaaccatacaaagctaacccagattaagagataagctaccgaaggtcgctgacatcacctggatgatgcaacaaaaattactttgttactactgatctgagaaagtgccccttgattttcttcctgagtgacaattaacacaattacctagttgaatggaaaatgcaaagacccacttgtgttaccatatgattataatagtcaagttggaaaatatccttttctaaaccactaaaaatacatgggtgaagggttgttctaaatatttctttttagatatgggcatatatgccataaaggcgatatatacaaaattatattaagaccctgcttaccaggttacatagcttctccgggaattaccttctccatgaagagagtgaaaattacaggtccaacaaaaagcatctgataaaggagaaatgtgatgggcagacgtgcgtctgcgcttatcatcctaaataaatgtaacattcctattttactcaagttataatttcaaattttggatttattagaattgatgaatcttaatacataattttcagaagcaaactaaaggggattaatttgaataaaaacttttataggggattgaaaagttaaactgatttttttttcatgaaactagagtataatatgtagtttttctgatatacccctaatccaggccatctcgctatttaaatttctggaagaaactatataaaattcacaagtatccataaaacataactaaaagatatatgcataaatatatatttgtccatagaatgtcgtcgtacctgcagctcaagaggtcgtgaggatggcagactaactacagccatacccttattgacctcttttatatacagggtgtgtgtttagttcacgataaaattgaaagtttggttaaaattggaacgatgtgacggaaaagttggaagtttacgtgtgtaggaaaatttcgatgtgatgaaaaaattaaaagtttgaagaaatagtttggaactaaactcggccacaatcaagccctgaagtaatttctcatttggctcctcccccccagaatttccaggtaata

SEQ ID NO: 23884 - DNA, 48750 bp, Oryza sativa
  unsure (1)..(48750): unsure at all n locations
cgggcccaaaagtgcccgattgatatatggtcgcacagacatgttagatgggtataaaacttaagcccgtcacggatgacacctatcagtgacgggccacaactttaggcccgtttgaggtatggaatgttatctcaatcgggcctaaagttgtggcccgtcactgataggtgtcatccgtgacgggcttaagttttatacccatctaacatgtctgtgcgaccatatctcaatcgggcacttttcggcccgattgagatgacttccttatgacggcccgctatttctaagcatattagagcccgttacagatagaaggatctgtactagtgatcattggtgggccccacaaaaaccgagccgagccgagtccgcacaagaccgcaagtcgtcgttcttatccatccactcggctacatctctctctccttgtctctttcttctcctcttctcctccactcggctccatcttctcctcttctctttcttctctctctccttatcccgggcggcgccatggtgggaggggacgtgcggcgacactcggtggcgtgaggtggcgctacggtgggagggaggtggcccgctcccctcggcggcaggaggcggcgtgcagcggcgggaggaaggcaacctgcgcagccgagtccctcggcagcgggaggcagtcggacagaggtggcccgcgccaaatctgaaggtgcggctcggcgaagacagccggtgtggaggtggggccgtcggcaggaggtgcgacggcgtcggtggcctaaccagagtgctttcatcaagggccgctcccttcatgacaacttccgctatgtccagcttgcggcaagggcgctccacgccaaatgcgttccccgacttcttctcaaggtggatatcgcgaaggcctttgacatggtcagctggcctttcttgcttgaggtgctagcccagcttggcttcagtcaacgttggcgtgattgggtctccctcattctcagtgcctcctcttcccgggtgctggtcaatggggtgccaggtatcggagaggtcttcgccaaggagatcctctttcccccatgcttttcattctagtcatggatgtgctcaatgcgatgctccgcaaagcctctgactcgagtagttttcttcccctcaatgattgtgctattcgacatcgtgcatccctctacgccgatgatctagttctcttcctttcccccgttcggtaggaccttgagttcatccaaggcatcctctctatcttcagtgccgcttccgggcttcagaccaacttcaccaaatgcttgattactccgatccactgctcggttcttgacctagagctggttcagtcctcttttccttgctcgatctctgagtttccctgcacctacctcggcattccactatcagttcgcaagctgccaaaagcggccctgcaaccacttgtggataaagcctcccatcggctccccccccctcgaagggtcgtctcaccactctggcgggtcgctcggttctggtccaatcggttgtctcttctattctggtacatctttctatggcgatcggcttgccaggctgggttatcaaagccattgacaagaagcgtcaccccttcttgtggacaggtacggactcggccaatgggggacaatgccgagtgtcctggacgaaggtttgccatcctaggtatctcagtggtatgggcattccggacctcaggatagctggctttgccttgaaagttcgctggctctggcttcagcgctcaggacaccccaactggtctgatctgaaggcctctgttgagcggagcgtctccgacatgttcgcagcatctaccttcactaccttgggagatggtcagtccacgctcttctggactgacgatggattgatggtcggtcgctagcttctatagctcctgacctcctccatgtcgtgcctccacgtttccggggatcgcgcacggttgctactgggttagcgaacaactcctgggttggtgatatacgcggtgccctcactgtcccggtcatctctcagttcctgttagtttgggacgcggtgcttcctacccagctctcgccgggtgttgaggatcgcctcgtctggtgttggacgggtgaccagtgctactcagtgcgattggcgtaccaggcgttcttccttggctagcactcttttgcctgtgccgacctgctctagcacgcgaagggccctgctaaatgcaagttcttcctatggtttgcatttcagcagcgctgctggactaccgatcttctccagaagcgtggtatcgatagccactctgcttaccccttttgcgcttaggagcttgagagggtgaaccacatcctcattaattgcatgttcgctcggtaggtctggctccgtgtgatgtcccctcctggctgggttgccctctctccccctcgtggcagctggctccaggattggtggtcatcctccagggcccatttacctgagcacctccgtatcggctttgactacttggtactcctaatctcttggcagctgtggaaggaatgaaactccagggtttttgactctgcgctcgcttcggtcccagtgattttggagtccatccgctcggagggccagctgtggtctttagctggcattgctgtttttggggatttcttgggagtgtagtgtggctctgccccctcctgttgtttggagtttcgttttaaccatcgtagtagttcctagcttcaggttttttattaagccaatctggctgattccgttgtgtaacaaaaactcttttcctgctaatattgacgtgcaatccttttacgcgttcgcgaaaaaaatcgatacatattaaaattgaaagtcacttaatatttaataatttataattacataattattgattcagtaaaaaatttaattgagattcaaaagaagattaaaactttgcatttatatcaatattggattgagaaaaattttatgaggaaaaataaaattaatagtacgcaccaagtgcgaagatgcatttcctaattaaaggtccatgttagtcatacgatgttaattattaagtttaattgcaagaattaataaattatgaaatcatcgagactccaagattacttgctagtttcaaattttatactctagcttcgattttttctaggcaaacgtttttttaggtttaaccaagtttattgcaacatttagcaatttctacgacactaaattagttttattaaatataacattgaatatattttgataatatgtttgttttctgattaaaatattgctatatttttctataaacttgaccaaacttaaaaaagtttaactagaaaatagtcaatgcgacttataatataaaatggagggagtacttagtaaatccagaaaaactataagtgcgatttcaaaccatgttgctttttttttatttattctaaattttagtattatataataagaaaacatataaagttcaactccacaatatgtacaactttgtaaatacaaattttgaattagtaaatttactaaatagaagcaacaacaaaattatttgaatggttttgtgtatgttgtttcattaataatttaaatttagagctgtttcagatatatgcaaatcacgtaatatgagattacccgtggttatccataggttaactagtccccgtataaaaacagttactcaagttagaagaatatttacctaaaccactaacagcatgtacctattggatgctttgaaaaggtcgttttaaattttatttacttgtgggcatatattcaaaggcgctaatggtgattacacgtataaatcaaattattaggaccctgtgtaatcttcctcggggagctggcttctccgaaaaaagagtgaacatttagaggtccaacaaatagaacctaattcagcaactaaacaagagaaaaactggaatgttacatttgagattgttctgaattattaaattgggttttaagttttcaattgttgaatagtttcatattagttatgaaagggtaaaagacctagtatagcttgtcacctcattggtgaactttaggggttgagaaaggtcatttaggatcatacatcgaatttgtgggatttttcatgaattatcctacagttgactgggattttcttgattttgtattggctcagaaaatttcatgaagttagacgaagtacaagttccaggaactgattcaggggacttttaaaattttcaggcttatgttatagtagtatattgctgcacgtattgacacaatgatacattagaaaaggatttcttctgcagctacctccttggttgagccgttgaggcacttatcatgaccttcaagtccatggtctatttccaaggttgtcagtatcccgatacgtataccagtatactagacactacgatccaccaaatcaaaatgatattatctcatctattatcctaattttcatagtatctcaatcttactaattgttttcgcacgttcctacgaaatcttaggtagtatcctaattctactatccctacgatcctacaaaatattatttaaaaataggtggattgaaaataatatgaataaatatgctcaagtttacattaaaaaccaattaaatttatcaaaatcaatattatatgctttaatttatacaacatattatatattttatataaaaatatgtattttctaaaatctaatagtatctcgatactgattatcttgtatatttttggccattgcccatatgtcttttggtattaaaaaaatgtctaagaaaaccgtaatctaatttttttgaattgaaagggtagttacttacttgacattgttttcctcttttcttccacctatatattgtcgattgctctctattgaattgaattatcaaattgaaaacgagtagcacttagtataacgtaagagggttaattaactagtgaaaataaacagcagcaggtcatgataaatttatttttcattagtcgtgagctcgattggggttgggtgggggggggtgaccgtccacacgatttttcattaagaataagtcatgacatcttttttgcccagaatcaagactggtgctaacttgaaactctgagtccaagtttatgtttcaggtaacctcaaactcataatccaagtttcatgggtaaggttaacttggaaattagtttatggctgtgtttatatccaaagtttggatccaaacttcagtcattttccatcgcatcaacctgtcatacacacccaacttttcagtcacatcatctccaatataaaccaaaatccaaactttgcgctgactaaacccagcctatgaccattgcccaatatgagggtaactgacgaaaatgaacagcagcaggccagtcatggtaacttttttcactagggtatacagtatggttcaactgagttttcataattgtcagagtctcaaaaataattgctctgttgaatcctggagtaggtcttaatatttactggtacatgttacaccaaccagtggtcaatagggatggaggcttgagtctggggcaaaagagttgtcatgaaaggccctcataatcagttatgacttttcgaatttgctgtcaaaatttagttatgtgttgaaaatttcagctgttaattctttcaattattgtccgcccgcactccgcgcaggatcatgctttggacttgggatgtacagtatgtatgtttcaggtaacctgaaactctgaatccaagtttcaaaattgaaatgtctagccattttttgaatcattcaattgagctatctgtagacttggaccactgaagtaacaggatttcacttcagaggttccgaactgactgctgaagaacaaaaccctggaactgcatttcctacagatgtgaaactaattctacatgtattggataaccattcttgattaatctgaagtggaacaataatcctgagcatctgcatagccagattaggaatgtaaggtaatcttggatctttattcaacaggcatacactgaacactaacaaaacaaagccatcaagctttttgcttctgcaggttctagttcttcctaattcctcagctccatctacttctactctccaaaaacaaaacaaaaagaaacgaattcaaacagcctatccttctcctcctcttccccccattcatttacacagctcaccacctaccatcacaaattcacaacaaactcgcatcaaattctccaccacaaacacatgtaagatcatcaaacaagcccaagaaggcacaaacatttttcttatgttttctgttcagagttatatggtggtttcaatcgaatggcgacttggccttggatgatgagttgtagatcatggcggatgagccggagaagctgctgctgctcggcggcgtgctcgacgacgtcgacgtggcggcggcggcggcgcgaggcggcgaggcggcggcggcgccggacttgaggaggaggtcgacgttggcgtagtcgtcgcggtcgaggcggatctcgttgagcatggcggcgacgtccttcatggcggggcggtcgtcgggggaaggggcgacgcagaggagggcgacgcccatgacctgcagcatctcgtcgacctcggcgtcggagcggccgcgcagcgccgggtcgagcacgtcggcggcgcccttccggcggcggacccagtcgacgacgtgctggccgtcggggatggtggggtcgatgggctgcttcccggtgagcacctccagcaccaccaccccgtagctgtacacgtcgcttttctccgttatcttcatcatgtacccgtactctgcaatgtttgttaatcagaaggtgaaagattgaagtaacttttgtgacatagtattgaaagccactgaactatatgattctgttcaacatttgtgcttaagatgggtggtttgtcctttttggttgcgtgaattttaagcggagtgggctcaattggttgtaccatcttgatgtaattgaataagtttcgataaagcttccattatcttaaagaaaaaacttacctggggcgatgtagccatatgatccggcgacggtgttggacgagcggccaaagtcgccgtcgtcgacgagcttggcgaggccgaagtcggcgatgtaggcctcgaagtcgagcccgatgaggatgttgttggccttgatgtcgcggtgcacgatcggcggcacgcagtcgtggtgcaggtacgcgagcccctgcgccgcaccgagcacgatcctgtacctcacatcccactccagctgcgcgccgccgccgccatggccgccatggcggcgctcgtggagcacagcacccaggctaccgttcgccatgtagtcgtacatgagcagccgtgtcgtcttgttccagcagcagccgaggaacctcacgatgttcttgtgccggatgcaccccagcgtcctcacctccgccgagaacgagtcgcggacgcgcccgccgccggcgacgtcgtccttgtcggcgccgttgcgggtgcttggccagagcttcttgacggcgatgacctcgccggtgtcgaggccgacgcggtacaccacgccggagcagcccttgccgatgatgttggcgtcgacgaggttgcgcaccacctgctcgacgctgaagctcagcttctggaacggcgtgaactgccacggccacgccaggtcgccgccggactccgagtcgctgctcccgccgccgtgcccgcccttcccgccgacgatgcccatcccgcgcgcccgtaggatcccgaccatgcccagcaccatcgccaccgtcgccgtcaccagcagcgcgatggcgagcttgagccggtgcatccgctgcacctcctcctcgtcggcgctcatcaccggcctcccgctggcgtcgatgctgacgaagcacacgtcgccgcccttggtgcagagcccggagttgccggcgaggcacgacgtcgacagctgccggaacagcttcgtgtccgggaggtagccggtgaagttgttgttggacacgttgagcgtgacgaggttgtcgaggccggcgagcggcgcgaggccgccgtcgagcgcgttgtacgacaggtcgagcaccgagagcttgctcagcgccgagatcctcgccgggatcggcccggtgagcccgttccggctgaggttgagcgcgatgtcgaggccatcaatggcgcagagttcgtcggggatgcggccggagagggcgttgtcgctgaggtcgaggagctcgaggttgcggcactttcccagcgccgccgggatggcgccggagagcgagttgccgctgaggacgaggcggctgagcgcctccagcctcccgaacgcgtcggggacgccgccggtgagctggttgtgtgacacgtcgatctcctgcaggccgcggacgccggcgagcgactccggcagcgcgccggtgagcgtgttgttgctgaggtcgagcatctggagctgcgagcagttgccgagctcggcggggacgccgccggcgaggcggttgctgccgaggtcgaggaagttgatgctcctcatcccggccaccgccgccgggatcgtcccggcgagccggtttcctcctagccgcagccgcacgaggctcgccgccttgccgatctccggcgggatgacgccggagaggtcgttggagaggaggagcagcttggtgaggttgcggagcaagaagatcccggggggaatggcgccggtgaggtggttgtgcgagaggtcgagcgcctggaggttggcgaggccggcgagcgacgccgggatggagccctcgagctggttctgccacgcgaacaccacctgcagcgcggcgaggcggccgagctccggcgggatgaggccggagatggcgttggtgtcgagctggagctggacgagcgacgtcgcgttcgccagcgccggcgggatggtccccgtgaggttgttgtcgctgagcatgaggtcctgcagcgccgggaggcggccgagcgacgccgggatggcgccggagatggcgttgatggagaggtcgagggagacgagggaggtgaggttgccgaaggtgtccgggatgggccccgtcagcgagttctgccatagcagcagcttctgcagccgcggcagcgcgcccagcgacggcgggagcgggccggagagcgagttctcgtagaggtagacgttggtgaggttgccgcagccggcgagctccgccgggatggagccggacagcatcgtcgtgtagatggacagcgtctgcaagctctggagccgccccagcgacgccgggagcgcgccggagatcttggtgtcggcgaggccgagcacgacgaggttggagagcctcgagaacgactccgggatctcgccgccgaggtcacggttgccgccggcgcgcagcgactcgagcagccgcagctcgccgagcgacgccgggagctcgccggagaggcggttgtcgaagagcaggaggtccctgagcgacgcggcgaggttgccgagcgacgccgggattgggcccgagagctggttggagttgagcgccagcgacgccatggccgtcgcgttcccgagcgaggccgggatggggccggagagcgagttgccgctgaggtcgagcacggcgaggcggcggcacaggtggaggtcgtcggggacgccgccggtgaggttggcgtcggagacgacgagcgacgcgagcgacgggagcgcggcgcagatgccgggggggagcggcgcggcgaggtgcaccgactggaacgtgacggaggtgacgctccccgtggcggcatcgcagccgacgtgcgaccacttgcacggcgacgacgccgacggcgaccagtccggcggccgcgccgccgtggtgttgagccattgcgtcaggaaggcgacctccgatgaagccgaggcggcggtggaggaggagaaggagaggaggtggagtaagaggagaaggaagtgcatggggcttggcaacaatggtggcaatggcagctgcatcaaaaatcgtgctgtgcttgcttggggcagtgcacaatacactatgctaaccaagcttgcttggttcaagagaggtgatgatctctatgaacttcactctcactcttcactcactcaccatggttcaagagtgaaaacaaacaccttgtttctctctctctctctctctctctctctctctagctactctctctctcttttcctcctcaaaacactcaacaggttgagctgtttgcttgtgtcttggtgcttggttgcttgctccagatggatagtggtggtggtggtgtcatggtgaaatgtgggtgcttgcttcaatgcattgggcttctccccaacacaatttaacaaagttttgcttcttctctctctattcaattggtgatgtgtgtgtagagagagagagagacaagggggtgcattggggggagggaagaagggagaagaaaattgggtgtggcactgacaatgggagcttagctactctagtctctagtgtgcagctgccctttggctatgatcaagtatttctattgtcaaattgcaaacaatttgcaatgctacactcatgtggagcatgtacaccatgcttttggtctcaatcgcaccaatcttgatgtgtatcttggctttgtaaatctatggttgagattaaaatcttgacttagttgtcaactacttaacttaatttgtgcggctgcgtcttctcccataatcagaagctctcacaaacagtacatcttttggtccagattttgagaagctgtagttctagaatccagaaaatgaactaaagccagaaactggaaaacccagcttttccagatcctcagaagctggctatcaaccaactacttctcagaattttaagttccaccaaacaggccgtaagacatgtttgattggcaactacaggttgctacctttttatcaatagaaattatcaaacttacctaaggttatgtgcttaaaatcttggtcatatcgtagatagaattttgcctctctttttagttattattaccacgtgcgatctaatttgttgaaaaggaattttaccacaattacgaatgcaaccaaacagttagtatctgtatttatcaaacttgtctaactctagatatggtaaattgtgctaagctgtggctggcaactaaacatgtcctaattgtgtgctctaataaatgttatttgtggctttctgtggtactggtgttggttgatgggggtgatcttcatggctttagaaagcaagcggcttgtggggaagccagtcggtgttgtgtcccctgcacaagtcgattgaatgttgacaatttaattttgcttgcttcatcagtgagggcaaaagcagcattaaatcccatgaaatgcgcggcaaaaaggtagggtttgtttccgaaaattaacacccaaaataattataggcaatgttcgaccgtacaaaggctaatgtatactatttttttggccaaatagtcttgaagtcaagtcaagggagtatgtacataggttggtcaggattgtatgtattcagagggggacaaaacgttaaaatgcagtttgaaaagtaagactgcaggtttgaagtttgtatattcagactgctatgatcaaatgtctaattgaaaatgtgtaaagagatcacataattgacctaattaatctcctatcatctttagtttggtcgaaaaaaacatgaaaagacttactattttgttaaaaaaaacattaaggaatcctctcaaatggaggattggcacgagatttcaattcccaatggattctttttcatgtaggctcctttgattcaagggaaggatttgaaaatcttcataggattgcatttattatcaatttcataggaaaataagccacattaagacttttcttcagttcaatctttcttggaacaaaatgtttcaacaagcttcgcaagcaaaccaatggcttctttgacttgcacctgccgggattgcaggctagacaatagacctgattgatcaacttgtcggggtctggagtgccattcaggctctacacctggtagagcacgaggaggacaatataacatggaagcttactaaccacggcgaatacacgacatcaacggcatataacgcacaactccttggaaccaccgctaccaacttcaacaggctaaactggaaagcctgggcgctgcgtaagtgcaagacctttgcctggctaatcatccaaaatagagtctggacttctgacaggctagcgacaagagattgactaaacggttccatctgccccttacgtcgccggacccatggaacagccctgcacctcctcgcggaatgtagatacacaagaagagtctgggcggaactagcggagtgggcagcgtgcgagcgactacaatctagccaatggcggcaaacttcgatggtgctagattggtgggaggctaccgtaaatatacaagagacacctaagaaggcactccgcactttggtgttgttggtcgcctgggagatatggaacaaaaggaattgcataaccttccaacagaaggagatttcagctacctccctgttagccaagatcaagaaagaggctaaaacttgggccttagcaggagcgaaaagtcttaataattggctttcttttagttagctcggatggaaggtcctcagcttcttttttttcctttcgttttgtaaagttttccttctctgttcaatgaaagtggcactagtcaatttgttaaaaaaaaaggtttctctttccgtttcgtgtgttttcgattctatacgattgaaaaaacatgctactttatttttttcccaactgtttttcctattgagcatttcaaaaggggcctaagagcctggctattctgaataacgcatgcttgcttgattgtcgcaagtaaacatagtagaatcccattttgtagtactccaattaacagagtgttaactaggccggagcctctagctagttaattaattagctaaatggtaaatttccagcatagagatgtcaagatgctgtatgggttattccaacattggatcacgtgtatatcacgcgcacagcaggcagctgcagattaaaattacagtaagccaacaaaaattagtacaccattgtttaagattgatgcagggaaattagagtactaatagctttttacagtgccaattaaccgtgtgccaaccttgaggtttacattccggttaactactagagcactcactgaatggtgggcctcatcatttacattaatctctcataggacccacatgtcagcgagtaattaccagtggctttgcttgtttaattagtaaagaaaatcatatagattcgcgctagtgttgagttggatgatgaggagcgacccgcacacgacatggggcatctctccacagtgacagccttcattgcgtgcagccactagttattagttaattaattaattaacgtgataagtaaacagagttagtggtagaaattaagaagcatcactctaattaagctggtcagggctagctggttaaaatgaggcaagcatttttctattactttccacattcacaattcagtccctctaatttatctgcatctatatgtacttcacctgcactacataattggagctgctataattctagagaagaacaagaagatcaaatctatcttgtttcaatcgattccaattgttaaattgtcaattcaaatcatggtttcaattaatcctatgtgcattgtatgaacaaatcctcatatatacatctattagtagattacaagtagtatcatgtttggacttgcaaagaaatcttgagtaatccaggatgttctgctaaacacatacatgcatatttaacaatgtgatcaaactgtcataaagtaaaagaaaaattaatgttaaaatcagaatgaaggtggtgtaagtgtgacttctgagaggtgtttaatactttaacaactttaccacgttggctgatgatatcttattcctaaccgagtactactactctctagcctctactcttaattaaccgagtacttgaattaacagtgttcatacaagctagagtctaaaccccagctctcgttgtctaatctacacaaattaaatattaattagcagctagctagtctcggcttagggcaagtactataatagatgtaattgttacctccaaatttatttatggcattcaccaataaattaagatgcaagatatccaataggtcacccctaatacacaaatatcaatgcctttagtactctcacatctttcttggagcttgtgtggaggctacctcttgatttaggggtggttcatcatctctctccttacttctctcctccacctcatcacccaatcctatgtgtcatttttaggggcagcacatgaaccattatagcacttgcccttagatggctcaatggtaagcttggtcttgggctttgagcttgtggctacctatttaaattggcaccatgttagggtgcagctaccagtcaattgtaacctagaaaggcatctcaaagtgtttttgattcatttgaatgttgggtttcttttgaggtatggtgtcaagcagaaggcattggtatgcatcaaaggattaggatgacttgtggtggggttaattctcctcctcactgtccccaaaatatagggcccatcactgttaagaataatagagatgaagtaaggaataacctagtttgatgttccatttctttttgtaaggataaatgtatctaatatgtttgatcgatgttccattaattgtagagtatgttgatcgaggtactagaatataaaggacatcatgtaaggttttacaaattaaatgagcatcctcaatcacgatggcaaggttgtcattcatcaaacaatttatatatctcaatataaacttttgtatgagagtgcatcaaagaagaaaagaaccatctttaagaatgtgtacgaaaagaaactactaatatggagtgaggacaaagagacttatctatctattaaattaatttaatttggtcagcagaactttgtgaaaggaaatattgcaatggtaagaaaatttgaaaataattagtggatagggaagtaagtaaataaaggatatgccggattcacaaaacataaatcatatagaatatcataaaagcatataaatttggatcgttgattctttagtactcttttggatgatgattcttattgcatccgttgtgcatcttacaacgaattatcaagtccatacgtgcatgtgaactctctatcttgttggcgcatgaattgtctatccccaatggtttttgcgaaccctggtcgtcacagttttaaattagttacacactcttaacggtttgtgtttccacaaacatatgtatagtaatgaaaacagcaaacaagacccagagttgtatggcgaaaatccagaaatggccaaaattggtggcaacaatgaccccaaaaaactaatttttcctctaaagtccaatcaatgactcctggtacaagtaataggaaacaagccagctggccaacttcatgtcaaactgtcaatataggtttaggccaaagttgagcgtggttgtttcaaaaaaaaaaaggaaaaatagtttagtgtggttggttgtattgtcacttgattggctatgggtcaaagctagttcctggttttggggagttaaagagcaagtccacattggaaagtttgggatggggacccatttgacggccagatgatctcctggatagcgacaagacaatgcatggtgtggtgtctcttcatatggttctgcactcgtgtgcatttaagacattatgattgggttgaaatagctgtgtaccttagagaaaacctttctgttttcttaactttttcagataactattaaatgtaaaaattgtctaaacttattttggaaataaatcttttgaccacatccctttgaatatgcaggcacctaaacctctctatattccatacagttctactccatccgtcctaaaataacttcactctttatcaactagtttgacccaaataacctcatcctttaagcaattatcgcattagaaatttgtgaaagtgagcaataaatgcattacgatttataaaagtgacagacaattgcatattgaagtttgttagagtaaagggcattctaggttttattttttttacctttgtattggtatgtgtaggatgtgtgttaaaattaaagttattttgggacaagtacactgttacaacactatgatgtgctgaaaggttcaaatctagacctaatatctatgtgaggatttatatttttcatatatatttttttaaaaaaaatgaaaattcaataaatatgtttatgttgacgaaaacatgcccaatcttataaaaattcaattatggtcatagtttcgtccaaaacttgtggctatggttcatgtttgcaaagctttgcatcgatgctgtggaagtgtggagagatgagcatgttcatggtttcaagtttcaacaggccataaggtcaaaatgtcaaatatagtacaacgatgtacatttaaaataatcactaacatgttttttaattatggttaaggtatcaaagctatatgcaaatataatcactcggtatatatgacgagcacaaaacttatcacccaactacttctataaaagtgcattttagtactaatgctaacactgtatatatgaaccatagccacaaacatgcaaatataagacactaaatgcaaaatattataaataatggttacaaagaccatcaaatgttgcaaatatacgaagttttctgcaacggacgcaatgtttcatcatttcctacgtcctcagcatttttattctaattaatgaagcacataagaagttccaaacttcaagaactgatctaaacttgcagcagaaagaatcatgatcggttgtgggtaacacaaggagggatgtgaagacatgctccatgtagaaattaaactgttaaaaccccaagaactggatcatgcagtgcatgtggatgcaggaaaaagtacaaaccgatcgagctgtaaaaattctcttaccggatgtcactaaattactagcttgctctgcagccctgcaggcacaaagctagcaggtttagtggtaaaaacaagaattctagatcccaatgcaatggctgtttgtttaggctcaagtcgtttctcagatttaatttacttaattaccacaagataggtgtaatagacatctgtattttttttactgcctgaattatttagtactacacactagtagtatttagtttacacagaacatggtgggtagagactaatatatgaagtatgatatgattcactcttagctgtagtttacttgggtaattacatgcatctatagaacaaaggcactactcctatgttttagaggtaaatggagatggaagaaagtaactagagatgcccatgaacttgtgctggtaaaaaaaagagtagtagaaaacttaaagaacgccctaaaaagcatctcagcatgcagtgaccatgctgtataatcaccagccacactgcacaccatccatcccggtcagctgctgctgcttttgaagcgagtttaaaggttaaaacactggcctctctccagacggattaactatacacgcatcccaaggttaattaggacgtcacatgctgttagattccatctcacaccgcttaacccacttaagtttatcttaccattccatctccatctctttttcaacgtgtattatgtactatacaaagctacaagcaagtagctaggctcgtagccacgtggaaccgccgccaaaagatccaaatttctttgtgcctattagcaaaacattagtatgcatgattatattaatttctgaattgggcataggtcttaattttgttttgtaggctgggtgatactgatgttcatgatagatgtaaaatctgtttagttttatccttttcaattaaaagttctaattcctgggatgtacaccaactagagctgtacacggacattacacgtaaaactaaaacctgtatttctagcatggcggtcaataattacagttaagggcaaagagtgcctaaaccagtggatgtatatattacatatatgctcctttgataaaggtaccatcaatctcattggtagaatggagtagaaatcacctagtattgtttagatggctgtctacactgtgatttcaattatctgagaatttaaatgatgtggtgactggatttcatataaacagtggtttccactgtaaagttacccctactatcttaccctggaagcgctggtattttacggatatttctagctgttatctaaagaactcgtgtaacaggataagaactttactggaagtactagaacaaaccatagagaaaactgccgttcgctgcagaagataaaaggctcggtaaatagcgtactagtacaagatagaccgcttagtgcaaagagaaattattcttcgtatatttacaaacaggaatttaggaaaccaggatacatactgccaagaaagccctacttgtaatcttgtatgcatctccatcactgatcaagtagccagctgttaagcaagtccagtgttagtcggatcagatgtcctagaaatacatatagtaaacatttcagtgcattttttttatgctagtactacgagcagaagtctagctacaatgagattccagtaaacctaggaaaccaagaaatttgatatagggatgactgaacagaagggtgaaactgcaaattgtcaacaaacctgaatatggcttcaaaagtccacctgagtctatgacccatccatttccacgaccacaggagcaaactgcattcagatgaaaagaatgttttcactctgagtgcagcaaagaaatgctatcactcgatcatgaatcgtgatccaaatttacctcatcatcttcatcaattagattcaccgtattgttgtcaagatcccatccaaatgtggtctccagaagtgattttagttttcgagtctgaatatatggaggtaaacattagaaacatcttttgatattattccaacattacacaataataaagctgaaataaattttctacagaaataatgaggctggctgctcaatggattgaatttgcagcatactttgtctgcaacgtactctagttatgaataaaataaaaaaacatttttctctgatattactctcctctgttcatataaacggcaaccacagaccaatcattcaagtgcacgaaaatataactccctcaaaataactggtcaaaggtccataatttgtggttttgtggatattaaaccaggaatttgaagtaaccaaaatactagtccagctagggtattttcagagaaagtatgaagttctaaactcagtctaaatgtggtaattcaagcatgggctacagaattggttatgtggtatgtgttaatgttaaaaaaaaaggataagaaaggcccccccatgccaaaagttccccatcaccactggtaggcttcaagtatcaccgcaaagaaatcctgacaatagcagaacaagctattcagcttctagctgtgcttctaagcaaactgtttcttactccataattcaaatatgcgataagaaatcatgcttggtcatgattaaatataatgattccaaaataaatcatgaagtcaaatgaactgaacaatatattcacacattttccagatatgcaaattcacctctaccttgatgagtttactattattataggtgtttaatagtcctcgagtttaaaaatgtacgaatgttagggtcctctgcattacgagtcccaaatggacgatcaaacttaagttagcaatgaataggcacactgcgctgctgcttactgtcttcacaacaataaaaaacagtaaacatgtaactaattgaatccaggatatgtctgctaactatacacagtgaagctaaaatcgttttacttcaggtccaagcagtgcattcattgcaattgctaaggacccatttaaatgcaattatggagtaatcaatataagggtgaaatacagtttcaaatgaaaagagcagtgatagaggagagatgaggttttactaactgttgggacatatctggtaggagctaactaaaatacgaaaaatgactcgatcagtagccagtgttggacagtggtgacttgttgtggttgtttcaagatgtacaatctgatctagagatcaatattaccattacttgatttttcgtatttgacacaattaaaaattatataatgttttttcttagtcatacaactagttttaggaaatatttaccttaaacagtaagcatatatcttgtaaccaagaagattttgtagggttatcaacaaaagatggtaataagtaccttagaaagacgatagagaaatatgtctcttgaaaaccatgcttcatctaagaacagagaattccccatttcctcaccacttctattatcctgtgtgtgctgaaagccatgcttgagttgatagtaaattgccctaataaactgaagcagcacaaaatgacaaggaaatggttgattagtcattatcatttcagaccatctttgccctgataaattcagtaaaacgtgcccatatatgaacagtagaataagggcaaatgatacctttacaaacaagttagtccttgtatgaagaggctgtcaaaaggaggaaaaattaaaaaaaaaaacttataagttcatgaatatacttgtgccatcatttcttatgacttatgaggtatgatttaactcggacagtggtatgtgcattataaatttgtagtagtactatatagtgcaataaatcctcaagaaggtaattataaactgtcatgtcagtgcatccgttcgcttcattgttccacactcccagcctcaagacaccaagtaaattcagtttgttaacattgacggaaagcattcatgtcttgaagcatgtgctcagcttcatcaagatgtaccctaagatgacagttttaaccaacagaatctggttactacagataatgatgagttgttgaaacttttagacagcatattcatggaatttggttgaaccaatgcttacagaagcacggtagcttcttcatcaaaatgtgtcctgagcagtttaatcaacctattacatgtctcacttcaaaaaagaaatggaacctctagccatctgggtacaagcgaagctctatttttgcagaatgcagatgcaagcagccaccaaaaaaatgctcaatgacactattttgtgcactctgatttttctgttttgatagaaattagttagcatgtttaaataaagagtagcactattgagtaggcagtacaccatcgatgaagcaaaacatgtacattctatccatcaatttgtgaagatgcagtaaaagtgctgcttaatattaacagaaagttgagataaattagtacttacagcttcactacagctcaaaagaagactaactaatgctttccattgcataaaagcctccagtgactgccccatctaaataactcaaaaatgttaagagaattatgatttattgaatgtctttaaagaagttggtttttttcagtagtaccataaatgctatgaaagcaaactgcagctctcccaagagtaaatcctcttggccttggtaattcttggccaaaacactctccagcaagcatgtctgagaagtataatagcttcatcagcaaataataatacaatttttcgatttggtgcaatttacatgaggcatgtgtgaaaggaatcaatccaagcaatccaccattagtagaaattactatgcctaatgtagaaactagagcatgagagcatatctaacatgaagcccagaatattactttgtccagatttaatgcagttagctcatccccagagatgttactatgcttaattgaagcagggatagttgtatagtagcatcctctccgctcagactgcacaggagcattctttgcaaattttccatcttttagttggtccattaaacgtctctccatgtctgtttgcggagctttatccatccatgatgactcccatgcaattgtaatttctccaccaattggctctggagatatcaaatataaatcaaatatgtaataaatgtgccgacttccaaaccaatatgagaaacaagaaggaatcttgcataccaagacgttcaatgacactttgtggcaagtagcttgagagttgtttccaatctccaaatgaatccaaattatatggtccaagctgactgtcaaactcgaaatgtcttactgcttcagaatatctgatttcctaccaaaaagtaaacttcagtttcctaaacgaaaaaccaactgggcatatctgttatgtgtatttttgtcaagtcatagtgaattttgcagaagcacaagtctgtggaatatgtacaagttaggggtattagacaaatttaattttacctgattcatgtaatgtacactgtttctcactaacaacagtggcaatccatagaaaaacaagttcaaacttcaaacataggttgagtgcattttgtctagtcctttttttagggaattgtctagtctaatttccactgtcatttatggtgcaagtatgagagagctgcaattccaattttaagcaatgtatcttatacctcattataaactgatttagttattcacaagttgccatgtctgtcttcataatgtacaatcacaatacaattgatacttggcatactttacagtttaacagcgcatgaaggaaatatgaaaattacaggatttaaaagaacttgaagctactataccaacattcagcaaaatgcactcttttatcttctgaaatagtggcttttcaagacacttccatctcagttcagtgcaatgtagcctttataagaactagaaagggacaggtgcttctatgctccacatactttaatttgcaccggtttcaaagcaatattaacattgcacgcatcggaggatcacttggatcctagtactggaagtggatcaattggttgaaatataatgctttttgtttcaaatggtccattagcaacatataaaagcagatttcctggttttcagtaacgcagccaaccagaatgcgtagcaattgaaggatcaagacattcatcaaaggaaccaaagcaatggaggcccaatcaatagtcggaaggtttccattaatacccattccaaaggttcctagaaaaatataaagtgatataatagattaaagccaattctatcaatcaaataggtcccctcttcttcgggaagtttaattaatctctcctcctgggcatgccacttccgaccaatcacctggaaatagcacacagaaaatggtactgtaaacatgcaagttactgccatcatcagaatccccccccccccaaaaaaaaaaaatcaaactttgacttccttcaaaattttaagtacagttgagaatattaatcgtcattcactgtgacaacaatcacaacattcattttcatctcttgcttcagtacatcttacaagtgagttcttctttgttggcttttcttctgttcattctatagaccaaattagattttttttcttttagccaggcatacatatctatatatatacaatacatgcaagtttatccattatttgaaaatgagtggttagatccacgcattcatgtaactacacttcagcaaatcatatcaacagtatcttatttgctaagatgaaaataaaaaagagaataacatacggtagtaatgcaactgtagtaaaaataaatacaatactactttatttagcaggacagggttctacattttgaattcaccgccctatctgattttccgtggctagcactgataaaagaaatattagctattcacagaataataaatgtagtggatatgttgatggttcatccttccaacccccattttcagtaaaactgacatgttcacatacaacagagtagcacaaaacaaaacccaggatgcagaattcagcattaaccctagaatggataatatctggtgccatattatctctgcgggcaatttaaacttgatttggggcatcatgaaagagtacctcagatgggtgagtagtaagaaagaatccgacagtaggtgcgaactcatttgcgtgcctgaaaggatcacagattgtggaagaataatcaatatgtggcttctcatgtaagttgttttggccataactgaaagacacagaccatgcaggcgaaatggaacagaatgcgtaaaacaggcacaagtggtttcatcatcttaacatggttttctgaatgccataactccagatcaagtaatcaaacgtgctgctactgatatatatcaagaccggtttacaaatgttaatcaagatcggtaccagtgatttcaagtcgtctagtcgggactagtcgtaagggcaccgactagtcgactaatcgcgattagtcgcaactagtcatagattagtcggtgactataggctagggatatgcaggataatgtacagatgtttataagtattaattaccatagtatactagtatagtatagtacaaactaaggataatcagattttcacagttgacagttcacacttgacataaggtcttaaagttaaatcatttacctgtcctagttgcaataagtccttcatcttttctcccctctctctcgtgactagatctagatggctggttagggttagatgaggggtacaggccttcttgggctgggcaaaaggcctgccactgaagtgtaaagtccaacacatatttttagccctaacagactagtcatccacgactaatttgatcgactctcatgactagtcgtgattagtcggacgataagttttctggtcaaactaatcgcttcaaagttcatgatcgaggtcagggtagcgataaggataactaatcatgattagtcgcgactaatcggacgacttgaaaacactgatcagtacacaaactgttgtgacccaaagaagcactaggtagttaattacgcttcgctaagattgtcttgtcaaaatggaaggtagaatcgagctatccgatccaattgatgatgctacactagtacactagcaaggttcttttaataatttttttaaaaaaaaatcaaccttacatgcatatcactcagcacttgctggctaaacaactctgcacaagttgactgacggtgtgataaatctaagaaatagagaaatgggatgacgcaatgcaacctgttgggggagcagtagtagaggaaatgcggccccggaggcaccatcttgatccccttgaacttgggcccgacggagaacacctgaaccgaatcgaatcaaaagcagcagcacgcaagaattagcctagcgaggagaaaaggtggggtttagggtttagggaaaccaacctgggtgtcgacgccgaggagggtgcgctggggcacgtcgaggaggaggagcgtggcgcccttccgcaccagctccgtcgccgcctccgggtccaccgccgccgccgcgccgccgccgctcgacatggtgccgcccagaagagaatgaaggacccagaaaagaaaaatcgaaacgaaacctggtcgggcgggtggatcttctgcggctggactcaactcgtgtactcaagcgccgattagttgccgtgtattggtccgttaacttgtgagagagcatctaatgcactcacctcccccttaaataagcaggcaggtttaaaaaagtcacacaatattgatcaatttgcttcttcaaataaaagagtacttcaaaatcatggtgttgttggaggagatggaggaggaagatggccttcagattcttcctcatcagtaggagggcatcggttggaacaaatgggagagagcaatccagaagagatgtgaaggattcataaatggcgatgcagagagaggagacacagcaacgagctcacgtagaagtgagggaggaagaggcaatggagacgaatcaagagctagaagcagagcttctcgccgggataggggaggtgaggttcaagctagagctcaagcggctgattcagggagatgctatctctctaagtatggctcttcctttgcaaattctcatctggcaactaatagaaatgtactccctggtggcgttagggtactagcagtgctatggaagaaaatgacaagctcttttatcaagaagtggatgatcgagctcaatcagaaggaagcaagtctcagtttctccacagagtcaagtcgcacctgactttaggtatggcttatttggctggggctcaagctgctaggaattatggttctcctgctacgatcgggggatgttgttctgtttctgggcatgatgtggctagcgttcctcgaggaaaacttttgcaaactcagcctcaagatcagcttcttgcacatggggattacttgggattggagaaaggtcggctcacttctcaagggcagttggcgccagcccacaaggtgccacaggcaccatgactttcttgagctggaactgccgaggtatgggaggacacctcggcaggaggaagatgcagtacctccgtagtttgatcagctccactctcgctcaggtaatatttatttctgaaacaaaaaatgattctttcacttcctctgatctcactgatgcttttcatgtagataatagctatatagttcctgttgtccatgcttctggtggtttgtggcttttgtggaataatgaagtggacctcactgcgatgagtagttgtgccaattatatagtagctgtaggtgtttcatatccctagtggcacgatgtttaatcttttgtatatatatggtgatcctactcatcttagttctagcagaatttggcaggaggttagtacttttgttaatcaaagtagccatcgtgccaccatctgtatgggacacttgaatgatattatgaaccttgggagaaatatggtaatgctccccctaattttaatcgcatctctatgttttataatcatttgagacatgttggtttgatggatatgggttaaatatattattaacaccagaataacggattgatgattttatcaatgagggtaataacgtcataatcatggaacggggttgtgatacttagcctgagacggtcaatatcggtgtgagaggaggaatgcttcacgcaagtagagacttcggtgacgtgattctcatatgagggtatcactgcgactaacaaataagagtaatatgagggtatcatttttacttggtgttaatttgtacattaatccttaaaacagctaactttctggcattgagggagtagttaagttggtattttgacttttgtggtttataagccaatagcttaaaacccacaaggtcaagagtagtttcctaactccacttcacataataagccaagaaaagcaactcaaatctagctttcagtccattaatgtagtagtaacctatagctttagaagggaaaaaaagcctttagagcaagttttatgtagaggtggatactacatctaattttagccgtgttatctactcttcactacacatacccttataataagggttaattggatccatgccactgcaaatatgtcaattcggaaaaatgccactactattcgcgatatcggctacgtgccactggaatttggcgaaattggaaccatgccattccatcgcattttccgttaaaaatccatgttagaatccaactgcgcatgggacccacctccctcccctctctttccccttcctctctctcacccgcatcaccagctgccgacatccatggcggagaagcacgccggccgctgatttcctcgacgacggcggcgagagaagcgcatctaccggtggggactatgaaggggagggcttgccggcatccaagttgcagcagtggtggtggcgtcgtcgtcgtcagcctgctactgctgctgctgccgccgttcagatccacagcagccacctgcggcgcgtcagatctaggcgtcaccgccgccgcaagccgctcgagctcacttgagatatccgagttgaagctcgagtagtcactgaaatcccgcaagagctcgagcatctccgtggtcgcggcattggcggatgacgacttggccaccgccgccgggcagccgacggccacggtgcaccggtaatacgcacgcgggcaagggtttcccttcgccatcttctacccatacttcctccattggcacccatcgctgatctgctcatcaccatatcgacatctcaacacaaacatccatgcgaagaagaagaagaacactagctgcatatggaacatgatcgagcacacacaccatgggtgcatcggagcgagctcgaacggagacacgggccttccgcatggagtgccccgtgcggcattgcggcacaggtgggtgcagaacgtggggtgcacggaggacgcgacggcgttcgtgaccctcgctgccgccatcggccggctactgctgctgctgctactgctgttgccggccacctgctgctggtattcgtcggccatgctcgccgaagagagatggggaaggaaggagagaggggatggaggaagaggatggagctgacatgtgggtcccaatcccacactgaagtgtgacggcgatggatgaaaaatgtgacggcggtggcatggatctaattttacaaagttgtaatggcacctagcagatttcgtgaatagtagtggaattatcctaatatgacaaaattacagtggcatggatccaattaacccataattttatattgttggttcactttcacactattacactttctctttacacttttcttggagattgcatagatattgcccgttgtatgagaggtggctcgtcctctctcccttctcacttctctactccaccatcacctaatcccatgtaacacttctagaggaagcacttaaagccttatagtaattgctcttaggtcttgagtcatctttgtttgggcttattggtgtagtatttgcagtccctggtgtattgcttggccatcgtaaataagtatcatttagtgggaatagtgagtactacaaaacctatcatttaatgaaaatagcaagtgctatctctacatgtaaataagtaacattttaaatagcgatacagtcaccaaaacgctatatatttgtaatcagagggagtgtatctctataaaacaatctcctgtatacaacatgaagtcataaaaatatgtgatgttttatataacaacaatatcaccaaaatattagttcttatcattttgtagtacacaaccaatgagaaatgtaggatatatattattggtgttatgaataaggcatatataatacttttgtgttagactcggcgaggcatcatatactaaatcttatacggaattaagcctcatatatagaaggtgttccgggtaaggactactcggataatatccgtacttgactccctaattctacttagataaggggacacccgaggcgaagagagacggagacaagtcaagacagatctagataatctaagacaagcctagacgaactagatacagagctacagaggtcgacaagagggatctaggatgacctccaatctcgccaagttcatattcgagcaagcataaagtagattagatcatcctaaatattgtactttctcgccccttctatatataagcaacaccgacttcagctaataaggagtaagggtattacttgtcagtttaggggctggacctctataaaaatccatatctcccttctcttttacatcaatctcacgtatatcttagcaccaatgatcggggggaccctaatgggcatgtgatcgctgtgggcgatcaccccccatccctcttacacgctcctctcccccttcctcctccacttcttctcttactactacaccataaattttaaaaaataaaaaaacaaagttagaaaaaaaattaaaatagaaaaaaaatctaatactcttattttatgtgcatagactctgtacttatgtacagactttataccgtaaacttcgcatgtacaaactttatgtatagaaaatactatatataaaaaatatttgaattcaaattcaaatttgaatcgggtatataaacttttgattataaattttgtgtctatgaactttaggtgcataaactttatatatgtatagaaataatatatataaaaaaacatatttgaattcaaattcaaatttgaatcaggcatataaacttttaacttataaactttgggtctctaaactttaggtgtataaactttagatgcgtacaaactttaggtgtataaatttactaaaatagaaaagtaatacggtgaaaaaaaagaaaaccaagtgcatgtttggtacaactccaactcctaaatttagttccaggagttgggtctgaagtggagttgtagagctgcctaaacccagctccacaactctagttcattttgtgagagctccacccagctacactcccatttttggtggagctgaaactgtttggctgagctccagctccaggaagggtggagttggagctggagctgtgccaagcaggcccctcgtgaggagaggcgatcgatcgatcgcccgcccattaagaatttcgccaatgatccccacactctatcaatgccataggcgcttatatcttaccatactaattcccctttttttcagtccaaatgccgccacctcacagttggggattggaattcggaatttggaaaggagaggggaaagtgaaaagaaaaatttaaaaaaagagtaaatttcactttgggtcaccttttattaccagtatttcactttgggttacccttcaactaacgttttcacattagactgggtaatcttacatttgtttcactttggaccaccccgattctcttctcaagcatatgaacgacctcgagtacgccagctcctatttgtcaataaacctccttagctgtatttagaccgtttctttaacatatgacaaattagatgtagatgaataagagagttgagggtagtccaaagtgacacaatggtaaacatacccgatccaaattgaaaacatttgttgaagggtggtccaaagcgaaacaccggtgtcggagatatgggcccgggggtatgcaaagtgaggggaagttaccttcccatccagccacgtgactctacagtctagccctccccccacgcctcgggagacgcaggggcagccagggggcctcggggtgccatgttacgccccttaggcccccgcgttgacttgccccgaggccctcgcccgaccgccatgtggcggggggagcgagcggggaggagacccaagccaagccgctaccaatgcgcgcggtgccccaactgcccctcatcgcatttaatgcggtaagggcagacaaacggtgccgcccgactgatgcacgtcagtcgggtctgaccagtctgtgaccggcctatcgtcggtcacgtctgactggacaggcggccgtacccccacgtcgcctctgtatccggcggagtggaggtaggtatgtcctgtcacatcggagcgtcatccggagttctctccacgtaaggagagcagccacaagtctccgcccatttaagagcgagtgacagggctgtcccccatgtcaggtggggggtggcgccgggtgacactgaaaggcggaccgctttttagcttccgggcgaaggcacgaatcacggcccggtcaaggtagagtgggtccccctcccgtagaaagagcaggtagaagcggtgcatgtggtatccccttgaactataaaagtaggaccttgtccaccgggaaggggaacgccactcagtaggcctgaactctagggaaagaagagcgagagtgctctccggagtttaggaacccttgtaacactcgaccataatctcacacacaagagtagggtattacgctcgatagcggcccgaacctgtataatcttgttgcccatacgcgattagcagcattcagggtggatacgcaatctcgaaaagcgagccttttcccccggccgaactcacaaaagggggatctcacgatctcccgctagagaggatcactcctcgatagctggcgtgccaggtagggggatttcgcgcgctttgaagacaagtcgttttcttctgccccaagttttcctccgccttcgacgatcatggtcgaggtattggaggaggaggtggcggtgcacacccccactagcgggagccgcggcccccgtcaccgtcgccgcaactctcagactccgccccgccgcgacccctcgcggagggaggattccacccggtcgggtggctcggcccactccccgcctccgggcggggggaagccacgtcgcgtcggggtgcgacaccgcctcacttatggcgacggcggctcgccccgaggcgcgcttcaggcggcgggtgcccttctacggcatccccccgtgaactcagggccagagacccccgtccagcgatggttagacgacgtggccaacctagtcaccactgcccagcggcagttggccgcggccggccggcccaccgctgctggtacatcgcgtacccccaccaccctctcctcgtcagcaaggaggagggcccatcggtcggccacggcctcgaggcgatccacggccccaacgtcgtcgggggcctcgggaagtcgaagacatcacgacggcctctacggggaacaggacgctcgaatcaacatcgagcgacgccgggatgagcgccgcgctgcccgcatgggagaaggcgcctcctcgtctagagtgccacgttcctcctcgcgaggcggcccgccccccacgttcaccttggagggactggttgtagggccttcgttgcgagtctccggaatgtccggtggcccccgaagtttcgccccaacctcacggagaagtatgatggcaacatcaatcactccgagttcctccagatctataccatgatcatcgtggcggcggggggatggggggggcacgaccaggtcatggcgaattatttccccatggctctcaagggtcaggcgcgcggctggctcatgacccagccccccgactgtcgcgaccgggaaaattgccttttcccgaacgctagtgtattaatccccgtcccaggaaaagccggggtacaccatacaaacatgatataaaagacacatctttattacatcgataatatttacattattacaaaggcacataaggcctgacaatcaaaaataaacagcagcggactagcgggcctacggctccatcttcacaggcgctcaactggggtataagccaggactccacctaagacatcttctccaaagcttctcttactgaagggggaaaagattgagcaagaatgagtacaaccacagtactcagcaagccacaccggcggatgcataattaatgcaagggaggtacaagggaataataatataggggttaagttttgcagtaaacggcatttaaaagtcacttagttgccccaaagccattttataaagacgatcctagagctacacagtattattaatcaaggccgtgaaccctcacgaacctgccttaacccaaggcctacgatgattcagaccgaactggcaacccgaccctgggtcccagctcgtcccaagccaacccaggccaaccattccatattttagttgttgagcaaattttaagaattagaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccataatcaagagtaccgacccaatcctcctacggccgggacacccgggacaggcaggcaggactgagccccctagcagcagggcaccaaccctctgccatatgacatctcgactaccgggccgcagctcgtgtagccttcatttgccctggagaatgtccatcgacccccgacttcatccatctccaatccgtgtacttttgtttatgactagattgagccacaaactaagccttacccactagacatgtggaagtacggtagtgctttgcaacagaggcccgagcttaatccttatagtggccggggtgctacttcccacaactggcatgcacccaaaccccaccgaaaataggttttaggggttttgaaagaggaagagaggtgtatgtccaattccaccataaaccaacaattcatagtgtccaggtgatatgaatattcccaaagtctaaaattataaaaccacctaatgttgtcctattaatcggcgaagcatctacctaaattcatactagtggaaccataaatagagtgtccactagttggggttttgtttattctagggtgaacaaggtaataataacaataacaataatagtatggtcctaacaaaggtaaataggcatggctaaataaaacagtgataacgcgggaatttaaataaagcgataatgcattaatttaaatcaaattaattttataaactgggattcaatatgctcaaggatgatgtgacttgccttgctcgctttcccaaacgacggcttcgacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaatttttaattaaaaatcccatttattgcgtcagccgagggagcggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgctggcgcggccgacgggagcggcgcgcacccgcgctccgatggtcgccgccggcgaccaacggcgcggcggagtggcacccgagagagaggagggaagggggaaaacgaacggcggtcttcggctcaccccgggacaacgacgacgacgagagcggcggccggagcggaggaagacggcggcgcggttcgggatgacgatgacgacggtgctccggcggtcggcgggcgaagcggagcggcggacggggtcggcaaccactcggcgaagcggacggaggtgtcgccgagtaaggaggaagtccggagcggcgacggcggcggaacggagctcggcggcgatggcggagagagcggagcacggcgcgagcacgattccgacggcgagagcgagcggcgagcggcggaaacggaagagcggagctcggggaacgtttttatagcgtcgggagggagagagggcggccgggcgaagggggaaacggccgcgaaagatgcggccgccattgatgccggcgaggtttaggggaaagattccgagcgaatccgagggagagagagcgggaaaagtggggggaaatggcgagggaatcacggggagtaattccccccacttcaatgcgcgcggggacggcgggatgcggcggatttggcggcggcggcggcgctagggcacgggcgggcggcggctgcggcgcgaggagggagatgacaggtgggtcccacccgtcagcgagagtggcgggcgggcccgcctgtcagcggcgcgcgcgcgcgagggaggccgatgggccgcgggggaagagagagagagagggagggactgggccgagccggcccaagaaggaaaaaggggggggggggaaagaacttcttttaggatttttctttttataaaccttttcaactttgtttatttcttttcaattattatttgtgctctgaaaattccactaaaatttgagggctccttttaggccaaggagaatttaacaaaaattctccgggccacatttgaatttttcttgtacgtattttagggtttgccaatttcttttcgaattttaattaattctattattccttttagagaatgatttttatttcgggatgaatttatcaggacgtgacaccgactccatccactcctggaaggacctgtgccagcagttcattatgaagttccaaggcacgtacccctgcctaggagaggaggcggacctgcatgctgtgcagcggaaggctgatgagtccctccgctcgtatatacatcgtttttgccaggtccgcaacactatttcgtgcattccggcccacgcagtcgtttatgcgtttcggaacggcgtgcggcacaaccgcatgctagagaagatcgcctccaaggagcccaagaccaccgccgagctcttcgagctggcggacaaggtggttcggaaggaggaggcgtgggtctggaactcccccagcaccggcgcggcggctgcggctgcccccgaatctgttccccactctaagcggcgagataggaggggcaaaaggaagccggcccgctccgacgacgagggccacgtccttgcggccgatgggccctcacgggccccgcgcaaggagaaagccaccggcgacaagccaagctccaccgctccctctggcgagggtcggtcggcagacaagtggtgctcggtgcacaacacttatcggcacagcctcgccgactgccgctcggtcaagaacttggctgagcggttccggaaaaccgatgaggagaagcggcagagtcgacgggagggcaaagcccccgcgacccctgccaatgaccggcgaggggaggccaagaagaaggccccccagatgacagcgacaacagtgaggatctggaattccaaataccttagggaaccgtcaccactcttgataggggggcttgcgctcacacctcccgccgcggtttcaaggccatgaggtgtgagcttctggctgccgtcccaactcacgaggcggcacggaaggcgcgctggtcagagatgaaactcaccttcgaccagagcgaccatctgacagtgctcgctcagggagggaagttggccctcgtggtctcccccaccatccacaacgtcaagatgaagcgtgtcctggtcgacggagggggggggcagcctgagcatcatctcctcggctgcctttgatgcgctcaagtccccggggatgaagctccagccgtcattgccgatcatcggcatgaccccgggtcacacgtggcccctgggtcatgttgagctcacggtgacctttggcgactccaccaacttccgcaccgagcggatcgacttcgatgtggcggacctcaacctgccctacaacgcggtccagggcaggcccgcgttggtgaagttcatggccaccacccactacacctaccaccagatgaagatgccaggtcccaacggccccatcaccgtctgtggcgatgtcaaggtcgccctcgcctgcgcggagcagcgcactgataacctggcggcggccacgaagccgcaggccccggaggcctctgcgtcccgcgcttccaagaagcgcctcgcctcggccgatgaggtgcccgtcaaggagattctccttggcgatgatccgtccaagaccgccaagattggtggcaccttggacgccaaataggaaagcacgttcatctccttcctgcgggcgaactccgacgtcttcgcgtggaagccgtcggatatgcccgggatccccagggaggtgatcgagcaccgcctcaccgtgcggccgggtgcgtgacccatccggcagaaggtacggcgccaagccccggagcggcaagccttcatccgcgaggaggtgacgcggctcctggaggccggcttcatccgagaagtcatccacccggagtggctggcgaacccggtggtcgtcccgaaggccaacagcaagctccagatgtgcattgactacagagacctcaacaaggcatgccctaaggatcccttccctttaccgcgcatagatcagatagtcgactccactgcggggtgcgaccttttgtctttcttagatgcctactccgggtatcaccagatccgcatggctagggaagataaggaaaaaactactttcattactcctgtaggcaccttctgttatacaactatgccttttggcctcaagaacataggtcctacttttcagcgcatgactcgcattactttgagtaatcaaatagggcgcaatatagaggcgtatgtcgatgacttggtggtaaagacacgccaccaggacacattgttgcaggatttggccaagactttcgacagtcttaggtccacgtgcatgaaactgaaccccgaaaagtgcgtgttcggtgtgccggcgggcaaactcctcggttttcttgtctcctcccgaggcatagaagctaatcccgagaaaatacgcgtgatagagaggatgcgccccccagcaaacttagggatgtgcagtgcgtcacgagatgcatggccgccctaagtcgattcatatcgaggctgggagagagggcgttgcccctattcaagctcctcaaatgccccgagccgtttgtgtggacggtgcaagctctcaatcagttgaaagcttacctcacttctccccccatcttggtggccccggggccagagaaaccgttgctgctctacttggtcgcgacctcccacacggtgagtgccgcccttgtagttgagcgcgacgagggcgacccgcgttgtgagcccatctatgagaagggaccaggggcccccttgactggcgatggcccctcgtcgcccgacagcctggtgcccgaagcccccaacccccgggagggccccgaggcccccgtggaaggaagagagactctggcgggtggccccgaggcctatactcccgacatggcccgagatcccccgaggcccctgagcacgggcgccccgggccagctgcccctaacaacaaggaccggccccactagaaggtgcagcggcccatctacattgtcagcgaggcactccgagacgcgaaaacccgatacccacaggctcagaagatgctttacgcagtcttaatggcctcaaggaaattgcgccactacttccaagcgcatcggatttccgtcgtgacatcttaccctctcggccaaatctttcacaaccgggaggggaccggtcgggtcgtaaagtgggccattgagctcgctgagttcgacctgcactccaaaccgcggcacgcgatcaaaaaccaggttctagctgacttcatcgcggagtggaccccggtggacgaccctgttccgtctaatgttcccttcctccccggagacggaggagacccaaacgccgacattcgcgccgggtactgggttatgcacttcgacggctccctccaccttcagggcgcgggggtcggagtcacgctgacttcgccaagcggggatgtcctaaagtacgtcgttcaactcgatttccgagccatgaacaatatggcggaatacgaaggactcctagcaggattgagggcggtggccggaatgggcatccgacaataatactcttcctgagggtcgcgcaaaacctgagaagctcacgcgtatctctaagcaatacgtgctcgtagaagggaccctctaccggcgtgccgccaacgggatactcttgaagtgtatttctcgggagcaaggtgttgagctcatcgccgacgctcatcagggtgagtgtggggcctattcggcctcacgcacattggtcggtaaagccttccgacaaggtttttactggccgaccgcgttgcaagatgccccagaatgggtctggcggtgcaaggcgtgccagttccacgccaagcaaacccatcagctggcccaagccttgcaggtcatcccgctctcttggcctttcgcggtcttggggctagacatcctaggacccttcaaagcggcccaaggcgggtattagcacctgtacgtcgccatcgacaagttcaccaaatggcccgaggcttacccggtcgtcaagatcgacaagcattccgccctgaagttcatcaggggcatttcatcccggttcggggtgcccaaccgtatcattacggataacggcacctagttcaccaatgagcttttcggtgaccccaagagcaacggccaagtcgagcgagccaacaccaaaatcctcaaaggcctcaagaccaagacgtacaacgtcctaaagaagcacagggattcatggctggaggaactgcctgccgtgctgtgggcgaatcggaccactccaagtcgccccaccggggaaacgccctttttcctggtctatggtgccgaagcagtcctaccttccgagctctccctaggttcgcctcgcgtcgtgctgtacgatgaggccaaccaggatgatcttcgccgtgacgatctcgactatttagaagaatgcagaaggcgtgcaaccctgcgagcggcgctaccaccagcgccacgtcctggcccgatcactacaagtcggcgacctcgtcctatgtcgcgtgcagtcgcgcttgggactgagcaagctctcaccaatgtgggaagggccataaaaagtgttggcgttccccggccgggctccgttcgactaaccacgaggacggcacggggttgcctaacccctagaatatcgaaaacctccgccgtttctatccatagggtcgcgcgtctttcgctttcatggtgctcgggccaacccccgcacatccttcggcttgtgcgggcttggcctggggctaccactgttaaatatgttgtatcttgttccttccccagcaataaatttttctgctcaagtggaagccgttgtgtaccctttcttactccttcctatggcttgtccgggtttaaaggacgattcgcgcttactccggaccctaagtggcattgggcggcctgaaaaccgccgaaagggagcctaaacgcgggccgcgccccgggctgcggcgaaccctgggggctcggaagggccttcacacggccatccccgacccccggtcgccgtagccccggtttggccagacccgctgggcagctttctcggggcgacggcattgcccctcgccacctaggtaccacggaccgagcgtgagtttcccttttcaccagaacgagcccgaggggggtataaagggggtaagaacgacaacttaatcataagaaagttaattgaatacgttcgctttggtttttccttctctccttgccgcagacattgaaaggcggaagcaagaacgtaaaggtgcgaagggtaagctttatttgcaaacaggatggcacgatggcctaaagtttgaagcgttcaccgcgagtacataaccaaataaaagaagaaaagcggggatagtcacggagtgcccgggcccctgagtccggcgccgctgaccacctcgtcccagtcctcgccgccatcatcgccaccaccgtcctcgctcccgctctcctcgtctgaagcaagcgcgaggttgaaccgaggggccgacccgtcgaagctggagacgattacgtcggccgcctcccagacttgctcccgagccctcgcctaggtccccggggggaagtcctcgagcgcgcgccacgggaggaagtcgttgtcacgagcttgatgacttgcgaggaccagctccaccatagcctgcgccaaagctgacgacgacttcacggtttcgccgacctcctcctctagcctctccaaatccgccgccatcccatccagccggagcacgactgccggctgtgtgggcgggagtttcctgtcctggcgcacggagatgcctattcggcgccccgcgcgccccagccggtcgacggcgtcggagagttggccaggtccaatctcgttggtgaggcgaagggctgtgatctccccgacttggtcctgcaccaggcgccccaggtcggcgagagtgctttgagccgcggtgagctggctcaccaactccgcgccagcgagttgcccgcctacctctagctccttctcctgggcctccagctcggaagacctcgttgccattgcctcgcgctcagcgcgggcactttctagatgccgggcctcgtgcccggtaacggcctcctcgcgcttcgcgagttgctcacccagccagcgcgccgccaccccacggcggttctcctcggcctcgcgtacggcaagcgtggcgtcccgttcctggcatgcctcctctcgaagccgcagctcctccgcgcgatgggccaccgaagcctctacggcaagggtggtccggttgcgctcggctgcggcctcctcacggaggcgaagggaggactctgcctcggccgccgttctctcgtgggcggccaaagtggtctcgcactggtctagcatgcgcgcccgctcttctagtgcccgggtatgctcctccagtgcccgagcgtgctcctcaagctcccgggcttgctgcgcctgtttccagctgcgctcgtcctgctcgcgctggttacggtcaaggacctcaattcgtcgatggatcgtggcctcgaactcttgcgcggagcgggcacgctcgtctaagaccttgcgctcggcctcgagcgccgccgactgagcccgcagcgaggcgtcgacctccgacgcccgccgctcttgggcggcagcagcgtcgaggactccgcgggtgtcttcgactctcttcgccagatcctcggcgtgggtctcgtactgcaaacggatgtcgcccagcgcctcatccaagacgctcgaggcgatgagcgccgcctgccgctcctcctccgtctcccgcatgaccgagtccagcgtctcttcacgcgcctggatctccgccggttgggcttggcgcattttgtgccccacctccaccatgtcgtccacggcgcggcgcccctcgtcaacccgtgcgcggtccgccgcgagctgcgcccactccgcctctagggccgcccgctcgtccgccagggcttgaacttgggcattgagcccctcccagacgatggagtcggcggcggcgagcacctacaggagtggctctatgctcgcgggagtcagggaagaaaaagtcacggtccgcccccgagatgacagagtgctgctggaccccccgcgggactgggggctgctctcagccccccttccgcgcggccagccccgagggcgccccagatgcagaggggaacagttgcccccgtcacccccgcctcgggccctcgggcagactcggcctcgacctcgacctcgggttcgggcccgcccccggcctcggcctccgggtcacgccctgcctcggcccccggagcgcgttccacctcggcctccgggccgcgatcgcttcggcctccgcccccgagtggcgctcctcgtaggtcgcaccctcgggatcggccctgggggggacgccgccaccactgccatcgcccgcgaatgggtgcacctcggctgtggcagactcagagccaaacccggcatgtgtcctgtgggccccgccagggtactgcgaaggccccgtggcactgggtcggccgggcccctctcgatctggtcgctcagattttgacccctgcgagggatcggtcgccgagaccccctaggaaggaatcccactacaggaggaccccgatcacgttaagaaaaaaaacagaaagaggaaggaacaggagcccgagatggatagagagcaccgagtcggatgttggcgatcgtacctgcgagggggggcgtttgaaggtccacttcgggggctcgatgaaactcccccggcacggctccgtttgccctatcttccggagccgcttcttcttccttccagcctcggacgcggcggggcgcttgtggcccgccggcggtctgtccgccactcgctcagcgccccctccgcgcgggggagagggtggccgagattcgaacatcttccgtttccctttcggatcaccggccgaatctcccccgggcccacggctcggaccaggtgccctgaagtcgccgtccccgccggagttgccggttcggctgccgcctgcggacgcgctgctgctacccgcgccgacggcgccgccaccggcgccgccccgacgggaccgacccctgccggcgccgacggccgacatcacagccaggatactctcccggtcgcggaagctgcataaggggaggatcccgtccggagtcagcgtttgctcgacagtgtccaggcccagcacccgccggatcaccgtcttcgcgtcctcctcgcccagtcccagtgctcacccacatgggtgcgcatgggatcgttgtacctagtgtactcccacgcgccgcgagaccgctcctggagaggcgcgatgcgacgacggaagtagtcaccgaacaccatcgcccccgttaggccctggcttcgcaggcccctgaggcgatcccgcactgcgtcgtactcctcgcctagttccgaaactaccaaccacgtggcggatcgttcgggagggccggcggggagccgaagtcgtggatggtccggcagcgcggtgtagaaccaatccttcttccaatcctcccacttcttgcataggtgactctcaatgtattgccccgccgtgcccggccggggctggaagcagcatccccccaccaccgcgccttgcagcagccatgggacgaagaaggacaggaactgccgcatcgtcggccgcaccccgatgaacatctcgcacaagtgcgctaagatggccagagtcatcacgacgttgggcgcgaggtggaaggcgtgaatttcgtagaaatccaaaacctcatggaagaacctggaaaatggtgggatcaaccccaccatggcgaaggacaggaggtgcacggatcgtcggggtaccgcggccgcagccgcgactcccccaccctcacggcggcatcctccggcatgatcttgcggatgaggctaaggtgcctctccgccgtgatgcgcaatgccggaaggacggcgtcaccagcgtcttgggccatgatggccggcgggaaaacggcgaggagcttggtgtatggagcagggtggagcgagaggagcgctagggctttaggagcgagtatgcgagtatgcagttggcgagagaaaggggacgaactctccgcctccccttccttttatccacccctcgcccgcactcgcctcctcgtttcacacccctacggttgccccctcgattcctgcgcctgcggttgcctcctcaaatctcgcgcccactcatcacgttgccccgcggagcccgcgtcccgcgtttagtgcgcttgtcagcggcacactcggcgtggggcgtgcgatgctcacaggcacggttaggcgggcccgccattggtcccatcgcatgcttgacaggcgggggagtcgaggcggcgtaaatagcgattctgggcatggtctgaccaaacccccgattttcgcgccctaagtgcccccatcatcagcgtggtcagtggcggtcaaatcgccattttggctaatgtgccatcctggttgccgccggcaaccgtctggagtcctcgtcgggcccacaacctcggcacggtaagtcgtgaggcgccacgtcagactgccctcaggggaccaatgtccgacgtggtgccgggggctactgtcggagatatgggcccgggggtatgcaaagtgaggggaagttaccttcccatccagccacgtgactctacagtttggccctccccccgcgcctcgggagacgcaggggcagccagggggcctcggggtgccacatcacgcccctcgggcccccgcgctgactcgccctgaggccctcgcccaactgccatgtggcggggggagcgagcggggaggagacccaagccaagccgctatcaatgcgcgcggcgccccaactgcccctcaccgcatttaatgcggtaagggcagacatgcggtgccgcccgactgatgcacgtcagtcgggtctgaccagtctgtgaccggcctgtcgtcggtcacatctgactggacaggcggccgtgcccccacgtcgcctctgtatccggcggagtggaggtaggtatgtcctgtcacatcggagcatcatccggagttctctccccgtaaggagggcagccacaagtctccgcccatttaagagtgagtgacagggctgtcccccgtgtcaggtggggggcggcgccgggtgacactgaagggcggaccgctttttagcttccgggcgaaggcacgaatcgcggtccggtcaaggtagagtgggtccccctcccgtagaaagagtaggtagaagcggtgcatgtggtatccccttgaactataaaaggaggaccttgtccaccgggaaggggaacgccactcagtaggcctgaactctagggaaagaagagcgagagtgctctccggagttttggaacccttgtaacactcgaccataatctcacacacaggagtagggtattacgctcgatagcggcccgaacctgtataatcttatcgcccatacgcgattagcagcattcagggcggatacgcaatctcgaaaagcgagccttttccctcggccgaactcacaaaaggggatctcatgatctcccgctggagaggatcactcctcgacaaccggtaataaaaggtgacccaaagaaaaaattactctaaaaaaatgaaaaagaaaagaaaagaaaaaagaaggagaagagatcacagcagagcacgcacgtagcaacacagcaaagcaaaggcattcgatttcagagacgcatcttcgctttttgcctcggcgtcggtgctccacggcggcggcggcgggggcggcgccggagttccaccgcgcccgcctacatccgcgtgtgtgagagagagcggctacaaatggcctccgccgccgaggaggccaagggcgtggaggaaggaggaggaggagccagcgccaacggcggcgacaaccccgccaccgccaccgcctccgcctccgccgcggccgcggcctcgtcgtcttcccccgctggtgatccatccatccgtaccccccacaccccgcctgcctctctcctttcgtcttcgttcgtgtagctttgctgcgagaggcaacctagggtgttgggattggtggcggttgctttgccttccctagttcagcttcgcccccccaaatctgcggcggcttctgccatctccgctcatgtggatggctgctagttgcgagcgcaccttcgccttgttggtggacactctgatggctgcttcactgtctgtgtcacgctggttgctgggaatgctgcgtgtgagggtttggtgtgggggtttggtgctgtgttgagtgctaattttaggcgttgactccacgactagtgggtgatggcctgccttctcctagattttacctttctgaataatggttttctcaaatctcttcacaaaacgaagccgttttggagggttagattacatcgaaaccccaatgaactaaacttattgtaattttgtttacactgtcaagcaggttgtgctcttcagctctggttattacacaatattgtaggtccattgcacagtgtgaaagtatgctttactcactactcagggtaacactgctaggcttagttgtaccatgtggcttgtgagttgtgttcaataggattatgcagtggtgtttatagttgtatcattttttaaaggataatttactgcagcaaacctcaaatcatagtgcaaatatatcttttgttgatacattttaatctcactttgttcagtaagttatgatagtgtaaaataaaaggaatgttgtcatccatatttttcaaaccatcattatgtttttgtagatgacaggggcctccccagatcaagcactatgccaggtgggattaataatgttgaaataaccaatgaaactgctggtccatctaatctggaaagatcaagaacagagaggcgtcgacaaaacaatccagctgatgatcctactaaacagttatttgatgataaaatttccctaaaaaagaaggtgcggataacatagtcctgttgcctatgtcttgcctttccttcatttgcaatgcaccctgtttcatctatttacccttgtagcttccttttcttcatgcatttgacctttgaaatttggagcatgtatatgttcatataagagaagccattttgaacagtcacgtgaactgttagccttatcttctgagcgcggacaagatagctatatctgaatttgatacattttagtataatgcagcattgtgaaaaagggctaggagcctgttgcagaggtgagggctaagatagctatatctgttaaacgattatgtgtgatactgctgattaatcagaattttgatagttatgctctactaatttatttatttataactaaagtcaattaaaacatgaaaattatgacatgttataaccacttaaaaacagcacttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23885 - DNA, 746 bp, Oryza sativa
gcctttgatacccagcttttgccagctccaatgcaagcacatcttcccaaggaacgtcccaaagtattttcgaaggctttttatccattttatctagatccacgcactacacaaaaagaacactgggatttagtaaaataaatagaagcagtttactatgagaatcagacagaaagaggcctcacctgaagcagtatcactcgtttgtttgttaccaaagcaaccttctgattttgtacgataaaatgatcttcatagtaatctgaccatgcatactttgaaggttcccgaaataaatctgtgcatgcaaaatatctgctagcctctgctaggtaaagggccatctggacaattgaatgctcaaattaagtgtatagcatcaacaatattcattgactgaagtaaaaccagtactatgaaacaaaaactatcgctccttgaaacagttatcagaaagctagcacatatgttaaccatcattttctactgcagcatacttgcagaacctactatgcaactgtttatcaagaaaaacaaatacatctgtcgtgggtggaggctacaggcctagtcggaactgttatgggctggcctaattcgcactatcatgtgctgcagccactcaataaggcggaaatgccactcacatggcaaaaagaaagacagaagtgatgtagcataaaggctacctgtagatataaacatttaggagttgcattgtagacaactagaaggaatttgtacta

SEQ ID NO: 23886 - DNA, 3319 bp, Oryza sativa
tgggttagtgagaaattcgcggaagatgcagtatacgaggagcaaattgtatgggcttcgtcagatgcctacccatggggatgctatgtttaccaagttcagagcaagtcactgcaattcatggcgatgcggcggccaaaagaagagtgtgagctaaaacctaagaaggtatcagagtcttatgcccagcaagcattggagaggtcctgagatgagaggcaaacatgccatgcattagtgtagacactagacacatgtaaagtgatgtacataacataggtgcgtatacatgcgtgtaagaaaggagtcaggagcaggacagatccagcattttcgtgcaagatgtgtccgaaatgagagtttcaggtttacatttgctcccatttgtaatccatcattctgcttctacctttgtcagacccttggggtcaaagcttgtacgtcgagcacttgtaccaaacaatccgtctgcttgtcaaccagcagaaaaggggttgtaaattttgtacatgtaaaatcggttgtacttttattcagcactaaataaaaagcatgtaagcggttgggcgcatagcctggttctgcagcactgaataaatgtcattctggttgttttcttaaggaaccgtccgcactaatgaaattgtaaaattggtacatgttttttttttcttaaggcttgttcctacggtatgtgctcccttcttttccaatacataactttcgaagattccagctagttttatattgctcgttcatcactaggatgaaggaaagtggaagggtaaagaaagacacgagctgggagctgcagaccatggtggtcaatcaagaggggtagggtttttagctccttgtatttactagttagtaagattaactaacagattaactaactgattggagtgagaagctttttcattgacttacttggactgacatattttttcgttgaatgaatagatgagttgtcttttcttttatttgtgttcagtttagtctgactgaggccgtgtttagctccttttcaaaaaaaaattttgaagtatacggacatacatttaaagtattaaatatagactaataacaaaataaattacagattttgtatgtaaactacgagacaaatctattaagcctaattaatttgtcattagcaaatgtttactatagcatcgtcttataaatcatggcgtaattaggcacaaaatattcgtctttgtcggagatatgggcccggggtatgcgaagtgagggaaagttacctttccatctagccgcgtggctctacagcctggccctactcccgcacatcgtgagtcacagaagcggccggggggccttggggtgccacgtcgtgcccctcgggctctcccgctaccttgccctgaggccctcgcccagctgccatgtggcggggggagtgagtgggaagggggcccaggctgaacagccatcaatgcgcagcgccccaactgtccctcaccgcatttaatgcggtaagggcagacgtgcagtgctgcctagctgacccacgtcaatcggacgtgaccagtctgtgaccggcctgttaccggtcacatccgattgaacgggcagccgttcaagggtctcacgacctcccgctatcgagggacttccctcgacagtctcgtaatttacatataaactgtgtagttggattttttttgtctataattaatacttcatgcatatgtctaatcatttgatgtgatagaatttttgaaagtttgaatggaacaaacacagcctgaatgaaagaattgtttcgcatttcaaagtcggtagttgagtactaagtggactcgcatttatgaaacatcatcgatctccacaactgaaaaccagttcgtctaggcacttcagaaaatctttatttttttgcggggcacttcagaaaatcttggccgggcaaaattcagctccacctgtctcttacaagcagatgggttgtttcaatgtgttctggaacagtttggtactacaagaaaatggtagattccatcacatgccatgttaccatgttgctctccctggaccaagctagattttttttaagcaaaacctcacctggataagcacgcacacgccgtctgatcttgacagccaagtgttcctatctgtagtttatccatccatccatcattcaccgtcgttccctaacttgcagtcttgcacccctagctacgtggatggattaggaattaacatttcaggatcagatagatcgatccgctgatccactcctggaagacgcatccatcgatcgatcacacatatcatcgtctcgctgtttcgatggatcgatccatgcgtctccgtagccggcaaccggccggtggtccacttactatggaggagagggagatgaagccaagaacaccaaaggccaaagatggcgatatatactcgcggtcccgtgaaggccaaggctacttccctgaaactgaaagccgaccggtgctctgcgatctgtacgcattgctgcgtatgaatcttcatacagaaggaggaaatatcaaataatatagggtattgcgagagagatatttctgaaaaaaaaaaggcaagaggagctgaggatggaaggcctttttcttgggacagctggacggttcaggttccgacggttttttttcctatgatttataagttgttgtccaaatttgaattttaaattttaattttgaagttggttttgatatttctttaacgtagggtttttttagcattagcttttaatattatctaagaacaagtatatataagttttatttataaattattttctattattaataaaccgttacagtttataatcaatcgtaggtaatcaatgggtccttatcctattggaaggtctaatttgcagcacctgaacttttagagtaaaaaaaatctgagctcaagttcctgttctttacttcgatatcaaatacgttggcaacagtagagttcacgttgcagaagactatctataccgttgttgataatttttcttttaaaaatttgacagacgtaattataatataatcgttgtataattataatataatttgcatataacaatgtaacttttaaaattctctccgtaacacgctatttcctcgaaatagaggtagtttgaccgaatgctatcacatatgcatgcgttgtgattttttttccttcctcacatgcacgaatcttgaaataaatctaacggttcaaatctatatgaaagttacattgtactcccttcgtcccataatataagggattttgagtttttgtttgcaacgtttgaccactcgtctta

SEQ ID NO: 23887 - DNA, 13478 bp, Oryza sativa
  unsure (1)..(13478): unsure at all n locations
aaatcccttatattgtgggacggaaaaactcaaaatcccttatattgtgggacggaggaagtagttacatgcaaattataatgcaattacactacattgttataaatatataattacatatgtcaaatttttgtgagaaaatttattgataaatacttcctccgttttataatgtaagtcgttctagcattacctacattcatatacaacatctatatatgggcaatgctagaataacttacattataaaatggagggaatatgtagcaaaattgctccgaattatctatttatctgtcacgcacaaaagcatatgcttgacgaatttgtgggcgagcgagcattgatcgattttcttctcttcaatttattctcaacaggcacaacaacaaaccatcacggcatcacgacacgacacaagaggaaagggacgagagaaaccaaaccaaaccaataggcactaggcaaacacatcacacatggcaacaaaagtagccagagcgtgcaaaggagagccacaaacttggaaggaggagggacccaaaaagcaaaaaggtcaccacctgcgctgtgcctgtgcgcggtagaagaagcagccaagaaaaagcgcacggctgggtcccgtcccgtgaacgtggggcggagactatgatgctggggacgagacggataagcgcggcacgccgtccacgcgtttcacttggtgcctacacgcggccgcgtcaccaccacctcaccttgctacaccattctcctctacttgtctatctatgggtgtgtttaatccacgctaaaattaaaagtttgattgaaattgaaacgatgtgatggaaaagttaaaatttatgtgtaggaaaatttttatgtgatggaaaagttaaaagtttgaagaaaaagtttggaactaaacaaggctatgtacagtcgatttagctaattaaaccatgcgttgcatgtttactaccataccactccgtatgttaacacgcgtgaggtgacgctgctccacataggatatgtcagtaatttatcccgtttgattgtcatgcaggcaaaggagaatcgtacgtattgaaagttgaccgtgcgttaagcacgagattcgcaagtgacggaatatataattagcgttagcgatatacggagtactatactactactacagtactccctctgttttataatgttaaaatgctaacatcatctatacgaacatagataatgctagaaagttttatattatgaaatggaggaagtaggacgttacactaccaagtacgacagatcgatgtgtggttaaccgacaggagcgtgcgtgattctcatgggtggatgccgatcgatccgtgtacgacggctgattcgcccatctcgacgagaaatgcagacaccgcagtgagtcacccaagtttggattttagccgacaagtcgcaaaccctccacaccgaccacgcaccaaacaccaactaccccggaagatgataccaccacagtaaattaaattcctcgcatttttactgcatttttgtccaactccaaattccgacggaccaaacccagcaacaagcggagaccacacaaatttcttgtggagtctcgatctagaaaacgctactagcacacacatgtcatgtcaccaacatcagccatggcccaccagcagcctcacaagcgcactgtcctccatggcaatgcttgccacgtcagcacctcacgttggtccatcctcgctgacgtgccgtccacatatccgttccgtttacacgccccgtttcacccgtaagacttatccgttctcccttctctctcttcgcagccaagtgtaaaagcgtacgcgtacgtgtactgaatcttcttccactgcacccctttgatttgaccgctacgttgtcgccgtctcacccagctcgatccatctggctaactacgtggattagtagagattatcgccttagtttgattctataattacccacctatctagaagtagcttgtaattgaacaggtgtcacttgacagtactcagtacaacagagcaatggaagcgtatacaacactcaacgatcagctgcttgtgcctgctcaaaacgacgaaaaattaattgaaatctttattactttttagttccaaaaataatggataaggccattgctgctgatctaatcctcccccataatctccaaccaggaagcatgcacactagagagaaaaaaatatatacaaaaatcacatgcatactgatgcaatgctactacttgctttacttgtgagagtgccagaggaggaaagattattagtttagctttacaatcctaatcagcattgatcacttggttaagtgacgataagcacgtcgccatcacacgcatagttgagatttcctctatatatacccgcagcgactcttccctcccaaattcatttcattctcttcaaatccaagcaagaaagaaatcaaagcttctcttcttgaattcaattcaattcaattcctcatctccgatcgaatcaatcttggttagttgttaagcacctcttatctacttaattatcttcctctccggagaagctcgagctcgagatcaagtccatggcgttgacgctgcgttcatccacgtcgttcctgtcgccgctcgacccgtcctccaagcgcgaggacgcgccgccgtgctgcgtcgtccccatgccggcgccggggagcggcggcaggctgcggctcgccagggcggcgccggtggagcacgcgacgatggaggagatggcgtcaccggaggccgcgacgctgctgcaccacgggggcgggggcgggcaggggcagcggcgggggaaggggacggcggtgtacgtgatgctgccgctggagacggtgggggcgggggggaaggtggcgcgggcgcgggcgctggcggcgagcctggcggcgctgcggagcggcggggtggagggggtgatggtggacgtgtggtggggggtggtggancngnangggccccggcggtacgactgggagggctacggcgagctcgtccgcatggtggagcgcgccggcctccgcctccagatggtcatgtccttccaccagtgcggcggcaacgtcggcgactcctgcaagtaagcctacccaacctcacctcctaaactaatttcctccattttttttggtcttaatttcttggactcggagtgttataaaaatagatgtacaacggagacatgaattttacgtggaaaactctttcggtaaaaaaaccataggtgccgaccggcaatgtttaccgtagagtcgttgattataaacgtagaggaagaacaatgagaacttcacaccttctcgtacaacttacaaaagtatatatagaaaataaaagaaagacactgagtcctactagaaaactaatcagaatatactgtgggcttaaaatttggatcacgtatttaacctagagtgctctgcaactgcaactgttgttctctgttctagccaatccatgatccatctggttagcttaaaaaaaatgtttcagattgtattgtatttgcttagcttaagggaaagcttatttgattaggaaaaactttttagtttggttctattctatgttctatatatagccaaatgatctgcttatcttgaggaaatggttcagattttatttgattagaaaaaaaatgttttattttaggggtttttcattctttgttggtctcttgcacgcaaagaatatacgtgtatttttctgaagcaataagcaatcaaaattatccaagtaggaagggggaaaaagcgtaaaagcgatagctaaagaacacaacagatacgaagctgtcacaggagttggaagaaggaaaaggatcaaaagattcctcccaactgcaaccgggctactgctaaccaacaaacacctgcttttgccaccactaattaattccaaaatcaactcaacaaagagatcaaaatcgagttctaacagttcatatgatttctgtgacagtttcattggattaattatgattagtgttttatggtttatgctcatatgtgattttgctgatgttgatgcagtatcccgttgccgggatgggtgttggaggagatgaagtcgaacccggacatcgtgtacacggacaggtcgggtcgtcggaatccggagtacatctcgctcggctgcgacacgctgccggtgctcaagggcaggacgcccatccaggtctactccgactacatgcgcagcttccgcgacacattctgcggctacctcggcaacaccatcgtggtaattacattgtggtaattacattgtaattacactacaactatactatagttgcatttgaaattgttttgtcaaaaaaaaaaacttgcgacagttttttttagcgatttcgaattggtaatatgattaaccattaaccctgcatcgatctccatccacatccttgcttaatcgatccaagcaatttgtttgatcttgatttcgttgtgaaaaattgcaggagatccaagtaggattggggccttgtggtgagctgaggtatccttcgtatcctgaggccaatggaacatggcgtttccctggcatcggcgagttccaatgctatgacaaggtactctttctttacgttaacctatcaaattatcggtgaaatgtgatttgtgattggaattaccaaattattttttcgcgaacgcgcaaaagtattatcaaattatgggtgaaatgtgatttgtgagtgggattaacggtgaatggtttggttgattggtgtgcagtacatgagggcgtcgctgcagcaggcggcggcggcggcggggcacgaggagtgggggaggggcgggccgcacgacgccggcgagtacaagcagttcccggaggagacggggttcttccggcgagacggcacgtggtgcaccgagtacggcgacttcttcctcgggtggtactccgggatgctgctggagcacggcgaccgcgtcctggccgccgccgaggccgtcttccgcggcaccggcgccgcgctctcggccaaggtcgccggcatccactggcactaccggacgcggtcgcacgccgcggagctcacggcggggtactacaacacgcggcgccgcgacgggtacgcgcccgtcgcggcgatgctggcgcggcgcggcgcggtgctcaacttcacgtgcatggagatgcgggacgagcagcagccggagcacgccgggtgctcgccggagcagctggtgcggcaggtgcggtccgcggcgcgcgcggcgcgcgtggggctcgccggcgagaacgcgctggagcggtacgacgagacggcgttcgcgcaggtggtggccaccgcggcgagcgccgggctgggcgcgttcacgtacctgcgcatgaacaagaagctgttcgacggcgacaactggcgccagttcgtgtcgttcgtcagggccatggccgacggcggcgagcgggcggcgctgcccagctgcgacaccgagcagtcggacctctacgtcgggttcctcgagaagagggcggcgccggaggccgaggcggccgccgccgccgccgtcgtgtagtatggaggcgagcttcgtggcgccgccattattgtgtataggtacggtgctacgtgcaccgggaaagggaagtgtatatatgattatgcggggagtctgcaggttgcagagttttatagtcagcaactgagcaggcatcatgtctagttcatatttaggccatataagttttttttgtcatatttcaaagcactgtactccaatttggcagctttttatgtgtaaactgcccaccatgtaataagctttgttagctgagaataattttgcaactttgcaaggaaatagctcgtttgcagcagcaaacaatttgggttctatttgttcaaagtagcagataataaggtaaggattgggccgacgtttttgaacttttgtgtttgaactttatgcaggtttatgttggatacattgggccggcagacggcgaccaaatcaaacctgcggatttttttcttcttttccctgaaaaatcaacctttcacgcgtactttacagagtcaaactacgacatatataagcaggacgcaacagccaaaacctgcatccggacttttcaaatctaaggacaagagagaagaaaaggagaacgaaaagaaagaaagaaagaaagaaacacatatgctacaatctcattaacccgtgcatattgcactgagcataatatggtcttgatcaaggaacaatgtgaccaaggtacaaatcacattccaaagggcgtgaacaatgtaatgagcaacaatacatgcaacatgttagctctatttatgaaatggagccctttcaacagtgaaatttacatcatgataatttatacggggactagtgatataatcatagacgcggtggagaataccaggatcgtgtcatagagaaaagggcttcgcatacacatcgaatggctcgtttgcagttagctgtggatcctgcagattagagaaaagcagttagtattgttgacaatctgaaaagggaatggaaattgtatacaaccaaaagaacatgttctgtgtgtttttgtattgtacccacggaaataggatttaaataatcactagatagagaggaatatgtcaaactccagaatttacctgcttcaagccgccactactaacgctgcctcctgtaagaagcattgtgattagcgatgttacagcaccacctccgctgcccattgaatcacctgtactgcgtattgtcgaacgcatggaggtcaggatactcccataggtggtgccctgcccacgctcaattgcttggataaagcaaaatgtcatagcgccagttgaagtgatctttgacaaagcctgattggaacaagtgcaaatgaatcaaatgttaatacctataaattgggttaaacagaatagaacacaactgaccaatagaacagtaacagaacaggcatgatctgcaatcagagtccttgccaaagctatcttttaagcatatattaacttcgaagagaataaggaatgacagcctaggatgctaacagagaaggaatgaattcaaaaatttactgaagtatctgcagatgtctgatcatcgtcacaaccactaaatgaaatacactcgccgccactagtgcccttccagacaccagatcgaggtcgatgatcttcccatacatattgcccactcctgtaccaaagaagaccagggatattagctgaacatatttccatcataagatctacagatctatgtttgtaaagtaaacactacaaccaaggaatccaaaacaaaaccaactgaataaaacagcatagtctctaaacagcacattcctgtcctaggataaacaacattttgatggacatactatgggcaaattagcagtaagttgtgaaaataaacggatggtgaacagtaccacaccaaaactgtttccaacaaatgacagtcccaagagggtaactacttgtattgacataattgactaagaaacatagttcactggctctaccctcaaattacattccagtaaaaatatttgagcaggatgacagaatataatcatcatgagacaaaaaaaataattgaatgctgtcctcaaactgcatttcaatagaatatttgagcaagctccaaaatcatatcatcatcagctgaaacataatcagacaaacatggcattcaaatcaaattggttcagaagtaaatagcatctttcttgcaaacatagtttgtagtgaagataggataataagattgccattaggttaagtccatgtacttatcattcaagtgccaaaaaaaaaagagcttgcacaagataagcgaacctgttcattctgcagaggaaaggcaaatcaagtgcagtcccactgtgacaagcatctatcagtgcatgaagtttaactccaggagtaagtggtctgacaagagcagtatttatttcatcatccacaatcattccctgtgtctcaaaatccaatgggcagagggtttcatccattccatcaacttcatctccgctgtagtttctttgttgtgctccgtgaccagaataatggaataccaatgagtctccaggctggcaaccttgtacaagccaatacatggccatccttatgttgtgctttgttggaatcttgtaagggtcagtttgttcttctgcaagacaagaaataaaccaatagtattgggttatgatcagtttcaacagatcatcagaaaacaaatttcatataccagaaagataatataagacaaaaaaatactttgcccttttcctgtcttaaatgttttcagtctagcatttgcatcctactagattccatttagttagtaaaaccataatttgcgaaaacatgagcccatgactcacaacaacattagcttatatcagccctaaagagtgtgatggatcaaaccaaaccagctttatcttcaaattgaaaccatacgtagtttattgaggcaggaataaatttaaattacattttgatatcgccaacgaaaaaaatacagttctcaattcctcatcatttgcccctgcctattcatcgcaacagtaaaataaaaagcgagcagaaaattcatcaaaatgcaaagccacccacagctccttgattcgatcataccctagccctgaaattcgctccagaacaatctcttcacacgcaggccactattggtggggtgggggatcaatcaaaccccgaaattgaggatacccgaaccagaattcaaccaatagggaggtaatatcgggtagttaccggtgagcatgatgatggagtcgtcggggaagtggaagcgcgtcgtgaggaggtggcgcatgcacttggcgtcgttgatgcaacccttgagctcgtggcgcgagaacttgtaggagatcccgcagatcacggcgcgcttccgcccgtgcgcgggcgggggaggcggcccccaccccggcgcctggtgctggggcgccaccgcccccggccccgcggcgccgcgggcggggtcgccgtgggccggtggcggcgcggcggcggcgacgtaggtgacgccccgcagatggcgcagcggatgcagggcgccccgtgcggcagctgcagcggcgtccggcagcccgagcagtcgatcagcatcatcatctctccgccgccgcggggtcgccgccgccggcgaggaggggggaggcgaatcggcgggtggatttggttggcaacgatttcttcgttggctcggctcggctcgtggtggagtcgttgagacgcgtcgtgtatttgcgagcccgcaagacgcggcaggtgaagccttcttcgggaaggacgcggcatcctaccgtcgatcgagtcatcgacggctctgattgaactgtaccaaagctgtcgctgatgatacagatcgcttacgtaaatttttgaacgcggcatttgactcctgacggacggctgagtaatccggtatcatcgccgtttctcatctctgatttttctaattgttacttagctgagcagcatttggtttgaatttgtaatgccaatttattcttggagtaatcactattcggttcagtttgtatgctttaattaaacagcaagcagcatcgtatgctatgaattgtgctttgggtgcgccaataatttccttcaagatgcaaatgcttgttgatcaatccacaattatttggtagctcgtgtttccagtccccacaaatgataatggattttggcatatattcctatacctactaatggtaatagtataatccaatgtgcagttacacatcaaccacgaaaacaacaggaggcattccattcattcaaggtcatggttatctttatgcgttcaggtacaaagtagtacagacaatggcgggggcggcatgcggttcctccaaccagcacggccggcaccgtggaatatgtaggttctatacatgcttaaagccaagagacaaaaggcaacagagattttgtctcctgatgttgggggtgtgtacatcatcgtatctctaaacataggatgagtattacactgaagaagagaaaaaaaagaaagcacgagaaccctactgacctcgatcagttgccttcgacaacaggaagctctctctctctgcgcaggagttctgctgcgtcgcaaaagacaccacaaaagatgtatggagggaatggcggaaaactctggttccgaagctctgctgcaacggcagtcactcagggtatcgccacggcccgatggggtggagcaacttccccctgtagggaagcggaaggttgtgtcgggcgaattggtaacaacgcgatgacatcgcgaagcagcttcgtgccaaccttatgttggctttccttctcacactactgacaacggtagatcattgccattatttggcatgcgcttttgtgcagccttcacagcagccaccctggctgcattggctgctttatttgctgaagcaacggccctgttcaccttatcgtcgactcttgggacgtcataggccctctctgcagctcttctcgcctcctgatagtgcaacataatcagaacttagagagtagaattgtactaagcaaaaatggccagagaaactttctgacagctaatggcgtaatagtgttcaggaacattacctgcactgcattgaggaccttggaatggttcacagctataggggacccagggataatgttttgggtgctcaaggtgtcaagaactccattttgccaatggcctgcttgtgtctctccattcctgaaagtatacatgcctaatccttgccttctaccctcatgccaagctccctcgtatctgtgaccattggcaaaactgtagactccgaagccatgcattctatcagcaaagtactccccagcataggtatcgccattccttgacacaagttaacaaaatgttagttcaaaggtcaacccaataaacttgtacaggatgctgcatcgtataaatagatatatagagcactagtgaatcaggctaaactgcaacaatgcatctatggcctatgggctatgtggaaatctaaacatacagcttttattaaaatgaatccgtagagaagaacaaagtttcacacgggaaactgtaaacaagggaaagataaggaaatatacaaacagatagtggtgctcaaatatgtagtagactggtacaactaacatacatcacacacaatatatcatgctatctcataaactttgcaaaaaaaaaaatgaatacaccatcaagttttaatttggtagatggaagtgaaaagactaggtatagtatatatatggatttttaatattcgtccctgacacaggacaacaaagtaggatttccaaatccaaacagcccgtcatgacatgacactgtcaacgatgactaatatagctcgtaaccaatcagacataaatcaataagcattacggacataaatctagataactaataacagagaatggatggccaaatcccgcacggttaaacgatgcagcataaataaaagagaacatcaatcatattagtattagcgataccaaaagactgcttgcattagatatttagattgaagctacaactaagaatgaaccaacaattaccctaatcaacaaatacagaatgatccccaacaacgagaaacagatttagctttagaagagctatatgccagaagctaaaccaacagaggagaggaccctgttttccatttcagattatcactaattcactacttggatacacatgggattatggtaggaagtcaaacaatcaagacagatataatacaacagagagatgagagatatatggctggaaagaaccaaaaatggaaactaatggaataagcaaaatgcaatggatcaaattagacatccagtattccacatgtgaaataactagtgctcagcttgaccagtgcaaatttgcacgagatcagcttctaacagcatatcaacaatccaggaagaaatggaacaggaggacagctaagcatgctcacaaaacacagctagactagcataaacaggcaaatcatcacttgttttaactttaaaaacgtcttctagaagaatataggcatgcattaagtgtaaaaaaaagcttgctttctgataagtgataacaaaaaatgatgtgtattagtagactgaggtggtaaaagtatcagttttccctacagctctaacttttatctctatagttggtaatctgctctgcttcaccaaattgatttcctacctaatgatataggctgagaacataaaggaacaccttatattctgattcatgagcagggcagagggtaaaaaaatacagggtcgttggaggctataccctagtgataattacaactttttcagaatctaccataaatggcaaaagtaaattccaagttggatctttcagaagaaggtaccactaccagcccaacatttcatctctcccttgtaaacaataagctaatggaagtcattccctttgatcaaatgaagcattcacatttaatacattatctactagggttaggaaaagctctaaaattcagtgcatataaagcaacatagtagacaactacatagataatagagaatctaacgttctgctcaacttcacaagatctaaaatttaagcaacacctaacttactggtataagcagataaggttcgaagataaaactgtgttataagttataaccaattacaagatacttgtttggatacacaaatccacaaggatgggaataatttagcaatcgctggtgcaaaacaccaaaaccatgctaatttcactcttatcatatactgtggttaaacaatcatgcatttgcctaatttgacattaccactaaacattttgcaacatccatatctatttgactgaccaatgatggatcataaacatgctcttaactagttgcaacagctaatttcacaacaatgacaaattctctagcaggcagcagcaaatgaaatatataagttcagtcccacacctgaaatggtagtggccaagtccatgcttgacacccctcttgaattccccaatgtagcggctgccatcctcgcaggtgtgcacgccatacccatggctctgcccattggaccattctccggcgtacacatccccggtgtagaacctgtatacgccgtgcccgtgcctaagcccttgccggtactggcccctgtaccggcttcccctggcccaggtctcgacgccatagccgtcgtacttgccgtcgatccagtccccctcgtacctgccactcatgtagtagtagtagacgccgctgccggtgcagcggccgcggttgaactggccctcgtagacatcgccgttgctgtagacctggacgaaatggccggtggtgggggcggaggcggaggcggagggcgaggagccgatggaccagaggatgggggatcggcgcgggcggcggagcgggagggggaaggggagcgggaagggg

SEQ ID NO: 23888 - DNA, 2863 bp, Oryza sativa
agggtcggcggcggccgcgtccggtgatgcggcggcgggggcgacgacggggaggtggtggtggtggtgcatctaattgggatcaattcggccgggattgggggttgcttcgccggcgagggagaaggcgacatggggtgggggtgcgtggcgaggcggaggcgtgggtgggggtgggggcagccgcctcgcgcttttctctcttttctgcaccgatttttccgggtctctctctctctctctctttttttctttttttttcctctcttgtttgttctcctcctccctgagttcccgctggttctttttcccctcttgttcgatgttttttaaacgaatttattcaaattcaattctcctctgaaaactacgaattgattgtgattttttccccctttgttctagcttttaacataattcaaattgaatttgaatttgaatttcccacaacaagttgattctgtttaaacctgtgatagaaaatgattattttaccctaaaaaagaaaatgattatttaaattggaacaatcatttgtgtagagtagcactatacgacatgtcgtcttcttgaagttatttaaataagggtgactaggaaaattaaatgtttttttcttgtttaaatgtctttgtcttgctccacttgtagttgtagttgtcgcccttagctctaatttaatgtcatttgttgtttttgctgattaatgagcaaatttattattttgctcgtgtagttttatagctttaacgttcataagcattaaaataggatcaaatgaagatataactaagttaactagtaatttatttacttttgcttgcataaacaaggtaatataaccttgagagagagaccaaatgcttggagtcaataaacattgaaagatgagagaggtgggtatataggataataaactaaacatactacccatgctactctattaaaatatgacgaagctataaaccaacacatccaacactgcaaaaaaaaatgtaacgtcaacatatatcaaaatttggcgttttaacaaggttgattttggcaacatatcgaacagtcctgaaatatgtacattttttttataatcaaaaggaacgaccaagaggataaggcacacactagcaatcttgggcgcccaccattccacagttagtaatagtatgttttaacactctaataatggcactcagcagctaacaaagtattgttagaactttttttttctttttgcttgtggtttatagatacataagcagtgcatgaagagtggtgtgcggagaggaccagcacaaggatcggaagtagacgaggacgacgacaggcagctacaagttgcaagcagccgcctcccctcctatttccgtgtgcttcgcttgcggctctgcttaccttggatctgtctgtctaatctctctctctctctctctctctctctctctctctctctctgtgcagcaacaaggaaaaccaaggactaatggccagagttagaattagaccctagaaaagtgggtccttgaccacttttcccaagtagttgatcctcatcattttgatctagaccttgttcaattccaaaaaaaggtctttcaaagttctacaaggcacaataaaatttcgcagaaaactgatcgaattgtatcatacaaatatccacatgttcttcccaaggatattcttgggcattctctcactctcaaatgattgtgttgctgaccgcgatctaaataatctacagacaatttgggtgaaaattcggtgcacactgccatactgggagcgtcaccacgtcaaaacaaaggacatggcgcatgtatgcacgcatgaaatgtgtaatctcgtcgtcggctcgacagagacgcagggggggaaaaacgccgcgagatgctgataagtcgattcagatcggcatggttatccacatgaccacaacaacgacatgatcctacgtgtgtttaatgattaatgattaatattcaagctttcagggtgtcaggaatcagaatattttagttacagtatattccagtgctaacaaaagaaggcaccatatagcagtatgactaaaactaaggtggtaataataacccagaaaaatcgaagaacaagttgatggcaacacgtgtgaaacaaaaggcacgggaacaaatagtagacaaatgtagatgccatggttatgaaaatatactggatgaataaaagaatgcccagtagacaaaactttgagaaaaaaaaggttgcaagaagaagcaacccaagaagcgatcaatcattaagcaaataccgaataattttttgcttactagtgtcacgatgttacccagtgagagtaaagtccgaagtctggggggaaaatccatataatataacccgaaaagcatgcggattaacataatttgatacagtgagacaacctaggatcacagaattaacagtacaaaaacagatacagttgctcggcaattacagcgagattcaagctcacatgttctcacatcaacagaccgcaataatttcgggccacaatgttctctccctaaaaactaggtaaaaacaagcagcagcttaccgtacaagtttgtcatgactgcttgtgaagtttgaagccaaaaacttttggaacatactgctgagatggcttttgtggcttcaagtgtggatatgtcatcaggaagagatgtgggaatgttgtcccaaagtacgctccgtcaatgtcttagcaaagtaaaggagatacaagtgcaagaaaaatagtaacacaatattcatgatagcacaaaatcaatgtttgtttacccatggttatgttccaaacaaatctaatcaaattgtatgagtcgcataaaaaaaataaaggaaa

SEQ ID NO: 23889 - DNA, 5994 bp, Oryza sativa
aaaggagcatatgagtaggcgccagttccaagtcgaaaattcaggacaacaataaaacgtgccatgcaaagactctgtgttcttccccacctttcccaactcaccttccctcgtgttccgcacacacttttcaaactaataaacggtgtgttctttacaaaaggtttctatacgaaagttgctttaaaagtttatattaatccatttttcaaaaaaaagagacttaattaatcataagaacatacgtcgctccattttgcatgcgaggaggtgagttcccaatctcacttcccgaacacagccttatgtgagcaggcaaaaaaaagtgggatatactccatatcagcggtactccgtattaaggaggaggtgactttcgaagccaagctagttagtgcgttaagggtgtgtttagttcgtgtaaagaaaatttatgggtgtcacatcggacgtttgaccggatgttggaaggggttttcggacacgaatgaaaaactaatttcataactcgcctggaaactacgagataaatttattaagcctaattaatctgtcattatcacatgtgggttactgtagcactttatggctaatcacggactaattaggctcaaaagattcatctcgtgatttccatacaaactgtacaattagtttttttatctatatttaatgctccatgcacgtgtccaaagattcgatgtgacgtttttggacaattattttttgaaactaaacaagacctaacttatgggtctttctataggctagcatcatgtgagtgggctagttagcctgggttcaagactcacctcctccttaataccattgatatggaaattttggtaaattttgttctcagtttattgtctagatatggtaacccctcttcaaaccgtaagagagatgtggaactcgtgctgctgtcaatttttttaaaaaaaaataaagagagaggagacgaggttgtaatcacgtagggtagtagtagtagatgtatctgttcatcttgttctgagatcagacagttggaacaaatacagcgcagctaggggcagcaccacacccagcaagccaagtaatactgctgctacacttgcctcatgctgcttggaagggacagacaaaccgaaacagatcgaccacgcatgctttgctaattgctgtgctttggcgttttcgctgtaaagtctcctcctcctatatccatttctcactccctcacattgttaaacaatcaattaattaatttgacagctaatctaacaacagatgcatcactctaagatgctactactaatctccctgtggcatggataagacacagacacttgtaattcataacatgagcatatgcatgcacactgaatgagtgtcatcacagcattagatgggatcagggtgtcatgtcatgcagcttcatgctagctactagtagctatactaactttctctctatctttaacaaaaggagataattaaatccttcacttagaccggatgattagcatctgagggcgacgcaatgcagcatatgtgcatgaatcatgatcatcatcatcaggctttctgctgtgacaggacctggaaaaaaattattctagtagcttttggttttgtgtttaactatatatatggtgataaattaagccaccctgatcacatggatcagagtctggctggaccacgggatcccataaaatcggctattaaatcgcaaaagggggcaaaaaacaatagcaatattctggatgaactgccaaggtgtctctcatgtgcattcttgtgggtatattccttccctcttctactagttttcgtccaaactgttccatccatctgcatctttcttcagatcagttcacaatatacttgtactacctcattggcacaggcacattcttgtgggagaaattttggatagagaaatggagatgatgctcctgatgctgggaaagaacatcacatgcttgcatgctcctcgacgtgatgagcaacatgtaagtatatgttagtactgcagtagtgcccttgcagcatcgatcaccaaccaatctgtcgcctgcatggcagaatctgattgtctgttcctcacaaacatgtcatattctgatgcctcctagcaatctgaattactaccatattaaaattttcacccctcctgatggtgttttcaccttctgttctgacacatatgttaagatttcaagttgttcagggaaacacttgtgatatgtatatccacccatcccaccagggttcaagtcctgttgcccatgaatattacagacatactagtgggcattcaatagaatttagtaagatcagggatgtgttgtggattcccgtctctttgagcatgtgttagatggcgcatctgtcattgtgtgagtgtggtgttacgtgtgtagtgttgtgcatgcatttacatctgtcgtgtaatcgcaaaaagatttcaggttgttcaggtgtgtatgtgttcagtgtatctctgaattgatctgtgctgttgctgcatatgctgaagctgacacacatatgttcagtttcagagttcagtctgtttcgagtgttcaatgtatctctgaactgatcactgttgatgctgaatatactacgctgaagacgacactgacattttgactaactgggtgcctataatcagcacggaatacacgaggaaaaacaaaaaatgaagcgccactaatcagttaattaccgtttcaaatgatccatcattagccaatacatgcatgaatttttcgtgcggaatgcccactgctagaactgcgaaacaccctaattctcgctgaatttgtgtgcatgtatatccatccattcatcgttcggctgcctaacagctggaaaaatgactttgtgcatcttgtgagaattgcagctaaagtcaggttagctctgaaagtgctctaccctgcattcttgccaaggttaaattcttccaaccaatacacgctctcgaatcgaaccttatcactcttgtcataaattaagctgcaagaatcagatgattccacagttcagataaccctcaagaaaagaacttcacaagttcagaattcagactgacttaattcaccaggttgccgaaaattcactgcaagtactaatgcagtgcagccgtacgaacctatctgtacggtcgatacgaatttaagcaaaaatccgatccatcattataatctaaatttgagagtctgatcaaacccagatttaaactaatttttaccaggttgctcaaaattcactgcacgtactagtgcagtgcagccgacaaatccatctgtacagttgatacgaatttaaagcaaaattaaatccatctttataatctaaatttgagaatctgatcaaacccagacttaaactaatttttacctgcttgctcaaaattcactgcaaggactagtgcagtgcagccgacaaatacatctgtacagttaatgaaattttaaagcgaaattcaatttaaattcgagagagagaagaagaagaagaagaagaaagacagactaatcatgccaacttgcaagcccaaagacccaatctttccttagaaatttaatttttttttcatctctttcctcgcgttttccctccctttataaccaccaccaccatctcgtctccttcctcccgctcgcttactgctcgactcgtcgccttcctcctcgtggcgagcgatcgatgaggacgggggaggtggcggaggcggtgccgagggtggtggcgatcctgtcgtcgctgctgcagcgggtggcggagcggaacgacgcggcggcggcggcggcggcggtgggggaggaggcggcggcggtgtcggcgttccaggggctgacgaagccggcgatatccatcggagggtacctggagcggatcttccggttcgccaactgcagcccgtcgtgctacgtcgtcgcctacatctacctcgaccgcttcctccgccgccgccctgccctcgccgtcgactccttcaacgtccaccgcctcctcatcacatccgtcctcaccgccgtcaagttcgtcgacgacatgtacgtcgctgcaccaccactctctctctgtttttttttacttcctaattccccatttcacgcgaattacgcacgacaacgccaccgacagagttgcttgcttgcgatcgtcgtcgacagaattgtagattgattcaacggtggcatttgttcgtagcttctgaatttcaaattttgaaacttcaagagcaagtgtagataaaaaacgaactctttttctatcttgaaaacacaattgcataaacacttgcaccggttagattaaaaaaagttgcatattcttgtattatctagccagccaaatcaaatcgaactaaatcaacctgaaattctgagcaaagttgcataatgcagcagcagcatgatcgcataattcgaccttttttttctctttacaatcgcacaattcgactttagtagcgatgttgcttggcgaaatgtgatcgaccaatcctttttctttttcgttttttgaaccaaatgtgatcgaccaatcgatggatcgatcgatcccctttggattgattggcacacgagcactgctgcacagccccaccactgtaccacaggcatgtggtccccactcacagacctactagctaatcccctttttcacctagcaatagcattttccaactggcattggcaatagcatcaaatccaagccatcgagttggtcacaaatccaaaggacagttgtcgaattcgaggttgatgcggcggccattctactaccaaattcgccattcttaccaaagtgacagacaccttgggtgtgtgtgtgtgtgtttgtcctatctaccttctcacaggctcacattgccctcaaaacaagccactcggttttgtccgtttcgccattgacaagagctattgcttcggtgacatgctggctggcctggccatcattgatcagtggtctaaaactctgaatatgctcttcttcttgtcgtagtttggaatatgttttttttttaccgggttcgttttatctttcggttgaactggtcggtgcatacaattcaacctgatgaccgtcacaatgcgtcgtcgatgcagatgctacaacaatgcctacttcgcgagggtgggaggcatcagcttgatggagatgaattatcttgaggtggacttcctctttggcatcgccttcgacctcaatgtcacgccggctgccttcgcctcctactgcgccgtgctgcagagcgagatgacctacctggagcagccgcccgccgtcgatctccccaggctgcactgctgtccgtccgatcaggacgatgccggctgccatcacaagcagcagcagcagcagcaacaacagcagcagcatcagctcgccgtctgaatgttcaggagttcagaatcaatgagaagttcagagctcttcttttttgtcactggatgtggtgtcaatttgcctttcttttttcttttctttaatcttttttttaccgtgcttggtacataggtgttagttaattgtggttagtgaaagaattgagctttgattagataggtggatcatggttcatggatgggtcagcttcttgggatatttttttcgccattgttcgttcgatggatggatggatcatggataggtggatcagctttgggatcttgccattgtttaagtgatgctaacttgtgcgcatgtgagtcacagcacattgcatgtctcttgtttgcttcctttttttttctctcttttattttcctcttttctgaacattattcgcggcaggggcaagaaaagggtaggagagatatcatgggattgtggcgacaattgggttattggtcagaacatggcatgtttcttcaatgtttggacgaaaatgatcagctcagcatctctcatgaaaatgaaaattttcgattatatatttgatgggcatagaacctgaaaactctgaataaatgcagagagcaactg

SEQ ID NO: 23890 - DNA, 3781 bp, Oryza sativa
agacgaaattattaagcctaattaatccggcattaacatatgcgggttactgtagcacttatggctaatcatgtactaattaggcttaaaagattcgtctcgcgatttccatgcaaactatgtaattagtttttttatctatatttaatgctttatgcatgtgtccaaatattcgatatgatgtttttgggaaaaaaaatttagaactaaacaaggccttaacagcaagcaacaaacatgccagagttgcatcaggggttacaggagcagaagtaaatgagtcacaaaaaggaaaagaaaaaaaaagagaggaacacaattaaatgcaatgtcaattcacctcatgtacttgtccaaaagggccaagtagatgagagattctactacaaggagatggagagattctcatggcagcagaggcatcttgggcggtactacctctgttcacaaatataagctattttagaacaatactgagtcaagtatttttaactatgactgccagtaaaataaaataaaaatcaatgacttaagaatgatgttacagcaattagagttaaacaaactatcataatatgcaactctttttatttgaaataattatttttaaaaaatacttccattgatcaaaataacatattggtgaccatgtccaagtccaaaatcgcttatattcatggacggagagagtatatcagacaggtaattaaagggtgccattaccatgaacagtagatgcatcatgtcatatactatctatgcagatgttagtagtggagagcaaggaggaggggtgataagagaagagaagagaacgtggtgtgcatgaggtttgtagggctaaggcagtggttgtggagggcaaacactgcgtgccaacttttgagctgggggtgtaatatataatgcctttggccttaatgctgtgagctggacatgaacatggatggatgccggtcacaagaaattcggcggttgcaaatggtgatctgatgagatgaccagtgatgcagggcgaggtgaggtgaggtgaggcttaattgcagccaagtcagaaaggagaagtagtaaacgattccctctctagtctctatgctcatttgacattccaggtgaaggttatgtgcatcctaagctaatgtgctgtacttagtgatctaagctagtgcacttatactatattgtaactagcttgttcttaattgcggcaataacagcatacacaattttattacagatgtggtttgtattttgtatttttttaaatgaaaaggtcaaaataatttattttgagctattaccttatggtaagaaaattggatttgttagagtgtaatatatttgggggaagatgtgtcggtgggtaaatgtttaagctgatgaagcgtttctattggtagaaaactattatggacaaaattaaatatatgtggtgagaattggcatgtgggtactgaaccatgtgactccagaactgccaaagccaatggtatttgaacctgtgatgtgaagcctagctagctagctagcccatgcaatgtggatcagtggcctaaagaatcacaggagtaaaccatcagggacagtgatgattctttgggcatttgcttttcataaaggcttccatttgctttggttgttcccctgtgaaatggagatggattttggttgggagcttaactttatctatgtactttgatgccaatgcatgtgtgtgcctttaatcattcttgttgagttgctggtacatgtcttctgaattccatggcttccatcctttcttatcttctggaatagtgacaagtgcactaattgtggctcctatgcaatagaagtgaaaacagggatgtcatgagctcaggaccaccacaggggatttactaggggttgaagtatacagtaaaaatagtttcttttcttaacatttgaactcacaatatgaaattgatcgatgcatgatgcatgaaactcaacaatcaatttaacccgtctccagtaaatttgcacaaccttattaggtgcaaattttgtaaggataggcaggtggtaaacattacagaagccccaaaacaatgaagactgtactttttgatgttaaaccctgcagcacagttttcttgcaaagataagttgaccatcaaacaattaatgggaaaatttaaatcatgccacacaaaatttacaaaatttatgatataccaccctgacccacatgtcattaactcatgtgggtcctatacgtcattgagatacgggtggcatatctcaaattttgtaaaattagggtggcatggttccatcaaacccaacattaataccctatttgattaataccctgtctagaaacagtgacctctggcagtctaggatattgcttcctacactagttgtgtacaaccatgactactacagtaccacccagtagatcaccatcagataacatggaagctagaaacacttgcacatgatcgtacccagctcatacggggtgaccagctcagtacaagatgacaaaaggcactctatcattcatacttcggtctaccatgtgtttatttgaagtggacactattactctctatacataagacttcgctctttaaaacttgcgaagtctgggccgttagattaggatccaaagtttcacatatcctcttctctatcaatcgcacatcctcctatccggaggcatgattttgttaaacaggagagttgaacgatgtaattttaaaattttattaaaattcaaatttaatgtttttttctttagaatttgttgtcatgtgtagggcccaagcctaagctgacctacacgttgctccttctcatgctccttctatttctcaaaaatgaaagtgtataattctatatcggacatacaaaattggcattactagaattaccatatgaaatgcttttgcaacagtaaggttctttttttaaaaaaaactaacactaaggtttcttgaaccacagttttccgccttacctccctcgtttagtaaggttgccaaccttagctgttcgttttccacgcgcacgtttcctaaaccgtaacacatgtgagaatgacaagtgggccacagctgaattccaaagcctaaatgttaaggccttgttcaatcgcggcccatccaaatgagccccaaacggcaacacgagtaggcccaggaaaacgtaaaccccggcctgctagtagatctgggcccatagtgccgctcgtgtgaaatcaaacagatctcgtgctcctctcctcctcgtcgccgtctgcctcccaccacttgacaacaacaaagtctctctctcttctctctctcgcctcgacgccccaaaccctagccatggccgacccagccgctgccgccgccgccgccgagttcggggatcccgattcgccgcccgcgccggccgccgaggaggccgaggcggctgcggcggtgggggaggaggcggtcccggcggcggaggccgcggcggcgaagaggtggcccgggtggcccggggacagcgtgttcaggctcgtggtccccgtgctcaaggtcgggagcatcatcgggaggaagggggagctcatcaagcgcctcgtcgaggagaccaaggccaaggtccgcgtcctcgagggccccgtcggcgccaccgagcgcattgtgagtgccccgcgctagttagtttatcgagtgcctatgtagttctttccgttcaatttgtcgagtattttagaagctctaaatttgacattaacattgttggattgtctggtaggtaggatcttttcttagag

SEQ ID NO: 23891 - DNA, 4929 bp, Oryza sativa
atgttgattgcgtgtagtattggtgtgtggtggtgcccttattgtaattatgctggttagggtggtcttatcttgaagttattggacttgttattgcttacgattgtaggcagttcatctctcaagatgatgggtagtgaacagatggcattcaatatgttttcctgcatttgtatctcgcctggtttggtgtgactcaaacagaacgatcttatttataatttggttcaaattgatgaaagcaataatctatcattctatctgttctctgaatgtgttcgaaattttgtattgggcactcacattagtgttgtttgcattattgtttagtcgtttgatgttatcctttggattcactaactgaatcaatcccacgcctcttggttataggttcttgtgtctgggaaagaagacccagccttggagcttcctccagctatggatgctctcatgagagtttttaagcgtgtcagtggtataacagatggagctgctgagggcacacaggcagctactgcacctggtgtatgtgctgcccgtttgttggttcctggagctcaggcaattaacctaattgggaagcaaggtgcttcaattaaggccatccaagagggcactggtgctacaatacgggttatatcaataggtaatgtactctcgcttgatgcatagcatgttaatacaccattgcctttgtgccaatttgatggttaaaatttctgtaaaagtttgattttacaccagggcttgctgtgcattattctgtgatcctttgtttatactgttggtatgggtttaaggctttaagcaagtaatagatattttgaagtcttcccctgttagtattaaccatggtcttgatatgcgtattttattcaaagaaagcgtggtagagcactttgcatgtcttcttgcatggaagaacgtatcatgtccattctactcttggtcacagtcagtagaaaatattgtgggaaaagtttcaaattagcacataacattgttgcgtagaaaacccaaaggcttaacttttctagatgtagaaagatatcaagggatcaacaaaaatgaattagtacaattttgtacaaacaaatgcgtgttgatggtattgtacttaaacaccctctaaaattttcaattaccctgaaaagtgacagcaatatataatatcaacttataaatttatgtagatgagcgagagcgacctttctatgtaattgaagatgaaaggatagttgagatccagggggaaacagagaaagtcctaaaagcacttcaagcagtttctaatcatctccggaagtttttggttgaccatagtgtacttccattgtttgagaagactgtaagcacatttatctcatgttttactttacccttcttatcaatcctaatatatgccgtttctgatttgtttctcagaatgctacagtaactcaagatcgcagcactgatgcttggactgatatatcacatccttcaattgtttctgcacaaataaaccaaccacctcctgtggttgatgaatatattcttccaatgaagagagaccctctgtttctcgaacgggaaccattgatagaccacaatattcatcgctcaggtgtttcgctttatgggcgggatcctgccttgtcaacattacgaacctctggaatacatggtggtggacctggtggccctctactttcacaggtatggttgatcttgggtttcacatgcatcttcattttttttttctgatgagctgtttgctggaacaaacatgattcatgtggttctttgattttgaaatctgttgtaatttgagtctcttttgcctttgattatgcatcctatccattaatatatgtttgccagttattatttatcagtacaaatatttatttcctcgtactgtttactgactagaacacgtggcacgcagataactcaaacaatgcaaattccccttacctacgctgaagacataattggagtgaaaggagcaaatattgcatacatacgagctaacagtggtgcagtcgtcacaattcaagagagtttggggagccctgacgatattactgttgaaatgaaggggacatcatcacaagtacaagctgcctatcaactcatccaggtaataccatggcatatatatactccttaaaattttgtattttcaagtttcagccataaaaatctctaatgtcatgtcctcctccctcaggattctctggcggcacatagggattctgtcaggagcagctatgcaggattagatccagtatataggccaagctattcacagtatggcagctcgacctatccgtcgtcgtcattgccatcgtattctagcatggatgggggtggatattcgtcttcaggtctcggtggatatgggtcatcttaccggtactaagcagttagtcgataggcttgttgccgccctgtatccatccctgggccatccttgtactgagccagcaatagatgttttgatggcttttgttcttctcggctgtagtcctgcagaaatcattgtgtcccggcaaatgtttttggtatatctgcttttgttagtgtgacagggcatgtggtttatatctcatcatggaaagatgcccctaatttttcatagtttagttgcattttttgtgattcttatggttgtgtggtctacctgtttgtgttgaaaacggatgagtcaatgcacgtgttatgttcatccaatattttcatgctgtaagcatatgaatgaaaaggaaaaaaaaagtaccgtgaagcataactgaagcataaagtcgctgttacatgtaatactttgatactgtgcccttctacaaaatatatgaaaaagaaatagccgtgacaactagatgatacttcaacaaaatcatttctaccaatacgatcttttacgtacaaagatagcaaaactaagggactttgaatcaaaggatttatataggaattttataggatttaaatcctatagtaaattttactatttggccctttaatttaaaggattgaagctttctaaatcctatgaaattcctatggaatggcacattgcatgtggattttgggggaaatttagcaagagctccaacctcttggaaaattttctttgagtctatctcttatccgattcctgcgtttttcctgcactccaattaaacgatcattcctgtgttttgcaatcctctgttttacacttcaatttctgtcagaatcctatgtttttcctattcctccgttttttctaccttgcgattcaaaggggccctaaagcttcatatttctagatgtacaaagaatgtgagaatatcactgcctaccgacaatattaagttgattggaccttcaaattgatcccgtatcccaatactgttgttgtaacgatgaactaatgaagaacacactaccgagcgtaaccacttcatcgtaccctgaaaatatgggctctgtgaaacaggcttttactgtggattctctggcgttttcagtgatcttccagtgaccaaaaaattagtactcctataattacaaggccacatagatgagccaatcattcaagggccaagcgtacaggacatattgttatccaaattacatctccagcggcacaaataggagtaactgttagcttctaaattgctgcaaaaaaaggcctacgaggaaataaatatgaagattactcttcacttgcatacaatgttgtctgtctgttaaagttgaccagcatgttccacagttccactagcccatcctgtagtgacaagaaaaacagtatatcagtcatatcgaattgttttattgaacataaataccatacttctgagttcaaaacatacggaacagggacgaaaggaaataagctgctgtagctacatgacacacttcaaagtttaggcaattcaactgactactcatctttcagtcatagcaatcctactgtaaaccttgtactcgctgacaaaatcactgaaaaatcctgaccatctggaaaactccgttccctcaccatatacaaacacacaacgggagagggaggagggatggagaaaataaaaggaaaaacacaacaagattcctctgttcagttttttttttcaacaaataacgattcctaccaaagaggaacaattcagctctcctgcaaaagcacattgagagcctcagccgtctttcctgtataacaggaagaggatcttcataatctagaaaacagaaacaaaaatatgtttgcatagacggaaaacaactcgcaaggcaaaacatcactgcaaagaaaacaaacaacttcataagagatatggatgattgtaagggaagtgcatactttctctttctaccaccctgtccacccatgacatttctcatgtcgttctttgggatattggtgccaggggttcctgcaaactgcataggagacattgcagatgcaccagctgctgacataggtggcaaagatgatgatggtgcagcaacaggtggaaccacggtcgacggcactggtgctgctgggggcactgttgctggtgcaggtgcaggtgcaggtgccggagttggttcaggaggagggcggggtaagatgtgcttcaacctattgttcctatagtttttccagaagaaatattgctgcctatgagcaacttcctgcgaataatttgatggaaggaattagtttgtgctactgatgctaataaagcacaacagacaaaacagaattacgaatatgcagtacaatatgaacaaatgatatgcttcaatttgttcagttgccccctaactaattcataaacaaataaaggtgcccattcataagtctgtaagaacaacaataataaagttttagctcatccccattcactaacaatctacagtcaaagtaatacattccaaatacacttaataaaggggaaatctgaaaggatg

SEQ ID NO: 23892 - DNA, 3962 bp, Oryza sativa
aaaaggcagtgcggatacctacacaaacaacaaccagtgtgaccaagctattttgtcacagcaagcacctactagcaaacagatctaaattatacggccactcacattatgtatttgatgtactccggacgctgccagtatttgagatacttgagatacccgataaatgcctcatcctcaaagtacctattctgtgctagatctgtttcaacataagaaatattagccaaatgccattttacatacagtattaatttcagtactcatttaacaagtttgattccattaaaaatagcagaagcattgagagtaattgggcataagcaaaacataatccagacatccataccttcctactgatcaacatacacttcaattatgcatccaatctacggtaccagactaccagcaaactaattactctaggcagtgtatcacgcttgctgaccaacacaatcaaattgctgtttatttttccttaactaataccatcaagtcaaagattaaacactaatttgttcaataaacctaatgaaaagatccgcggtaaaaccccaagccaagtgaaacgagaacgaggatacagtacagtacagtggatgtaggtagggtttgcgaggcactggatgaactcgagctccaacaagaaccgctgcctcgcgtcgttggggtcaggcgccggcattgcctccggctccatcacgcagcaagcacctgcaagtgttggagagagagagagagagagagagagagagagagagagagagagagttagcacgactgctccggctggatccccgatctactccggctcagcatagcaaggggggaggaatacctcgaaggccctggatgcgcgcggcactcggacgggaaggggaagccccgccgctgctcgcgctgagagccgcccttctctctctctctctcccccccccccttggacgaaccctagagcgaggcagcagcagagagggccgcggcggcgggcggcgcggcggcggcggcggcgtactcggcgttcccctttgcactggcgctcaggcggcgagggcaaaagtgaggaccgattagatcagggacaaaatcgtccatgaaaacaaactaagagcaaagataataaaaatggagtaaatttcacgatactacataatactttgataataaaactacatatttaataatgtgtttcataaaactatagatttagtgtcaaatttatcatggaactaatgtattatatcatataactatagatttaacaactattttatcataaagctacatatttacaactttaaataaataatagtgatacgatctaaactctagaacatgtagttctttgataacttcatcactaaatttgaagttttgtgatatggtgcattaaatctgtagtttttgtgaaaagtttgacgctaaatctgtagttttatgatactttgatccaagtgtctacaattttgtgaaacttactataaaaatgagaaaataaggagagaatggcactaaccggaatcattcgtaccgcgggacatttaatttattgctactttaagatgtggcaattaattatttgccactcgctatctataacatgtcagccctcatgtgtctatgacatgtggatctagtgataaataatttagcaccactcgtaagagtggcaaatagttaattattctctgaattaatagatgtgaaatgttgtaagacgttagtgttacatactagtaatttcttcgcatgagaaggggacacgatgaggatgagagaaatacacaatgcttcagcaaatacatgttttttgaaagttaaagtttttccctcgctattattttccaaccttccattgcacacaatttgatagtagaatctcatattgaggaaagatgcttggttgatttagatcacataggcttatctccaactataagggcccctttaaatcgtaggaatgaaaaaacagaggaataggaaaaacacaggattctgacaggaatacaattataaaacagaggattgcaaaacacaggaaaaacacaagaatgatcgtttgattggaccacaggaaaaacgcaggaatcagatgagagagatagactcagaggaaatgttccaagaggttagacctcttgctaactttccttcaaaatgtgcataggattacccatcccataggaattttaaaggatttgataggattcaatcatttgtttcaaaggccttcataggattttttttttcatagaattaaaatcctccaaaattcctacatttttcctacaaatcaaaggggccctaaaaaaagaaggaaaacctagtgcgtaaaaacggatgttaagttcatccttatgtaaacttatgggacgagaaaaaaaaatataatgcggttacactgtatgagctgcaaaattgtatgatggtcttgacactcaaaacgatacaaccgaacaacagctctatccaacgcagctccgaagatccaattactaaacccaatgatatctcatgtggaaaacaggtttaggtaagacaggcttggtgatatgaggcagacctcaagctacatactatatactagataactaaacacatttctttacttatgtataaaatttatagaacaagtccttgtatgtttctgagaaaataattataaccctttatgttataccaatgtattattggtgtattaaataacatgatacatattgatgaaatatgagatattccttgtattttatcttagggacatgttatttatggaacttgatagacatagctcacgttgtcgtgacaaacacctactaaaatacacacagtagtgtgatgaatgataacccctttgaaacgattcaagaatatgctctgctagtttactgttgttaggatcacctccattcgttttgatcaaagggactgtttggtagagccttttagatccaaatccaataaagttgaagttctatcaaatgattgagatccatgcaaaaatggagcagagtgggttggataactcttacaagtcttacaagttgtacttgtggtttagaagttctttaaggaaattaacattgatatatattggttgtaaatttgaaacacatattcatgtcttataatcgtacatcaaaataaacgtaagtaataatcatatttatcctctcatctctttcatgatttctgaagatgatagtagcttgtaagtattggagttggatccccaaaaaaaaaaagtattggagttggatcatgaattaaggatttaggacaattacatatttacaaacacatgctaggatttaagaggttgcttggcaaatgggttaggaaaataatctcacctaccaaaaaaaatatatttttaaatcctagccatccattattccttcctcattgttttcctaaccctttatccattttgctatcccaacagtatcccgcttatctcattattatcccatcacaccctacgactgtcaacgcttccaaatgggccctagctgcacggcgaaaccaaacgcagccacgccggcacggcacgcgcgtgggcgtggtggccgtaggccgtagccgccgcgccgcgcgaataaattagcaggcgagatcggccgccatcgcagattcacgggtcgagacggggcacagaccagacggcgcggctcctccccattcgaaaaagccacgggcgcatcgcaccgcaccgcatccgcgcggcggaaacggaaagcactagccgagagggacgtccacccacccaccaggccaccaccccccacccccgatccgacacggcacacgcccacgcccacgcccacgcccccacgcccacgccgcgcgccgctccatctctcgcctcgcccccacgatgccgcggcgccgtgccgtgccaccactccctcgctgggccgccccacccaccaccaccaccaccgcgccgccacgcgacaaacccc

SEQ ID NO: 23893 - DNA, 27906 bp, Oryza sativa
catcccctcctctctcctccaccaccaaaccctagctcccaccgccgccgacgatgtcgtcctactcctccccgccgcccaacccggacgcgctctcctccccggacctccccccgctggccgcccccgcggcggcggccgcggcagccgccgccgcggtgtcatctggtggcgcggggggctccgggcggaggctgcccccgccgtgctggacgcacgaggagacgctggcgctcatcgaggcctaccgcgataggtgggaggggctccgcaaggggaacctcagagcctccgactgggacgacgtcgccggcgccgtcaccgcccgctgcgggaggttccccacggcgacgcacaagtccggcgtccagtgccgccacaagatcgagaagctccggaagcggtaccgcgccgagagggcgcgcgccgccggccgctccaagggccccaagtggcccttcttcccgctcctccacgacctcgccggcggcggggcgcccgaccctagccccaaccccatcatcaagatcaaatccaagggccccgccgccgcggccgcctccccctcaccggcgtccccttctcccgtctcctccccttcctccgaggaggatgaggaggaggaggcggcggcggacgcggggcggagcaggagccttcacggcctcatctccaacggcgggagcgggagcggcctgcgcttcaccatccccaaggcctcccgctccaagcctgtggcgcagcgagaacaacccaccgccatcaaggtggagaagagcgaggaggacgccgaggcggaggccatggccgaggtggcctcggcgctgcgcgccgtcggcgacaagttcctccgcatggaggagcggaggctggagatctctctccagatagagaaggagcggatggagtctgagatgaagcgcacccagacgctgctcgacgcccagcagctgttcgtcgaggccttcctcggcaagcagcagcaccaccaccaccaccacaagaaggccaaggtgatctccgccgccgctgccgcagcaacagccgccatggatgaggattgatctactccatgttgttggtatggcctactatgtgtttagtaatgtttacttctcattgttaactgctggtgttgacttgtgataattctactagctgttgtttgtgtttgggagggtgattaaagtagtcaggtgtaggatatggagtgggggagtgaggaggaggattaggagtgagtgctcagttaagctgcctgtaatcagttcagtgatcttgtgcttgagttgctgctgctgaagctgccttgtccaaatacttctgtagtagcatattattgtcaggtttttactcaatcagtgtcctgtgtcatgttctatgttttgatgatcctaagccttggagtatgtgacagtaacttgaagaagccttgcactgtagtaacatgtttttctccatgaatcaaattaatggctggtttaagggtactatgatagcttatcagttgtcatggacatctggacagctgaaaacaacactctggatgcatcaaagagggtatagcgaaatgtgccggtttcttcgcgcttcttgctcttttgcactcagaacaagactgaagagtatcctgcacttaagcttctaatttattcttttgttagtcaagtcttcttgaaaacaaaaaggaacttcgactagccttctgtcaaagttaaatacaaaacgaagcagaagagagtgctgacatcggtcctattattttaattgttcaaatgaaataaagaatgacaacaatctagtaggactatgtttcattaagccaacgaaattctgaggtaaggcaatgtttcattaagctgttttatttatatgctttccaactaataaatggtgtccttttgtgcgaaatcaaataaatctgtttttcaagtttaatatgtatgttttgggaccgaagtaatgagcctgatcggcacacaaatgcccgcattcagcatggggtcatagtgcgtgtggtaatgacagatctgcaagtgaattcctcagttcgcactgcaaatgtactcagacactaatggtcagttcaccaaaccatatgagcagagcaatcgtagtaaaggccaaaaacggagtcctcactagtgaaactcaatgcttgctcgtacctatggaaaatgaaggcactcatgagatgtccagaattcagccgttgtaatgatggggcaccgtctggttttcatatattataaaggatgattgtcaatatatttttactggaaactggattatccctagatacaatttgccatgtcaccatgattatacaaagggtctgatgtagacaaaccatctgtgttgaatcaggaccagacaaaagagcgcgcacgtcctgtcagtagtttggaaaataaacattccagttcttaagaaaaaaccactaacaaagtgcaaattttttcgctgaaaactaattgcaaaaggtctagcacttgataatagacgcagacttgcaacgtatcaacgtataattgttcaaacttgcatattagatatacatgcggcactccaatgaggctccaaaatcagcttcaaatttaaggttgaaaattcaaattttggccgataagtataagcataaaaaaaaaaaaaagatgccagaggccttttattattcatacattgatcatgtggtcagtttggttgtctcagaagtaagaatacatggacctgtggagagatgtgttacgaatttatgatccatttttcttcaagaaaccttgatataagatcgtcccaggtgtggaacaaatagaaatgagcattacaaaaatgataaagcaatcacacagtgcacaaccttcatcgagttaactcattcccgctgtggcacaacgaacattctgcaaaacaatatctcgaaagacagcttgacacacaactcacaaatcacagcgcaaacagaacatgtagagtaaaccagaataacagaacagcatccagccttgtaaacaaataaacagaaagaaaaacaaggaatgaagtccagcgccagccaatcaacttgctacctctgagcacaagattggcatcagttctatcaggccccgaaggcttcttttgtgatgcaagaaatcacatcttccatgttcttttgtgatgcaagaaatcacatcttccatgttcttttgtgatgcaagaaatcgcatcctacataacatgattgactgccaatatgataatgtagtaatgcgatgggaaaaaatgatacgatgagaattacttcctccgtttcacaatgtaagtcattctagcatttcccacattcatattaatgttgtctagattcattatcatcaatatgaatgtgaaaaatgctagaatgacttacattgtgaaacagatggagtaaagtttatctgacagtctgaccacccaggggtgcgactactaatcgaggcagctttgttcgaaatcaacctatcataagctcctctatggcgtacagtaagtttcaagacattttcaaaatcaagcaagatgtgccaaggtagttgttgccaaatatcaagcattgctccagcttacacaacaagcagcaatgagtatttataaatttggcccctcaaaaactacacaccagccaaaagctacataaaccataagatattggaatatcacctaacttcaagtgtctcgccatcaaagtcaaaacggagctaaggtcaatgacatatcccataacatatctcaatcttcaaacttatttaaaccagaatattagtggtgcaaaaaaaatagtaagcagcattcccacactagctgagcaaaatttccagacctaccagtgaagtgtatgtaagcatgaggcactgaattaggacatcctaattatacttattttttgtgagtagaacaccatgtggtactatctcagatttctacaaggatcatagggtaggcaaccattggttggaacaactaaaagaatgaaaacattacttatgaatgtcctattgcattcctttattcaaatccaacaatgtatacacataatcagctatccgcctgaaccttaatactagaagcatcacataatccatccatccagacaggctcatcttgcacaccttggcaccaacaaagcaatgagccaatcactaataaaacactaatcagggaatttagcgcaagcaatcgacatcaaattcaaactataactaagacaagaaaatgaaccataaccagtgaaaaattgacacagaacgtctcccaatatgcttctttaatagatccatactactaaacatccacacccacacaagcaggcagtagtaccattacatcagggtgattgagattaatttagaaaatccaaaaccattcattggctgctactcagaaagcgaaaagctttagaaaaagagaaaaaggatgagatggccgtgcaccagtaccatcccatcgccgccgccgccgccgcaggagagagctcagaagcggagcttggtgaagaaccacctgttcttgccggtcttgaagcggtcctcgaggcgcgccttggcggacttgcaggcggcgaccttcttgtccctggtggcgagcgcgtcgggccccgcggcgacctccttgaggtcgacgtcgagggtgtagcgggtgggcatgaggtgggtgaagttgacgagcttgaggaagcacttgacgcgcgacttcttcgccgtcttcttcgccgagtccttgcggatcaccttcttggggtacttggcgaggccggcgacgaggcagtggccgtaggggcggtcgcgggtgccctcctcgaacacccgcacgatcaccgccttccgccccgcgaacctcccctgcagcaggatcaccgccttcccgggcttgagaaacttcaccatggctgatatcctctgctgcgccgccgccggggaagatggagttagggttcggggagaggagaggctttttttaagctcttttatagtcgggttgcggagaggatggtttagggtttggggtggggatagaatgacgtgtttacccctaggatgcggtccgttagatgcgaatcgggcgggtttaattgatgggtagtggtggtggggccaatgtgtcagtggtaagataggtgggcgagcgtaggggcaaaatgggaagagtgggagctgggctgagatgggctttgcgctcgtgagtgccatgtaggcccagttatcagacggccggcacagcatctggcccacgtcgagacttaatgtacagaggatcacaggaattttgcatgatgttcagagatgtttttttgttttctgaatgttcttaggttttttagacttcagaacaaggcttaagataatgcatgcggcacatacaccatttagctcctaattattcttttgatagtcaagtcgtcttattgaagaaaagaaacttcgacaaagttaactactagtgaagaaatgaagcagaagagagtactgacgtcgccacgccggctctattttttttattattcaaagggaaaaaaaagaatgaactactccaagctagatactatctcttcttgtagggccaaaattccgagctagatatcttaagctaccgccctgtacaccaacctattccaagccctgtctcgtttcttccttagcctgtcagcaatggcgaaagccagttcaagcgactgcgatgcattcagcctggggtcgcagtgcgtgcggtagcgagagctgagatcatcaagggtcaccgtcttggatccaccaatgcactctgtaacgttctgccctgtcatctccaggtgaatccctccagggtagcttccctcttgctcatggacatcgaagaaagccctcagctcgcactgcacatgtacaagaataaacacaaatggtgtcaatatgtcaaatattcatgtgtaataagtcagttgttcatcaaaccatgaatggtgaagtctcagggcttgttcagattgatgtcattttaaaccatacaattttttttactaaagttgtcaaatatgtacatccatttagtttcttgccaaactctagtaaataaataagaaaccatgctaaaacttggcaatattgtcaaattgccaaaattttggcaatgccaaaagttggtaaggtttatttttactacaatctgaacatgccctcagttcttaccctgatcgcgtcgaatgatcttgtcttgagaccacatggtgcgctgatggtgttcccatgcatgggatcactgacccaagtgacaatcaacccagcttggcggactgctctgatcatatgtgggagcttaacgcgcgtgttctcagcacccattcttgtgatgattgtcagtcttccgggcttgttgtgaggattcaaaatctcacacaatttaacaagctctgaaggttcgagcttgtcactcacctttttaacacagaaaaaattaactatgtgcatagacaactcgttttgtataacaaataacaataaccataaagtcatggctactgtacttatatttgcgatggcatggtaaacatgatatacaatgttttttttctggcggtctttcaaaaaataaatattttccccgacaaattagcatttacatctaaggctaaacagcataagaccgatgactgatgatgaactatggtactactagtaaatattgttacttgtcatttgagatggagcttaagtacctctagtagtccaatgctgatacatagtttgagagtttcagtagatatattacatattgaagatattggctgaaagtcttatacaaataagccaactttgaagaggtggattggttacctttacacctagagggttggaaataccacgaaggaattcaacatgagcaccatccagttgtcgagtcctctccccaacccaaagcatatgagcagagcaatcgtagtaaagcccagaaatggagtccaccctagtcaatgcttgctcatatggcaaatgaaggcactcatgagatgtccagaattcagccgtcgtcatgatgggatgctgaggagtcagaccagcagcaaccataaatccgatggcatcgtgaaccctctcggacagctccatatacctgctcacagaaaaaaacaaaagaggacatgatcttggtttccattgtataaaggattattatcaatgatacttactagaaatccctagctactatttgccacgtcaccatgattatattaagggtctgatgcgtacatgccatctgtactaaataatgcaattcctatgtctgttgtttggaaaataaacatttgcattcatatgaaacaaccactaatatgcgtaaagagttttgaataaaactaattgcaaaatgtctagcacttgagctaagctaacaactacctgtccccttgcgtgctgtccctcaagaagtcaagattccactgggtgactctctgcagatctgcataccctccatgagcaaatcctctcagaagattcagggtgctcgcggactggctgtaggctctaattaacctttcaggatctggtgcacgcgacttctcatcaaaaccatcgctgttaataatatcacctcgataggaaggaagtgtcactccatctatagtctcagttgggtttgatcttggctttgcaaattggccagccatccttccaacctgaaatatacattgtcaatcagtcaatctctccacctgtctatcagcacttgaatcattaaatgttaagccatcaatggtttgaagaacataaacctcaaaaagaaaactgcaaatacacttttgtttgtcaatctagattccagaatagactaagatactgaatctagcttgtcttttaaacaatatgaatgcttatggtttcatgtgtgcactggtggccacgtctgatccctgtctttcttgctgctgtaccttgtctgtcaaatattggggatggaaattggcgattgacttgttgatccgttaacttaagactcatagcatatataactgctaacaatcaaccatctatgcgactatgcctttcagggggaaaaaacagaaaactgaatggatgaatccgcgctgtgccataatttataaattataaagcctgatctttcagaacttgacagcgaagtcgacacgattatgtctacatcgaccgatcgccatctcaaagagagattgtgaagatgacagctgggaccctgcaacagcttaagcccgagtgatcagccacatcacatatattcgttctatctgaatgcgccaaaatcccaaacagtgcagcgtgtggcggacaggaaacagataattttcgatctcgaattccaatcgggtataaaatggaggaagtggattttgatctcttgaggagatatctcctcgttgcttgcttgcatgttactcaaatggttatgaaaaaatttgagaagatgtattaacgtgtgtaatatatcactccacaaattcaaattcagcttctatatctggcaacaaaattaattgtgaatatatgttaactagctgcggttctacatctcgcaacaaaattaattgtgaatatacgtaaactagctgcggtttaattaatttaatttttttacgagatcgttagggatggattggagaaggagaaatggtgagaagatgaagccatgggagtaggcgaggaggaccttgatggtgggcatctggccgccaaaggtgaggacgacggccatctggagcatgaggcgaaaggtgtcgcggatgttgttggcggcgaactctttgaagctctcggcgcagtcgccgccctgcaggaggaaggcccgccccatggcggcgtccccgagccgctcctccagcttccgcgcctccccggcgaacaccagcggcgggaacgacgccagctcgcgctccgcgccctccagcgccgccgcgtccgggtactccgggatttgcctcgccggccgcgccctccagctgcccggctcccacccgctcgtcgccgccgccgccgcgcgcaccgtgatcatcccccgccgccgccgccgacggccggtggaccgggcgtcctcgagacgcgtggtggcatggacgatcgccgcgtgcccaacggtgagagccgccatggcagagtgacacgtcatcgagtggatccgcagccggaggcaaatcactgggtatttatatgtagagccgccgtataatactccagtcactacgtataatagtcacaatttttttagactaaccaaaacgaagcaactacaaatcggccgcatgaaaaatgcagaagttgtttcatcactagacttaaaaaagtgttttaaacaattacaatatcgtctaaatttacttgaaacatttttcaatcatgcggtaaacaacaaagatacattgattgaaacattaaaaaaaatcgtgaaaatctacatgtttcaaacaaatgcaacaccattttaccccaagttgaaatatttttctagcacgtatgaaacatcaaaaatccaaaaatataccggtctagatctagcttccgcctcttaggtggtcgaatctttagcttcttctgagccgaccaaaattcgaacaaaaacatctccatggaaaagataatgggaactaaaaacccgattagtacaccaacatataatagtcacaatggtgtacacacactgaagttgtactgtacgtctatacaataaccattttatgaacatggtacaaatatgtatacgttcataagtaacaacgcacatactcatctccatatgcatacacacacattatctatagcatatccgaataactggataacgaaaccgacaaatctcgctgtttctaattgagctacactcacctcactacggtaacctcaaagctttagggcctttttaaatcacagtaatgaaaaaacggaggaatatgaaaaacataggattctgacaggaatgaaagtgtaaaacaaaggattgcaaaacgcaggaaaaagaatgaccgtttgattggaccacaggaaaaacacagaaatttgaggagagataaaagactcaaaggatttcttccatgagattctatctcttgttaaaattcctctaaaacttgtatggaaagaggcatttcataggaatttcatagggttcattcctttaattcaaaatgctttgtaggaaaaatttctataggaataaaatcctctaaaattcctatgaatttcctttcaatcaaagggggccttaaagttttatttgattagaatattgaacagattatcgttttgattatagagagaataaattatttaagaaataaatttaacaaatatcttaaaatagaaaaatattttgagaagcgcaaataatatgtttaaataatccaaagacaaggaagtgtagcacaaataatccaattacataattcaatgaataaactgggaaaatgaccatgcaaactgaatagtccttgccaaatgatcacacgaaactgcaaacaaataattattttttttctttattatttacgctgcaggaaaatccggtgcagagtatacacggcagaaaatgcatcagaatacgcatatcatttggtctggcgatcacgtatattccggatcatatttacagctgcagcacaacgaccatggatgcatatggatcatggatggtcagtaggtgtcatactcatcggcggcctcctcttcgtcgtcgctcttcagctcggcgagctccgcgagcagcgccgggtcggcggcggccatgtcgccggggaccttggcctcctggatgatccgcatgatctcctcgacggcctgcgtcggaggggcggcgtccgtgtccttgtagtcggccttctccctctccgatatctcctttggcagattcttcagaaaccacgtgtgcttctttatctcagggatcgtgatcctctgaacatcaaaagttcagggatgcaaaaactcgagttagttaaattcagagggaatccatctcgttaattaattagagacatagtttgagcattagaacatataattgagatcatataggccgcattacaatgagtaagattacaggtagaatctgagtatgatttaaggttaattttcccttcggagtaatctaaagtttggtctagtttggcaacttgggatctcacttaaactgggaggtaaagtgtgtgaaattaagtacctttgaaggatcggcaacaaatatttgagatagaaggcgcctgcagtcggaagacaccctcacgtagtccgggatggagtattgcacgccaagaattctctgtcaagtggaacaaggcatgcatattcagagtttcagactcaccattgaagcaaggtgtagaaaaggcttggatgatgaacagagggaaatggagcacttacgctgatcgttttgcggaaattcctcggatcacctggatcttcaaacgggtatgaaccgacaagcatcacgtacagtgtcacaccacaggaccaaacgtctgctacctgggtaaggagacgcattacctcagatcatgcagagatgcaattctatgatgcgatgttccaggaacttcagtagcgtcctaacattactgaaaacgtaaagcttatgctgttcggtttgttttgcactcaatgtaagtatttcagctgcaatggatcacttttagctaacgtctaaatgctcaattgctacggttccatgatgctagaaaagaaaaaacaatagtgatagatactgctatctatctttactttacagccaaattcagattgcaaaacatagaaatgagaaataacttgccttgccatcatattcttttcttgaaagaacttctggcgctatgtatgctggagtaccaactgtagacttcggcttcgaatgcagcaaagcagactgaaaatcaaagaagccaagttgttcagtactccagtttgattctaccaagaaggcaagaacaattcaatctatttctagtaaagtactctgagatgtagaacagaactagtagcatccatgttagcacctttgagtaaccaaagtcacaaatcttcacacgaggtgttgggcttccatccaggagggtgttctcaagtttaagatcacggtggcaaatttcctgcattttgcagaagcagttaatgaccacttaacttaatgagcttacgatgtgcctgttacgtctgcagaatttcaacaagcaaaacataccagagaatgacagtagctgacacctgatattagctgctggaagaagtaccttgcctattgacatgaatcaattattgagcacagatggtttgcaaaacgggaagattagctcacaagaagacaagtagggcctgaaagcaacctcgtcttcgctgaatcgccctgcggtgcagatttgttcaaagagttctccaccagcagcatactccatgacaatggctaggtgtgtgggtgtcaaacaaacctgctcttgatcgacacacaaaacaagaaatcgttatagcagttgaatttacttcgatcttaagacgatacactacttactaattgtatggtaagtaatcagccagggtaagctttgtgcttgatagatgtataaacccaaaaccttatcattttactttctacagtagcagtggagatcagctccatctagtttgactgtttgactgactgataatcagtgaagctgccgaacgaactgatgagtgaaaagaaaatctgaattacctccttaaaccgaatgatattgggatgccggagcgacctatgattgatgatctccctctgcacattttcatcaatctgcacacagagcaaaccaaccatccatgcatcatcaatcaatcaaactaaaagctaagactcgtcatgcatctggaacaacgagttgctgaaaacatcaactcgcacacaccatcaaattatcaatcagtccgacgcaagaaactgcgaaataaatcacaaaaggagagaagagaagacagagacagaggcagcatcagaccttcttgcccctctcgatgtacttgacggcgacgagctccttgctcctcttgtccctgaccagcctggccaccccgaagttgccggccccgagctccttcaacgcctcgtacctctcctccattggccccctcgaaacccaaacccaaagaggagaagtcgccgcggttcgagaccgaagccgaccacccaaccaacccaatcagaggcgagctaacctccaaccaaaccagaccaaatccgaagaagggaggcggcgaggtggagggatatgaaattctcttcgtcgccgtcaccggaaagcgacgagggtctcttggtcggacttgaagccgaagcgaagcagcgacggcgacggcgaggtgcgcgacacgtggcccccacgagtgccgtcgcttgtcacgtgggccccacgcgtcagctcagctaatcggcgggcggggtaggagtggggcccgtggattaggtggcgtgtcctgtgaatacgacgtggccgtttcgtcgctccgggttgccacgtggctccatgtacgtattatatggaggcccacgctcagaagagggcggtgtccagaaacatggagctgggcttttcttttccaaagatgctgggccggttttctaaagtgcaaaccatgggctgcacgataaattaattgattaatcagttttagctagtaatcgttagcaaagacgttggttaacttggttttcttgctagtttcgtagggatttcaaatggttatgagcagtcgttcaaaaaaaaaagatgattatgagccaagcaaaccatgggactactatcaattcgaagcatccgctcgagaatcttccatcgaagatttggaacaatgttgaatttcttcgatgtgacataaacaatctgcctggtcgtggttcactactgtggtagtagtactattagattactctaattattgcgcgtggctgaggtaaaccatgacacattagtgctggaattgttgcatgtgaccgagaggtaagattagcgcaagttggcttgcaatttctttgcgaaatcgtatgatctgctaatattccgtgtggctctgccccttctcgctgattggagttgcgcttagccgtcgtaatagtcattttctttttcttggtttttttttgtcttttcttctttttcttggcataagccagtctgtctgattgcgttatgtaaacaaatatttttttttaatatattgacttaattgttttgcgcgttcggaaaaaaaaatctgcgaatattcccagctgaccaaaatgggaatggacgacgacgacgaggtcctcccttcttcgcttcttccaatccatgggccgcaagtccgcaagggccgcgcgcacgtgggcgcggtgcgggtcttctttcccaaaagaagtcgggggaaagcgaggcgcaacggactcggggcccacctatcgcgtaggtagtaggactaggaggaggcatagcccgtctcgtctcgacacccctccgaccccgacgcgtcgcgcaccaaacccccccgcccccaaccccgacctcctcccgtgctccgcgctccgatccgccgccgccgccgcgcgcgcgccgccgggggagtgcgccggcgtgtggtggtgggtgtgtaagggtaggtggaggggtgggtgatgcgagatcggccgcggcggcggtagagggggtgtgtgtgctcggctactccggtgggtcgggtctgggcggggtgcgcgtggggatggggtgcttccagtcgacggcgaggcgtccgcgcccggggtacgaggaccccgtcggcctcgcctccgagaccgcctgtgagttgttgttgctgtacttgccacttgaggagtactctacagtactgtatttcatttcatttcatcaagtagttcatctgatttatgcaatcgatgggcgtactggaaattctgagttagttgttttggatgtgtagttagcgtaagtgaggtggaggctttgttcgagctgttcaagagcattagtggttctgtgatcgacgatgggctcatcaataaggtgaacatctaactgtttcttgggggtatctcaccatattggcatcatggcatgtgtgattatgagcatcctgatacatttactaatctgcttttatagcttgttgtggaattacaaaattagaccttgccgcattcgaatatatctactgttccgtctttcatcaccatattggcatcatgtcatgtgtgattatgagcatcctgatacatttactatctgcttttgtagcttgttgtggaatgacaaaattaaaccttgccacatttgaatatatctccatgtactgttccgtctttcgctggatatgagaggaggtgctctcatatcggaatttattaagaggggagtgaggctcgaacctgggtcggctagcccacaacttgtggtgctagccagaagacccccacgcctttctcactgttccgtctttcaggtttcagctgcacaaattatgtggtggatgccattttctgtgaatcgttttgctatgctggcagttctattcattcatctttgaagtgagcatgaatctttgttgtacacaccccgatcctttattcctcttgtaccgctcattgtattatgtgtttgccttctaaattgttgaattttctgtgtatcaaaatgtgatttttttcctcaaagtttaataggaaaaaacttgttcctgatataaaccatctggctactatcacagtataacaacacaatgatagttcaaagtttgagtcactttcttcctgccttgtcaatattgatttgccgtgctataaagctagacataatgcgtttctcttgcatcttcacttttgttttttgcatcttcttgttgcgtcttgcgtggcgaagaagttcattaactgctatctgagaagccatacaggttcatgcacatctgctagttctcatgaactataatcttgacgtcatcagtagctaaattcacggtatgaaattagggactacctatctaacgttcgacataaaatccccccaaaaatatgccgtaactacaacacaataatagtgtaattgctgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctgctgcttgattgactgccagctaacgaggcactcgccgaggaagaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgacgagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgctgcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcaaagtggaggtgcccgaagcgctcgtgccactgccacgcctcgtcgtcccgacgagcggcgaggcaaactggatgtgcgacttgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccgactcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgtttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttttgctgcggcgagctcggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttttggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaaggcaccacaagaccaagaccaaccagccaagacttattcctacaattgcaacgtaaccagcatgtaattacaatataactagggtgtaagtggtatgtaaatacaccatagctcagtggggaagtgcgcacgcatgatatccttgcgcctggggttcgatacccagcagctacagcatgcggaattttttcccccttcctagcacgaatctcagagcacatcgtacgaccccaaaactgacagatttgtccaaaaaaatatgtcgaaagttattttgcgattccgatgaaattattataattaatacctgacatcattttgctatgcaggaagagttccaacttgcattgtttaaaaacaaaaggaaggaaaatcttttcgctaatcgggtatccatctccttatcaaccattctcacttaggttctgttagtaaatattctgagtgctttcaggcacaaccttattctatcacttgaaatttacacagaatggaccttgcagatatttgacctttttgatgtgaagaaaaggggggtcatcgactttggtgactttgttcgagctttaaatgtatttcatccaaacatcccaatggaagagaaaattgattgtaagttattgccattctgttttatctcaacttcgttgataccataatttcacttcctaaatgattgaccccttggacagtttccttcaagctatatgatatggacaacactgggtttattgaacgaaaggaggtaatgtcttactatttctgggcctatgattctgcatatgccaactgttttctgattcggaatttaataaaatggttatgccaaagatatgtattggtggtaatccagtggtttgtaagcaaacttctttacctctgaagtaacatatttacgacatgctttaacatacatcctattgttcgttggtaactaaaatttctattcttattctcttgtacaggtaaaacagatgttgattgctcttctaggtgaatcagaaatgagattatctgatgagattattgagacaatccttgacaaggtttggacatttgattaaaaaaatgtagttaaaatgtacgtaattctggtgtcttatgacagagttaagacttacaatgacttatgtggttaatggcagacgttttcagatgctgatactaatcaggatgggagaatagatagaacagagtgggagaattttgtctcaaggaatccctctttattgaagataatgactcttccgtacctcaagtgagtataacagagaatagaaatatggacacattttactgctactatgtttatcttccatgctctaagaaattagtggtgctgttccaatttccaaagcttaggcctatgccatctaagaaaagataagatagactgaacttttgtaagctacgacactcacacctcaagtgagtattgcagagaatacttatatggaagcggtttactgctactatctttatctcccatattcaaagaagttaatggtgtcattctaatttccaaagcttgactgaggtctgtgccatctaagataagatagacaaatgaactttcgcgatctatgactctttcgttcctcaagcgagtatgacagaaaatagaaatatgtatgtgttttactgctgctatgtttatctccaatactatagaaattattggtgccactccgattaccaaagactttagcctatgctagctaaaaaaagataagatagacaaagaactttcacaatctaggcatgtgtggaattagaggagggttgggtggggcgtaaattgggtaaggtatgcataattcatcaacttctaaatgtgactcatgttaaatagtgctatatagttgccatgagacatttatttatcgcagtaataaattgtttgacctatatttctatttcagtcatctaaaacttgcaaaaagagatcaactatgtaaatctctgtagatatttggtttcagtgtggtagattgctagactacttacaaacattcttgcactttccatgaacatttgacatgctgcagataacatcatttctaaacattgttgcttgcatttttcagggacataacaaccacatttcccagttttgtattcaattctgaggttgatgatctcgtcacatgatcgtgtttctgttaccggtgtacagttaacaaaaacaaaaggagttgatttatgagtgaaagaggcagaacattcgcaggtgctattatcatacaaggaatataattgcgcagcagcttggaagcgtataacttcattgatgatgtcgtcgcacaggatattagcgttgttgttttagtgttgttgattagattcggaatgtaacatttgtatgtttgggtttgcagttttcaggtctttgccaactataacatcttatccttgtccccgtagagatatacagtatttacctagttttccaaacatgagtggaaaatcttctgtctatctggaaccaccctttgtgttgttctgtatagtactgtctcttttttgttttaaccatgatgatggcttctcgtagagtgttgcggaaagttaaaaaagggggaaaaggtaaaaaaaatgcatggtagttgggctttcttggcccatgaagcaaagtatgtgggcctaacctgagcccagcaggagcagccgacaccgaccgggaggaaatcccgaaaacacccccggcctccacgacagaaagaggcggggttaaaaatatctgcgccgagttggggcgtcatttttgcgggaaacccccgggctcttttcgtaattacagcggccgcccacccacctcacgcacgcacacgggctccctctctcgctctcgctgtcctcctcttccccgcctcgtcaccactccgatctcttcacctcgatcctgcgccaaaccctagccccgcccgcgagcgccgccctcgccggctcgccctcagggggttgcgagagagcggaggctgtggcaggggcgcgccgccgtaggtagggtatgagcggcgcgtacagggatcgggggttcggcggcgcggcggcggagatggaccggaagcgcatcaaggacgtgctcgagaagcacctggacaggtcgtccccgtccacatccaggggggcggcggtggccaaggagagggaccgcctcgccgccgcaggggggaagctgcccgcgccgctcggcaaggccgggaaggtctccgatggtggtaaggatctggtggtttgtttgttccgcgcgaggggttgtgtgctgtttgttttgacggtggttggggttggtggcgtctggtgctacattgcctcaggtctttgcctgctttggttagatgatgatgcagcttctgtttgtttctcgggtagaatcttagggtgaaatttggtgcgctgtcgtgataacgtaggcttctgtatactttctccgatggatgaaatgggatgtaagagtctggatgttcaccgcattaactggagctgaagtaagcgaagttctacatttctgtttgaacttcacgtgaataccatcccacgtactgcattaattgatgttatgacttaaatatgttcacgaaacatcggttagttctaaacaatgttttaaaaagcggtatgtagttttgtgcggtcaccccatattgtagcacttatgcggcatagtcagacgcttatgcggtataatcgaccacttgtacggctaagcggtacaaggttggggcacctgttccttgtatgtggcgaccttctttttagatgctggttctagaagcagtaacaattactaaataaataaacgtgcactggaagtttatgagaagccggtcaaagtagggtcttaatgcagtcaaagcatgcaatggtgaaagaatcagatgacagaagctacaataaacgtaggcaagtatgggttagggcaccttatgatatagaattcttaggcaagttggtttttgcgaggcattagggtaactggccacatggaatggaattttggactggtagttattctaccatggcagtggctgtttaattaggtatgcatgagacacaattagagcaatgtatttttgttgcagtggcaattaatgcgatgagttaaagaggtagcgaagagtttgagacgcgtgaatgccattttgcatacagtcgtcttaacaggataatattgaatttatcgaatgtttagcagccccctttatatgttgatgtactgtaacataggactgaactggcaacggcatccatatgtagccctaacaaatctcagaagagaaaactaacatgtccaattgaaggaccttctatatgagatgacccaatgtcttgaatagtttcagtcatattgtattgtttgtttgtctttggggccagtggagatctgaagaatttctctatctgtgagactaacatgatattgaaggcaaagagcaattgctaaaagcattaacatgatgtcatgatgttatattagtgccttgataggttactgctttatgaggaactcgtttggcatgaaaaatcctccatttgcttccttactttattggtttttgtctctgtagaacatttattttgctttcagatgtcaattactctattggaattttgggcatgtcattagctgtaatatatacagtgttgaaataactttcagctgtgtagtgacaaatgataaaaactcgacccaaggggagagacatcccgaaggcattacacttaaggtcgaagaaaaggccctgaaagccggctcttgcttgtacaagggctccattgccacaagccgtatcttaacccatactttagggaccacacaccgagggtccttttgtttgtgagaaccagggttgaaaccctggttgacaacttcacaactggaggacttgctgccgtgctataagcatgttctcaaaaacttgaccaacctagggggaactaggtgccttttttatttaagaagaaataggcacctgaattcgcttcgatgaggacttgaacttgggcggtctgggcatcaatgtcctcgaccaactgataatgtctttatacatttcacagctcatgttgaaccaaaaaaggggcataattgcaagcttacagttatatctgtagccagtgggcagcggtaattaattgtagtttttgagtgatcagtttccataataagaaccgggaggaaccaaatgtgatggcatagcacttggggagttggggtataggcagcattgattgatctcaactcttttgtttccatttgtgtcatacattccagtttgaccgatgtttgcacgtgtagagccgtcatgatctgatcacacaggaagactctctttttgtttgaattgaaaagggaactattccagtgcctccactgatgactcactgaacatgctgcttcactttgaccattttgtttgtcaatttcgcttgatatgcaaccagggcggtaacacacctattgtgtggttgatgtgaacagaaactggtacatcataatagcaccaaaagaagaggatagattgcacaatagataagtagagcaccagcaagcagaagattgaacctaggactagcatcttagtactccaacaacaccttctttaatgagttatgaaggagggggtaggaggttactttgacttggaaaccatagaaactcttggggatgttatatcaaactacactgaacttagttttacagtgatatgaatgtttgtgcagtgatatgaatgtttctttaatttctctgtgcatcgatatgaatgtttgtggtttttcaatctgtaagaaaactgcttgcttttattatacacttgaaattcataatattgtttggcagggtattacttgtgactattgctttactgcagtaactgcaattattaatatgtaattttttaatcatcattaggtgcctctaatcccttttttcttttgggtgcagcagaagaatttgaaactgacagtgaagattcagatgtcagtggttctgagggagaggacacatcttggatttcatggttctgcagtttgcgcggcaatgagttcttctgtgagatcgatgatgattatatacaggatgatttcaacctttgtggtctgagcaatcaggtgccatattatgactatgcacttgatcttatcttagacatcgagtcttctaatggtgagattatttttctcttaagaaag

SEQ ID NO: 23894 - DNA, 4402 bp, Oryza sativa
  unsure (1)..(4402): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagcgacttcactgatatgtgggccccttccctactgtaggtcccgcgccacgtcagctctcgacggcgctcctcctccaacttccaagtcgccggagcggcagttgggccagttggcctgggcccacttcaccccaaccgaaagccccccatcaaactgacatgtggggcccacccaaagcctactatctccgcgactaccggactggcagttgggccagttggcccgggcccacttcaccaccacccgaaagccacccatcacactgacatgtgggcccccacgaagtcacgccgcctccgtcttctacctccgcctcgtcgtcacaagtcacaagcacaagaggcgaaagcgcggcgccgtcgcggagaggagaggagggcgacgagggggaggcgattcccaaaccctagctaccctcaccgccgccgccgccagcagcgatgatggcctacgcgctgcgcggtgccgccctcgtcggcgtcctcctcctcgtcgtggcctccccggcgctcgtcccggtggcctccgccgtgcccttcatcgtcctgcacggttagggtttttttttttctctcgcttgtttgcccccctaggttttgtgctctgctggtgcttggatttcgtctgaggttttgctggtcgtgtgtacttgtctgtgtccgggcgcacgcagggatcggcgaccagtgcgagaacggtgggatggcgtccttcaccgaaatgcttggggaatggtccggctccaagggatactgcatgtaatggcgccttatctccccccatctctctctcccttgtgttctggaagtggagactgttcgagctgtgatatttgtgaattgtgatgttgccttttgttatgacgagaaattagttgctgtttcaagtgcaatactagtgctctggtttccattaatatatatgtacaggctattaattaattatttctttgtttttccatgtgaaattgttaatgcgaataaatatagatgcccaaattagatatggtagccttaattatatatccttggggttggggaggtttaaaaaggaatagattgaaatactccacacatatttagcaaatcacgaggataatgaagtatgatgagacgattactgtcaagttccatttgttaacttgtccctgcaattttgtgaggaggatctgggagtaacatatacagttttatacatttgcaaagtcaaccacagtttctgttatggtatgtacacccaatgtgtgatctcacaaccaaaccaattgatgtcccaacttcttttttgagagtttagcccatgctgcatttgtttcagtcaaccacaataactgtttctgttgttggatgcctggagattttatcgcgacattcacctctttcttacacgtttgggtattcacgtaatctgttgtttcagtatcttatttttcgtaccttaccatcctgctctctatttttagttaaatgtcaactgttgtatgaagccaagtttgggcaattcaatacatcttagaagtctcctgactttatgccatgttgaggaactaatatgttgtctgttccaattgcttttacattacttagtatggccttcctggctgttggaagtgaatttaacctgtcgcagtccatagtggggataatgaagattctgatatgcttcataattttgtatttgttcctgtggaatgggccttaacaaaatatgcagaaacaactattgttgaaaaattcatctagtattatggtatgtacaccctagtgggtgaccttacaaccaattgatgccacaactttgtttcttgagatgtgttacatcatatatcagtacaaattttaaaaagtttggcacatgctgcatttgtttgctagtttacttatggagattaaatgtattcctcctcagtgaaattggaagaggagcatgggactcttggctgatgccacttcaagagcaggttgatttcttgcccttgataatttcctttttttaaaaaaaaaatcaaatagactgttcttgtacaagtttctgagattatgtattcatctacaggcagacactgtttgcaagaaggtgattcagaacctccatcacttctatttatgtactgtatgctgaattctcaaggtactatatcattgctggaattgattttccaggtgaagaaaatgaaagaactccgtaaaggttacagcatagttggcctttctcaggtgtgttcatgctattatgctattttatgttcatgacaatagctttattgtaacatgcagatctgttctttgcttcttgtacctctatgcattgctgttcttttgttatgtcttcttttagtcctaagcctatttgatcagtcttggttaacccaaaaccaaaaaataataataaaataaaaataaaaataaatcaaacgaggcctgtgtggaaaaaaaaaaagtgattttcctctctttgtgctgctgccgaacgcaaccttaggcctgtgcggacatgtctcgcttttgttctatgtggacctcttgagtataaaacgtaggagtgtgctatgtgacccttcgatagatttttatttgggttattgacttagtgggagttttgttttcaatgccatgtatttcactagagaatcaccttattgtttcttgttgcatgtcaaaatttccctcatatgtaccctttttgttaccttttacaggggaacttaattggtcgggcagtaattgagtactgcgatggtggaccaccggtaggtgaatctagttcgcttcctgatgttacaataataatatattttatatggtttgttattaacataacaacaccaaggtgagaaatttgatgtacttgtggtttaccatatgcgtcccaacctttcttgatccaaatgatgccttggacctctcttatgtacagttatagtttatttgctgactgtaacaggtaaagaatttcatctcgattggtggtcctcatgctggtacggcatcagtaccactttgcggtgtaagctcactctatcctcccctggtctccttcttttgcatatgcgtatagaccagtatttaagagtagactgcttggtatgaatgactgaaggtttttcatgcatataaatttacacactcttaatgtttagtagccaatggttactaataagcaacaggtagctatttgtagaatgacctatagttaaaacattactccctctggtttaagatatatgttattttagctctatccaacactgaaaaaaaactaggaaaagctaatgtcatagatcttgacatagagcaaggaacgctaatgtgagggggaaaaagttatataaaaaagaagttttttcccaaagaaatctttgctagaatggcataaaaaaatggaccggagacacttattgatagaacatgaatatgtcatataacataaaattttcggggatgatctgtagcattggccaaaacatgttggatgcagtttatgcttgctaaccatccatttgcacagctatcttgactcactggagaaaaacagcaatgcattacaagtgaatagtgataacttctttcaatttgccagatttcaagggagggagaaagcatgctttgagtcctgtatgaatatgtttttgttcgtttctttgttaacctagatcactaattgactgtaatttcaaacagattgaggttgtatgttaatttgtaaattagcatgaggccttgagactgctcccttacttttgtgcattcatatgaatgagcatgcctccaagttttccgtggggtttacttcatgcaatgttttctctagtatctgaataatgtagtttctggtaaactcatcttctgtcatttatagctgcactaggaacttcaattctcaggctagtgacgttgctatctaacagttaaacaagtactgttgcgctactaaccctttcttcttttttttgcagtctggcatcgtttgtgttcttattgatgctctgattaaattggagatatattcaaactatgtacaggtgtttatgacttgtctttttttgccatgtcttaattggtagtatcactgttaggcattacacacatcatttctctttaagtaacttgaaattggtggtattgcaggcacaccttg

SEQ ID NO: 23895 - DNA, 6285 bp, Oryza sativa
cccggcacgcaaaacgaagctcgtattattgcatgattaattaagtattaacttttttttttgaaaaatagattaatatgtttttttaaaacaactttcatatagaaagtttttgcatgaatcacaccatttagcagtttgaaaaacgtgcgcgcggaaaacgagagaggtgggttgggaaaatgggggaaggacacagcctagtgttttaactaactcagaattcttattggcttgtatggctgtacattggtatctaatgtgcaatagaaggttgagtcccaatatattcattaacgtgcatggttatcctgcatgggctattcattagtacaggttcttgtggactgcaaatctgtctgtaacaagatacaacttacagctgtaaaaataccactgtaccagttaattaactactcaatatatgtaaccattaactgtgaagcccattttgacctttccaccttgtttcaggataaaactgagctattttgatttacatgcatgaacaaaccttttagttagtttaacccatcttcttaattctccaggatatgacagattatttgaagggttgcaagtttcttccaaagcttaacaatgagataccaagtgaaagaaatgctacgtataaacaaagattcagcagcctggaaaatctagtattgattatggtaagatgaacacgtaattgttgctatttgacatactctgggttgggtacttgtatgtggtgtagatggaatatgctgtgtgcagtccttgttaactttatatatatagcattatgcattcaaacgatcatatcgaacaagataatgaattaaaagttgttctacacaaaaacaaaagaaaacaaatagaacatctatttattttttgaaggcacaatacatctatttatgatcgcgatgtgtaaaacaatatgcttttagtaagctacataaaccttttagttcattaagtcacacatgcattttgtctcgtgttttgtataaatgttgttgatttatataatcttactgaactcaaatgccatttatgcatgcccaaagcaaatggatttaagttgcaacacattcagcttagtttttgtatctcaaatagctgatttttaagataaaggattacaagaaacatgaaaccatactggaccaatccatctgctgatacccttttgaactgctaaacagtttgaggacgacgcagtgttaataccccgggaaacggcatggttcgggtactatcccgatggcgccttcagtccagtgcagccacctcaaaaggtatatgtatatcttgagttgttgtacagaagacatagcatgctttttgttttaaactactgttatttaggggtgtgtattaagtaaggccatttttgtgtgatagacaaagttgtacacggaggactggatcggcttgaaggctttggaggaggctgggcgtgttaagttcgtatcagtgccaggaggtcacctgagcatctccagaagtgacacgaagaagtacatagtgccatacttgaaaccggacggatcatccaggttcggcattcgtcgcatcttgtcggattgattcacgagaagaaggcgttccgagtgaccagttctaacgtcacatggacatggattgtatgtaagctctgaattgtggacttaattgttgatgccatgtaaataccttggtaaaggtaatggggtaatggaatacgtcgtgtactgtagggcaggtggttagcgtacctgaactgcagaactggcgatgctagaattgtgctgcctattagcaaaacgcaattgtgggcttttatgtagcagacctcactaggaaaaagtccaattcgacaatctcgtatatagttcggatttaattcaacaacagaaacagctataatgattcctccagttaggcttcctccaatggtgccttgtaagctatctcataacatgtccacatcatcatgtatcctatgtggaggaaagagaaggcaaaaaatcaatccatctatctcctattcccacgcctatctcgctcagttaccgatgccgtatgagcctgtgcaagagatagcagtcgactcttccacaccaaaatcagatctcgtgctcccttcccccaaatcgccccgccgcacctcccgcccacccccgcacgctgcaccccgttcccgcacgatcccgcgcgctgcaattcgctcccccaccccctggcgcgccaatttgctctcccccgcgcaaatcctccagccacccgcgcgccaatccttcccttgcaccctccctcctcttttcttctccagtgtgtgaaatcttcctcggcggcgtcgacgtatccgtttccacgagcacaacgacgaatccactcctcttgccaatgacgacgagctgtagagcaggatgagctgccggtccaaacgacaagtagctccgcggccgccgccaccgtcgtcgtcgccgccgccgccgccgccgtcgggatctacgactgcctctgggtgcttcgatgctgcctcgtctgccttctttcaggccagtactgcaatggctcctcctctaggaggccaaccaggtactgtaccgtacactcaaacctgatggggattgcagtggctctgccttgcttgcctcctggatgttagagtagaacaataagctgatgatgctctcaacgatgtgcagggttgtgggacggatctttgccacacaccaactcctttgaccctgcatcctcagattggtaagaaacccatttgcttgtgtgttgtttctgcaagaaacaagcaaattcctttttgttgagactatttagattgtagaattaataatgttttagcacagataggaaatgtgttgttttttcctcgctcatagtcatgattttggctcctgatatttcagtggtatggatatacatccacctggtggtttcctaagcatgttacaaagtggtcaacagccattagtcccacctcatgttttgttcccagcaacatggccacctatgccacctatggcaccaacaactaattcaggcactatcatcaacttagatgatggtgacgatgttaggactgctaagcgtcttacatgggcatcagatgaggacttgcggttggtgagtaaaattttagacaacttgcagggatttggaccatcattctgaaactttactaacacataatgctaaatgtaggtgagtgcatggctgtaccactctaatgatccgatcaatggaaatggcaagaagaatgagagctactagggagatgtagttgaattatacaacagcactacacctattaaccggaaaagggaagtaaagcatctcaaagatcgatggcaaaggattaagagatgggtgggatttttctgcgcctcctggaagaaggctgcattagtttatactagtggatattcagatgatcagttgagagactttgctaatcagttttatgtggatgactatcctaacgaaggtccattcacagttttgcactgttggaaggttcttcgtgatgaacccaagtggcatgctgttttggaggagcttgaaaagccacacaagcggagcttggatgatggaagtgacacactatcacaaaaagatatcggagaaaaggagcgcccaatggggaggaatgaagctaagaaacaacgcaatggcaaaggcaaaggcaaaggcaaggatgatgatgacagtttacatgaagatatgaagaagtacatggatgttcaagctgcagctagcaaacgacatgaagagtttttagggactcagcaccgtatttcagatgcaaaagttgaagtagcaaggcttaggagagaggctgtcttgacggaatcatatcaaaaattgatgagcatggacactagtcaaatgactgatgagataagctgagcacgtgatgggtctcaagatgttgagggagaaactgcttggtgatataatctaaggtattttctgtcaatcaccatgcactttattgttagtcaatgttcaacaaatgaccatgtattgtaatatgtattcttagtcaatgtaccacaaataaccatgcattgtaatctgtattattagtcaatgtaccacaaataaccataaattataatctgtattcttagtcaatgtaccacaaattaatctgtaccatgtgactatatattgctctgttatattcagtctagcaaaacaatccagcactgtcctcctctgttccttctatccagtactattcttcctattctattctgcctcatttgttccttccatccagtccaacacttcctcatctgttccttccatccagtaaaacatgtcggatgagtttgacaattccatagacccagccgagatttacactacagatatgttcatggcagagcatagtgtccttaactcttttgccgggcggatcgacagaaggattaaggccagactagaaggaggtacatctaggcgtacaagtggtccaaggaagtacatcaataggaaccatgaaggagcccatgatcaactatttgctgattattttgctgaagatcctctctactctgctgcaacattccgtagaaggttccggatgagaaggcatgtgttcctacacattgtggatgaactaggcaagtggtcttcctattttacacatagagtagattgtactggatgccttgggcactcaccattgcagaagtgcactgcagcgatccgtatgcttgcatatgggactgctgctgacactcttgatgagtacttgaaggttccccagagtactgctctagagtgcttagaaaattttgtggaaggtgtcgtcgaggtatttagtagtaggtacctgcgtcgtcccacggctgaggatctcgagcgtttgctccaagttggagagtctcgtggattccctgggatgttgggaagcattgactgcatgcactggcgatggaaaaattgcccaaccgcatggaagggacaatatacccgaggtgaccaaaagtatccaactattatccttgaggctgtagcttcatatgaccttcatatttggcatgcattctttggtattcctgggtccaacaatgacattaatgtgctcaatcagtcccctctgtttattgaagcaataaaaggtgaagctccccaaatccaatttattgtcaatgggacacaatacaacacgggatattatcttgctgatggaatttatccggaatgggcagcctttgtaaagtctataagatctcctcaactagagaagcacaagctgtttgcaagggaacaagaagggaaacggaaagatattgagcgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaagaaatgcttctatccgagccaaaccaatccatagccagcttaaaaatgacttaattgagcatatttggcaacggtttcaaactaggcaaaataattcagtataatgtaagctctagtgtacaatttcattgtaattttatcttagactgactgtatttatcactttcacttactgtacatgtttttctctctaccaggggcgaacagattcgatgtcttttacttgtttttgtggctgcggtccagcttttggtgatcttgttcaaggaatgggataagcacttctggttgctgtccagcttttggtggttgtcgaactcttctatcacttctgtgacgtgatgcagtcttttttttcccttcagtttgctcttttccgcattgtactaaagtgccatgatatggctatgatgttatctagttactgttgtggaccgtgagttggaagaattgcacttcattgttatatactctaagtcgacgttgtgctatttatctatattcacactatgctgagatgttcatttttaatcgacagatctttgaatagcatcacatgaaggaccatagagatattgtgtagtttatcaccatgtcatttactacccatgctgccataaaagcaagaagagataaccttagagagttcattagagaaactatctcttgttctatctcttagatgtgtacgatttatgagctagcagttgtctcaacctttgaaggaggccttactaaa

SEQ ID NO: 23896 - DNA, 1387 bp, Oryza sativa
tctcatgccggcactgctgtttctgcctcctccgttgtccttgttgcgtcaccgtccattgcgaagaacgccagctttggtgtgtgccccgttgatgtgcatgcatgtgtggttctcagagtacgacaaaccgagtacgcgtgctaggccgagatggcgacgatggagccgaagaggatcccgacgaacgatgcatggagaacccccccccccaccccttccggagggggggggtgggggttcctgtcaatcgtcgacgcatgtacgtactccatgccgaggccggggaatgcagaagagatcgtaggtgtcgagtgaagaaccccatgccgaagaagaagacgatgttgggtttgatggcaccacagactgtcgacgaagggaccgatcaaggtgatgtcaatggaaggtttgcacggcgggaaaaaaacacgccggcagcgatggtgcctgccatctccggcgacgcccaccaccgttgccctctcctcgcacagtatcttgtgtggcgccgctgacgtacggtagagagtagtacaactacctttgttggtaaaaagaactacgaggcatgcatgttcccgtgcgtccgcgcttctcaaactgttaaacggtatatcttttacagcaattttctgtagaaaaattgctttaaaaatcatactaactcatttttcttgctttaaaaatcacacttaattaatcgtgcagctccatttttcttgctggaggtgagggttcccatccctcacccaagtactccactaagcaccagttttcactgtacaccttgcaaattccagaaacataaactttatatagtaatcagtacatttacaaagttacagcgcaggtggagcagcctagtctggcaccaccacacctcattaatcaacaaataaacttactgtataccgcatgaaggtcctgaattcccatcgccggtgacatttcaaagttacttttacacaccaaatgaataaaagaaaattgcacacgccccccacgtcgcaaacaaaaaaggcaagaaaaactactctatgggttcccctcatggagaggcatgaagcgactccccaaccctcccgattgcctcgttcatgtttactcagctcacagctctctttaggtgattctacctacatcccgaaacaaacagcctgcacatgccgagtggtaatgtgacacaagctttgaaagccaaaacattaccttgggccgcaattttgcgatgttttgaacaggctgagaaggctgctgaagaaatgccttgttggaagattagcataagctccactgctgtgctttcatgttgaagtccctgtctgatggtgttccaaatttctgaggacaattcttgcaaagactttggcttcgatagaagcgg

SEQ ID NO: 23897 - DNA, 294 bp, Oryza sativa
ttttttaaaggagccatttgcaatgacctatttataaacattccacagttcaaagtctgaaacatgtattgtatacacatacacccttctaagtcagaccatttgtatacaggtgatgtgttcactgaggagcaaaatgaattaattgagtcatctcagagatgctgtatggattaattcatgcaagatatatcttaaccagcaagggtctggctgcaatggtaatctgctagcagtttgaccatatttgataggctatgcttgcttccttgactacttgaatactaaattatt

SEQ ID NO: 23898 - DNA, 1131 bp, Oryza sativa
aagtattagcagatgtaagtatagattgattaaggtgagagagcaactagcaattttgttctctccaacatccactttaaaataatatactccatgtatgccacatttcatttgatggtatcacccaacaacagtgtttctttgccatggtcaattcaaagcacagctttcaactgtcagaacatgtgtagggctgcccgggaaaatgaagaatgaggtaataactaacaaagggttgtccagggaactagaaaatgaggcaacacagagaagcaaagatgttcggaggtgatggcctgtggctaaagaacctgattcagagtggcattcggctaaacgaaatgttaggaccagcactcatctaaacgtcaattttgagttggcaccaacaaaatttaagaatgcaatcattaagatcagaataccacgggcaacatcaggaaaatccagttgctttgaagtctatataacaagtactgtattatatttctttaaggaatgacaaccatgtcatcataaaattgcatctcagaaacctaagcaaaaaaagttcatcacaagcaccaggtgaatgcacatatgcattacaggtgaattatgattaaaagcagagtaaagcatgtgtcaatttcagtatggtgttagtctcctatcaaataaatgaaaaaacgacaatcaaattaagttggatgtaccggtttaattgaactccactcagtgagttcgtatgttgacctcttaaaatcatcttttctcaaagatgtacagatcatatggccaattggccattgttcatttttgcaaaataaggtcatgcaaagtttactgtgtctacccctaatcccttatgcccccagttcatgatacatgcaacacagattacaaatccagttcaagagaacagaaaagtgcaaccttccatgtgagaagagatgaccatccctcaaagtcagcctgatcccacaaatgtgcaagatctgaactgtttttggcgctatcattatcttgaaaaatcttgaaaatttccattaacctatgataacgtgctggagagaaatgaaaacccagggatggaacccgtactgcctttcttgtaaaagggtatagggcactttctaactggatctgaac

SEQ ID NO: 23899 - DNA, 609 bp, Oryza sativa
ttgcttgacaaaaaacgtgtagtgcataggccattgctgatgtgcaatattatcttaataagaaatttgcaaagtctaaaactgaattttctcaaatgacagaatggatgaggttgcattggttgggacgtcatcagagggcagttccaagagtgttaatgttgagggagctaggagaatggctttgaagcatatacagacttttgttctgacattttcggacccacaagttttcactacggcttccacctcctcagcctcagcagcactatctcagattgctgatgcagtgtttatacaagaagctggacacctgagatgcaggtttggctttattctttcactaaagttttactattcctgaagtttagctggctattctttaggcagagcatgtggaacattttaaaccggattcatgcttgtcccgttcatcttattttggacctgtcttggtagcaatgtagctaagaggaatgtagtactaatatagtcctttacttcccttcagtggtgccgagatcgctagatttgttgccatgctccggaatcctgcatcaattcttcgcgcttgtgctgcctttgcccttcttcaggtttgtttccttc

SEQ ID NO: 23900 - DNA, 2231 bp, Oryza sativa
  unsure (1)..(2231): unsure at all n locations
aaaaggtgagcattttatactaggaaccctactaggctcatggcctagtgctattgaagcccgagctagaaaaaggaacagcgacacggcctctcaggtccaataccaggggaagcaggaaaggcccaaagtggcccacttatcgaagagaacctactaagctcaggcagggcccagtataacttgatccatgtagatttctccatgtacgatttttctagatgaattttgtatgtaccttcttctggaatacatgatctgcttgtagagtttatcgccaacaaatcgtgcaatcttttcgctgaaagaagctcgtattgtactagcagaggagtagaagttagtaagcaggaactatatgtctaatgatcctgcaagttttctttgttggagtgaaacgactttgtaaagccaggctgatttttataaggttcttcagagaaaaggggaaaaaggaagcctaggtctatgctgttttttgactgaatgttgtggtatgagaaagaaaaggtcgtcttgggcaacacaacacgcacgcaggctaaaagtgtctcattgtctgaactctgaataacctgngcaacacaacacacacacgcacgcacgcaggctaacctgaagaaaagaacaagcccacagtctgttgttctcgagtgaatatattatttttaatacaatgttttattgagtgaatgttaagcaatcgttttcctagatgtccagactcttctgatagtgttcttcgaccaagcaaagaacaatacctagcatcttttttcccttatgctctcatctttgttattaggttggtgatgtatccacctccccggttgttcagcgaaaaaccgtgatgtctccgttaaggcaccggagcaaaaatcattaaaaaaaaactcacttttgattagtacacccttccaattttctgggcaagaaagcaggaacccaatcaagtgggggttcactgattttagcacactgttccccaatctctgcagtaatcaagcttgttactgtctgaagactgaatcggtgaaactctgaatattccaactcagtcagccagtctgcaaacaaaatactacctaatcagagcccgaccactgattgctactactaacatgcattactactttgtcaaatctatatttttttaggctccaacaccaacataataatatgacaaaaatatttctttcttttaaaaaagatcatcaagggaaacaaaataaagaaaggctatatgtaaagtttttcttatgaaattcttattatacacgctcatatggcatgctgcgagtaaatcattattgtctgtaagttaaatcaaacgattaagactttagtaagatttttttaaggtgtgtaaataaaaaattgaaacaaacagctgggctagcatgcgccagaagaggatgttggtgtcttggtggactcggccgaacatttgggaagaaccaaccacaccaccatggtccatggcaccatgaggtcggtggcgatcgcaacaaaaaattccacggaaaaactagtggaaacggccccgttttttttttttttttttctgcaaatacggcgacgaaggctccatagtttggtcaaataccgataatacgccgtataatgtataacgtaataaaaaatatggataaatcttttatacatataatccctccgtttctaaatatttaacgccattgactttttagcagatgtttgaccgttcgttttattcaaaaacttttgtgaaatatgtaaaactatatgtatacataaaagtatatttaacaatgaatcaaatgataggaaaagaactaatgattacttaaattttttttaataagacgaatggttaaacatatttttaaaaagtcaacagcgtcaaatatttagaaacgcagggagtacgttattagtgacttgaatactaatttaaaagaataacttcaatgaaaaaaactttaaaattcctcacaaaataattaactttaaaattaaattttagcagcagctgatgaggaaaagatggggccgaacggcccgcatatttgcaaacgagaagtaatttatgaataaaacttttgtgacttaaaattattgactgaaaaataaattttgataaaaaaaacccctcaaaatcagcttaaaaatttaaaatttggcgatatgcagccggaattcttttcgtattcgcagcgcaggcgacgcgccggtcgtctcccggaagtgcg

SEQ ID NO: 23901 - DNA, 29069 bp, Oryza sativa
cagggcgtccatgctcttcctcatggcggcctccaagggcctcctcctctacggggggctcctccgggtgttccccaactcggcgctgctccgccgcctcctcgaccgccgcctcgtcgccctcgtcttcgtcgcgctcgtcctcgccgacctcgccgccgccggcgccatcgccaacctcctcgccgcgctcgccgtcggcgtcccggtcatcgtgctccacgcctccttccgcgtccgcgacgacctggaggggccctcgctgccgtccccggcggcggagaacggcgaggaggagacggcggccgtggtggagaagaaggaggacggcgacgtcgaggcagggccgacgcggcggtccatggcggcggcgccaagatcgccgaagtgacaaacacttctacttactacgagctatagctaattgatcatacgattcaacaggtaattggccagatctgcctggctgttcttgataaagtcaatcttggcatagaattttttgaaaaaaaaaagagagagaaaaaaaatcatccgtagaatgtatagatagtgagagagactcaactcgatctgagaaaaggaattgagaggtttcttggtaaggcattcattcttctgtagcaatagaggattgaccaatattgagttcttgatcaaatacctaatacatttgcaagaaatgactagagaatactctgtgttttggccactgaatctgatgatctctgaaattactgaagaatcaagtcgttgctgcattcattcaagttcagaaattattcatggtcctgcaatgccgtactacctccaagaagtttgttggttttatacccttttttctctccatttcttcgagaagaatgtggaagtgtagttgccatttgccaatcgtaccatgcgaccgtgagagacgagcgcacctaactgctaacaaccaacgcaacggcaacgccaatgcttcctggaagtcgcacttgcaaggtcgcacctcctccagctccagcctccacacgccgtcgccttcgcttcaccgatgcatttgctaattggcaaaatttgccatgtgctgatgtgcctacctctctttctctttgtgccggtacacttgcaagtaaagtcagctaatgccagcaaaactattcccattgacacaaacactattgcctttttttttaaatttattttacagtggatattgttgttgcagattatgaactttattataagaacaatatatatatatatatatatatatttttgagaaataaatttaagaactaacttaaacaaattgtccaagtaaaaaaaaacttattttttcaagtatgaagtaaaccatccgtttcaataatccgactaataagctgaaaagatccgaacctaaagcctcctttggtgtcaatgaactatttcttgtgaaaatcctacgaaactccctcgttccaaattcactactagttcggaacgcagaaatttaccgaaagtaatgcaagttgaactgtcagcatatacacctcattatccggaagagaaaaaaaatcaaacaatgtacaccgggaagaatttgttaatttttctttgagatgagtgaatgaagtgattagtatagttcctactactactctctataatgtcgagtgaaatggagacaggggtgaaatggctcaggccatgaatgccgttttggaggcccacgagatctaatttgggcccaagtttgcgagtctagctagggttgggtggagatcgatgcggtgtctcacgtggttgggccggacagtgcaggaggcctatatatgggaggggcacccacggctagggtttcccttctccctcaacctacggcgccgaccacctccaaaaccagaccccgaaatctcgaggagcttgtcttttttcggtagcaatggcgttggagcagaccttcatcatgatcaagcccgacggcgtccagaggggcctcgtaagcttacctttcacttcccctcgcatcgatttggtgttggctagtgcttagcttcaatgtgtttgtcttttgcttgttttgctcagattggcgaggtcatcggccgcttcgagaagaagggattctacctcaaaggtaaccatgcccaccttgccaatgatcctgatttgtgcttgcgctgcaccgtgagaagattagattgaatctttgtgctacacaacacgatgtgccatgctatttatgtgttaaaaggatttctctctctccctctgaaactaagcatgttttgttgttgagtagcttaatttcttcgatctttcctcactccgtgggtctaattagtggcttgtttgatgatttatgcatcgattgctctgtggggagcgatgattttttttctttttgctgatatgctatctgaacatgcagccatgaagctcatcaacgtggagaagtcgttcgccgagaagcactacgccgatctgtcctccaagcccttcttcggagggctcgtggagtacatcgtctccggccccgtcgtcgccatggtctgggagggcaagcaggtcgtctccaccggccgcaagctcgtcggggccaccaaccccctggccgctgagccgggcaccatccgtggcgacttcgctgtcgacattggcaggtcaggtttcgttcattcactctgtggtttacattcatcagtgggtgataaattttaattcagttgcatcctccactgcttgctcactcttaattttgatttgctcatatgttgctgtgcgccagattcaaatgcaaattccactggagtataattagagatgcccatcacagttattctaagatgctttattttcagaaacagatgctaaaatgatttttttcctcccaagaggcatggtattaaatgcttttggagaaacacctaaacttatgtagcacatgaaggcttgtgtagttcaaaattacttatgtttctaaagtacattttggtgtgttgtttattttattgtgcaatatatagcattggtctgtcctgggagcttagttgactgactccctgttgaatagttctgtctagcttaagcatggtgagagcatctgacagggccatatgcaatgttttatgcactttgaagtaccaagtgatacactgtccaatcataccaaataattgcaaccgtgctgattcattctactactagtatcttattgattgaattttggtttatatatcactttatgggtccactgtgggacagcaccatgtgctacatggtttaccatgattaaccttgcatccaaattttccaagtctaattcgtggtccacagaaaaaatatatactttcttaatgaataagagtgcattttaccatgtgaatgtttcaatggcccaataacacttcatcatttcgaccagcaaaaacaaaaaacaatcattaggactggcatcttactatcacaatgattgccttgtactccctctattccacattgatctacatatttcataggtacaccaagaccaagaaaaactaataactctctcatactatatttactctagcaacaaactcgatgtatgcaccatccccaatatttcctagtcaatagcaaattaagatattgcatgtgggttataaatacttgtgtgcatggatacatgcatcaatgttcatttactccaatgcacaaataacgaatagacttaataagtgaacacaaatatgtagatcatttaggaataacctcagaaaaactatacgtagatcaatttggaatggagggagtatgtaaggacaagtatggtcgacagaacaccaaatggtgctctagagtccttcaaatttacctttctactagtactcatgttatccctttgagttctcatctgttcatagacctaaatatgtatccagaatccaagttctaaagatgacctcataccttgcaggaatgtcatccacggaagcgactcggtcgagaacgccaggaaggagattgctctgtggttccctgagggcatcgccgagtggaggagcaaccagcacccatggatctatgaggtctaaaatgccttgtcactatgaacctggagagttggcatctgaagatctaccgtgctatttagctgctattttatagttgagaattgagatcagcatctcaagaacctttgtctgtgcgaactgaagtttttcttcattatgttgcatgttatgcatgcatttaccagttgctcttgatatatggtattgctttaatcctttgatgtggagttgcattgcatggtgtttgaagccttatcatttgagtgctggcaacaagttgtgttgaacataacaagttcgttttcagttagtttgttctctttggtgcaactcttcgttaggaaaccaaacctgtctaagcaaacctgtctaagaggtcagtaacgtggggcatcaaccaatctagtggatcaagatacaggttatacgtaaattagtgtaactaggtcgatattggttattgccaataaattgttagctaagccttgcctaaccttcattgtgtgagcataggcaccaaccaaacattgcctggcatgctcttgcttatgtagtgaagtgctaaatcatgatttatggtctcacgaaattagttgctctgttttaaaatatatagcaagagttatagatgaagccactcgataaaatataacaacaaaatatatgttttaaaatatagcaacagttatagatgagaccactcaataaaatataacagttaattcatacttatatcttacctggtatagatagattcgtactatcacatggtaccaatgtcctgtatattttaagatggatgaggatggatggagtatttgtaaaaagatgatggtaaaaataacagttatcagcaaccataacagtagaacgtatcacaactcaaaatgctactacagtccactaccacactgcaatcatgtaactccgaacacaattgcaaaaaaaatcgctagagaaaactcaccttttttttttttggatgagaagattagaaaacttacctttttacaggtgaatttcaacatttttcgtcaatgacctcactgtagtgtctgagttctcagcgagtgactttcatcttgaattggagagcacactgcatttcctgaagtgctactggctattgccatttgaatgaattcaatcagaaaaagtggttttcttcccgcatcgaaaaggataatactatatcaagttttctaaggtggtttgtacataatcagcggcaagtatcatggtccaggttcagctcatctcttacaatcgatggattgatacaaacaaaggtaacaaaatagtattatgctgcataatttttgtctggctattatttatccttattcaagcactgttcttgtgtggcgttctggttcaaacttgcccttcacccgtagcaacggatggggtcgttgcaacccttctccgcagactgcctgaacccgaagcgaccgcctttcgcaaggtattgctggtggtactcctctgccctgtagaacctctttgcaggaagaatttcagtgacaatcgtccgattcagaagcttctgctgcttctccagagattctcttgccgccttctcctgctcaggggtgtagtagtagatacctgacctgtattgggtcccaacatcattaccctgcatacaaagagttcagagtatatgtgatcagaaacttcagttatgtcaaacagtcaaacggatgcttgaaagaaatagaatctaattgtctaggaacaagtttatctaatgcaaatcagcattggtttgttcagaaaacagaacaaaataacaggctaagttattttttttcagttagtttgttatttttggtggcactccttggtagcagtcaattgtccaccaatctaaagaatcaagatgcaagttatacataaattagtgaacacaaaatgatacatactataggcaatcgatcttgcaaaattacatagcgctgcccaagtgcaaggttatgcattacaaacactgcaagacatgctagactcagcaccactacaaaattagatgcttgtcaaaccaaccgataacaccaatatgatggtatatacttgctaacagtacccacactataacattgactgctcaagattaatatgcaggtagccacttggtattcggccctttgatgatgaaagtgcaaactgcagctgggatgctgcaaattcttgatccaatataacagaacctgattcattgggcccaatggtcccatgaacaggacaatcaacgctgagtgcccacagcctaacacaaccatgacgctatgacagtctattctctgccagtgctcaggattatgggattgtggtacttgctgtaaaccaaaactgcgtaaagaacataaggccaaagtaagctcctttggttggtgaggaactcatcaataattccggtcagccgtgacctgcaagctaattaagaaaccgcagtactgatagtcaattctatgccgcacttgtcacaggtttgagctcttactgtgcacgacagcacccacgtttctttcgtatatagagtgatttaccttactcgcgaggaattcttcttctctgtaaaaatttgcagtagaatatctgtctagtgactcctactaactgaactagtaatatcagtagcctaattcttcaattccactaaaccctcacgaaattatcgtaaatgaaatccccaattctgaacctccctgccacccactcaatcaaagaacccgaaattaagcatagagcaaggtacggtaaacgaaatcatgcgattaggtttgtgaatcgagttaatctgtggctggctgacctggcggttgggcgtggtgggatcgtggcgcgcccagaagacgtcgaggaggtcgtcgaacttgcaggcggagacgtcgtagtggacgcggacgacctcgttgtggtaggtggcgccggtgcagacgtcctcgtaggtcgggtcgtggaggttcccctggctgtatcccacctcggtgcgagtcacgccggggacgcgctggaacgcgagctccacgccccagaagcacccggcgccgaactgcgcgaactcgttcccggccgccgggcggtcctcatcggggccctgcgccagcgccgccgacgccgccgacgcccgcgggcttccccccagcccgcccagccccagcttcccgagccagctcatcgccgcgaaactcgtcctcgtcgtctgggtggtggtggtgctcggcgcgaggaagccgcggcgcgtccggtggaggagaggggcgccgccgcagccgcagccgccgcctccgcggaggcgaaaggcgaggaggagaggggacgtggaggaggtggaggcgaggagaggaggcatcgagggaggcttttcctttccgcttcggcttttgtggcggcgtggcccagaagcttcgacgcgcggttggttggtgccttggtgcctggtgtggttgcttcgcttgccttcccttctcggcctcttctccttttgcatctgttgctgcttctcgactctcgcggcggcctcgcggtttcagccacacacacaccacacagtatccatccgaaatacaaacaaattctgaattttggagcaaatccattttgaattttgaatcctgtatattggattagtgttttgaatccaacggaatattattgtttgaagggaattaaacgctgttagattatcaaggaggaggtaaacaacggggttaacggcttgtggtggttacttgtatctggttgccgttcagccggggaagtggacaacatttaggctgtgttcgcatgcaccttttcccattccctctctctcgttttccacgcacacgttttttaaattgctaaacggtgtttttttaaaaaagtttctatacgaaagttgcttaaaaaataaaattaatccatttttgaaaaaaattagctaatacttaattaatcacgcgttaatagactgctctgttttccgtacgcaggagttgggttcccatctccccccatccgaactcagccttaggggctgtttactttgatgtcattttaatccatacaattttttaataaagtaaaaaaaatgtgcatctgtttgatttcttaactttggtaaatatcctagaaatttggcaactgcatagtaatgaccaaaattgggtgcatgtacgttagcaataaagtgaacacatctaaaatagctatcttgccaaaatttggcaatattatcaaccttaccaaaattttggtattgtaaaaatttagtaagatttattttggcatcaaagtgaatagccccttagacggtggttttgtttgggtttagtatttgacaaaatcgttttggataagaaatcaggagggttatgcgcgacgcgtggtgagcaaagcgttgcaattgctgcgaaatggcatggcagatggagtacatacgagtgaatgatgttgactgatgaagcagaatgcggatggttcaatggtagaccacgtatacggttcaatggtagaccacgtataccgtgtggtacgcacgaaatgtacaccgcatatataaaaaagaagtgaacaataatgaacaaaagtggagaaaatttttttccccattcgattccaggaagcaaaatggtctactggttggtattatcagtctggacgagtctcctctgacataaagtcagagggactttgtcactgatatgtgggacccacaaaggttgggcccacacgtcagtaacccacgtccatctaactttgtcagagaagcgcgtcagtgacccacgtcccacaaaggttgggcccacacttcaatgacccacgtcccacaaaggagcgcgtcagtgacccacgtcccacaaaagttgggcccacacgtcagtgacccactatcagtctatcaacattgacaggtacatcaagtagcacatgatcatcgtgcatgaattcaacaccagtacatcacgctgccatctggagcaaacattggtacatttgacatcttacatatttttggggggtatatatagtatttacatggttacatcaacatctgagggagcaaaatagttaagactattggcacactggttaatttgctggtggaggcaatcaacttacagagttaacagtagtcggcacggtggaagaagatcgcttcgactcgtttgccttgaccgatttgtcttgaggcaaacatggcagattattagaaggggctggccttctagcaagcctgtgctgccgaattagatcatggcacggagcaaagaagtcgtgcatcagagcatcctctgatgtgatcctgcacctggggttgactgataagcacttgtctacaagatcaaacaatgagtcaggtatcgacttgaagaactccggcctgcgcgtattggctgcacaccactccctgagatccactgagcgcaacgatttggcatcgaataggtcctgaaagcaatgagaaatgttctaagaatcaccgctgtttctgtttcggcaaagctgttcaaaggttatcaacacttttggttaagcttcacagttccttgatgttcaaaggttatcaacacttaccgatgggtaggaagattcacagttgtgcagtttcgccacctcccatagtttttcgctgcctttaagctttgctatttccttgatgttcctgtatttgagaagatatatcatcagcaacaacctttaacatgttgaggaatcagagctttgcaaaatgcattagtaaactcactgttcaggatctccaccaaaaggcgatttgccaattatgaagtacaggagtgtcacccctgctgaccagacatcaaccttacaaccttgatggaaagacctaaaaagaacctgcaggtaaagacaccacataaatgcatggcccgcaaagctgaaagacaagctctcatggtttgaaagagactaaaacctctggagctcgaaatcctttagttccaacacatggaccttctcttcgatgttttccatttcctgcaagattgagatatttatatagatgaaacatctcagaggatgctgggttcagtgagaaggtataaagtttgtaacacacctttgctgttaagcatgccagaaccagcaatagcactaccacccgaacacaggggcatcggggtgagtataaagagcttctgatccacatttccgagaggagcagcaaccctcttcctttgggaaacaggtgctgtcgaagtatttttgtcaggactttgcattgcatcatgcaagaagttcattaattccttccgccctttgtagggcattggctgcttcaacctgtctaatgatgttttcgtgcttgtaggatccttggcagaggttacaccagacacatcagcagcttggataccatgcctacttttattatcattcttaggtgcactacccactgggcttctgttggatcttttcctcttggatccaaggagctgctttgaatcggcaactggttctttggcctgaaccactggggtagacttcagtgcaggctgagatatggtatccttcccacgtgagattgtctcagatttacctaaccaattaaaccaaaatatcagtcagcaacagtcttaaaacattccaaatctgaagagtttgaaatgcatttaataagaagcagaatgcattttcaaaaaataaattcgttaccacctcaaatagcctaatcattccaaaccttggactaactgttggaataatttaataatgctaacatgccaacactaagataaaatgctccaaagtggaatatttcccaggatattattagcggcatggaaattttcaagagctatattcagtacagagagcctaaaactggaagaggcaataacacagaacagataacaatcaatgcactgcaattaaccatcgaaattcaaaacaaaattcgaaacttagaaagtgaacttactgtttcgaaagaacttctggtgaaggtcctgcatggattttcagggaaaacacaaaatgttaaaattagcataaagaaaacagaaggcgagcatcagattgggagataagtatatgcactaacatttgccaagttgaagtcaataagatacccctttgccagtttacgggagaacaggaaatttccaggtttgacatctctatgcactatcccctggaaacagaaatatcagatatccaagataagctggtgacaaacgcaagttagcagttgactaaggtaacatgcatttaaccagacctgcttatgtaagcttgccagagctttgaacagacaaaacccataccaccttaaatcaaacaaacctatttcttttctcagattctgcagagataaaagaaatattcaacaaaagatggaccaatatgaatgccaataaaaggaaaaataaacatcagagacaacatgagtgtttcaacctctggtctatcgtgctcaacatgttctagaacaaagcattctagatcaccactcctaagagagcactcatatttaatcacgaaattcttgcctctgcagcagaaaaacatgatacatatgtttaaagttactgcatggaacaagaaaaatatcattataaaattttcggaggacatgaacttattagtacccaaagcgttccaacatcttctgttcattgtaaacatgatgtgaatgagcatttgcatgaggacctgttaataaaaaaaatacaggtgcagggttaactcttgtaaagatcttagccatataattatagaaagatgactgagactgtcaaaagacaaaacaacagaagatacatttatagatcaacaaatccacatgaaaaaacatcaaatcgagactagcaaagagatgtacacacattttatggcaaacagtcttccatctgattttcttcgagccctataaacagtcccgtaaccccctgagtatgcgtaaacattcacattggtcagcaatcaatataaaccaagaaagttttaacagaatatttagaaattctcacctgaaccttcctcttcttcaatttcaaaatttttgaagttaggcagtggttttggttctgtatgaccctgcaagcagcaacattcaataaatcattttttgaagatcagtataagctatttttcaaaagaaatacaaggttcatgatggttacaacacatcagtagtgcatgaaactgttcataaatagaaagaacctgaaatagcaacagttgagtcatcatcatgtggacaaactaaccttttgaacctttgctgcaacttgatccttatcttctttgggcagtgcttcttttttcttgcccttatccctttgcttcataatctttctatcttgctctttcttagataatctgacagccacttcgttctgtgttgatggctccacatgattttgatgtgtgcttgctctgttttcagcagcaatgttcaagttctcattgctaatgcaaccataagttggggcttgtagtggcaacactgcatgttcaacctttgtgtttgaagaaggttgacacaaacttcccatagtttcatggaccatttcatgtacaatagcttctgttttggtgccttcaggaggctggaatgtaatgtcttctatcttattctcatgaattgccacatgagcattaactactagagcatcactgtcctgaccacaagttaggatcttctgtgggtattgagcatttgggctgcaatattgtagagcttcagcttctttcgaaatcacatcgaacgtttccatatcatctgttgcctttgtgctacaatttctaggactgctaggtctaagattcagatcctgctcaatcccatttttctttcccacagctaagccaactgccatagtaaggagggtggactccttttctagttcctcacggtcctctactctagaacaacaaagtgaagctgatccttcaggttcaccaatcctagtactctctctgtcaactgtagcatggaagatattgatacagccagacatgtctgtcacctcctttggcactagtgcagaagccatgctcacaagaacactgccatcattgcctcctataaactggtcaatcttggacggaagagaaggcatgctaatttcaatgtctgaaaatacattagagccaattgaaacttcaaaggaacgctgagcagtaaatatgttgagactaggaagcctgtcttgcaattcttgggtagcctcctgatgtacctgaggcaagacacagaaagaagagaaaaatgaagtaataggtgaattctactaataatgaaagttttaactacttggagggtcaagatcaagactaacatacaaacttgagacatattcaagagaattatctttcatggggtcatccattttgagagtatgatatgtccataaaaatatgtgtatcaaagcattggactgcatagcttatttcataaaatcactgagaacattgcaggtcaattcaataggtagcatcaacctagtgaccaaaatagtcaaatagtcaactaaagaaatctctctcgtcatttgcagtgagaaatgtccacagaaggagcagaccaagccccaattgtaattaattatcgagcaaaaagtaaatcagaaatgtaggacagcagattcaggccttgtttggctaatccctccacaaggggcttcggaggggattaggtatggaattaatcctgtactcgtggggattaaccgaacaagccctcagtgtgataacctaattttccctgcattatctacagcaaagctactagagcagttatgcattgtgttactgcaccatgatatttctgcgactagaaaaacttgaaggttgaaagagatagcacacctctccagtagcaactggagcacagctttgcacgatcagttgctgcgactgccgcagctcgtgttccggcaaatctgtacaaaattttcccaaatggagttcaaaaccacactactgatggctccgcataaaccaacatcagtacagaaaaacaagcaaagtaacctgcatcgggagccgccaggagacgcttcctcgcgacgaagcgccccgcatctgacgccttccgcttgcgctcgtacgtaacgggcacccgcctccgcaaccacctcatcacatcatcgggcgccctcgggctcaccctcggcggcggaacatccaaccccacgtacctcaggaacgccacgaaggccgtctcggaagccgccacgacgcccccggagagccgaagcggcgacccggggatgcggcacagccgctcgacgtcgtcggcggtcgcgaagcgcgcgacgtcggaggcggcggcgggccggccgaggcggatgaccacggtgaggaggtgccacgcccgctcgatctccgacgagccggcagccttggagtccatcggagatagggcggagggggctcggatcggatctgccgcgctagtgctcggaaggcatgggaggaggaggcgccgccgccgcggaggatttggggaatgggagagagaatggggggaacactagtacactactactaccttgttcttgaggagggggtggtgtttttgcgatttggtccttggagttggtttctcacttgaggaggggttggttttttgcgatttggaccttggagttgtgcgattttgtgggttggtggtgggcgggaggcgggaaaaattttggtgcgggggggtgggagttttggggagcgggtggatctgagcacgtggcgtttcccgcgcggttttccctctctcgggcttgtaattgctacggcccaaacaccagcgtacacagaaaagcagcctcccccgttgctgcagtagaactccacctggcacgtctcaactctcaactcctatcacaaaaaaaaaaaggaaagaaaactctctacttcggcagaaaagaaaaaggtattaccgcctccggtacaaatgttttgtcattgatttctcaaactatacggttatgctataaaaagttatatttataaaaaatatttaaaatataactatataaaagagtttttcacagataatctactaatataaattttatattttaaaccttaatagttttgcatctactaatgattttagatttgactgcattgaatagaatccaaagagagaactaaaatcacgtactgctgtgatgctatcagtctgcgcatgttcagcacagaagtaacgcatcaattggatcaagtgttcacgaatgttcaggagataggtaacataactggcctgaacaacaagagtggatcttctgctgaggatattatgtcgaaagctaatccgatgaactatttagctactgaagaatccaagaaattgcaaaggattgcgaaaatagccaaaatgcaatcctgcaattccattatcatcttcttgtttttcgacttcgcctccggcaatcaaagcagtccgagcatgggttgtaggccttcactccatttttatgatctaattgtaacttggaaggtgaaaccttgagttcttctatgagcatttgacggagcttgtcgttctcgtcccgcagttcgtcaataattctttggtgcttcagcaactgggtcagaaatgaaaagctcagttagcagacagcagtgaaggcataaacataggtagaaagacaaccgtggaccattctgtacactatacagaactaagttttaaaacaaatgcaagacaaaattctgttatagaactttacttgtgaaatcatgttttaatgctacattacttgttaaaaatattagactattagaggcgcttcatgttaagggggctgtatgggatggcgtgagtagaacatatcaaattcaaagaatgaggatggaacaaccaagcaagagtgggattatggagtatagcataagaaacactaggtataactggactcaccaattccagcacattatccatcccatgtgaatttctagcctgcaaaaagaacaaagaaaagagtgttcaaagtccatgaataacatgtctgactaagcaaattttagcagcgagaggcataggggcaacccataattgtgcaatatatatagtgcaggttagatatttgaggtaatgttttagtgcataccacatctctgatgtccatcttggtttcatcctggaacaggggagactgtagaaagttggcaacaaccttttcagtccgactttcagtcatatctggttgcattccatgctggctttgcaacccaggagctggttttacttgtgatgtttcattacttgtatggtggaaattacttttcgtggtcttagcctttagatcaatggacacaccattgggagcttgtccattgctaggcacagaaccagccatatttggtgcagatgacaaagttggggtatccttcagcctagaagtgaacttagacataagttcctagagaaaaagttcccttagaattcatacaccaaaaagggaaacaaagaaaaattcaggtgatcaaagtttaggtttgtactccaacggttgactgaattccatgaattacttgtggcttcaatgcaattcctgagtattgagatacttaatggttcagcttcagatcaaacaagtttgcatgcttatgcaagaaaaatatttaacagatgtgtagcatttgatatagaatataaataagagtaaaatagcagaggcttggcagctgatgatttctactaacaaaaacaatgacctggaagcgttgcagatattatagatatttccatggatcctatttagggagtgtgctagtatgctaggtgcgaaagtatgaaatgtggttctattaaatgagtcccctcaattatcacttcatttttggactagattagatgaactgatagatctgctgcagcagtcaatgaaaataaaaaacatacaaaagaatcaaagtatcaccaattcaccaggtgcctaaatttaatctgattgctgtataaaaaagaaactatgaataaagcatgacattgccaccgcctagcaagaacacatgttttggtttctgataatacaaatgttaaaaaaaatggcgtgatcactgcaaaagtaataaacaggaaagatatgctcaagatatgaggatatcaagcacaaaagatgaccttgactgacaatagttcctactaggacagcaccaaaagaaaatttagaggactaactacatggaaaagctgcaatatgtacctattccaaaaccgtggcctataccaactccacagccaatgcctgcttcaatgttctttaaccctgacttccttagctagagcacaaaaataaggaagaaaaacagcagaattagatcgagacaagtccaaaatacataattagattaacataagtcaaaagtatcctactaacgtgattggcacctaattattcgtggttacacaaggattatctttacttacagcggaattaacatgccttgttacgcctgaaaaggcatccgttgcgccccttgttgcggtcataacttgattaagccccggtatgacacctatccatcaagacagaagccaactacttaaagtcattgaaattaatcatcgagccctaaatgccctatagtatggcagtatggggcagtaactgtggtctgtagtctgtgaagaggggaagtgcacaataccagtgtcagttcgacagactagtagacttaactaaaagtaaactgtattcctatgcaccagcaaacatcccatttttatcatctactatcttatccacagttcaagcaatggaactatgtgcggtgacacacgacacgaactgttcgacgaaatggccacaagccaggggcgggcaataatcacaaccctcagccgctcgacgaaatgcgaaacccaccgactcatggccgaccggatcgatgtccatcccaatccccagacccaaactatccaggaaacggcggaatcacttagcttcggaagctttgctatacctaggtagatggggcggccgacgccgatgccgacgccgcagccgacgccgaagccggtgaagacctggagcaccttcacgctgaaggggttctccatccggtacgccggcggcggaagcctccgctcccgcgagctcgccatcgaggtcgagtcgagcaccgcccgcggtagccgccggcggcaggatgggaattgtgagccgtcagcccgccgttgggtcttgggcttattgccactggctaagaagactacaagggtgttttttggacttttgagattaagagttgcgactgtgttcctgggctggaagatggatgcagcctttctatatccttggctgacattgtcacgttctacatgggtcctctatagcccctcccttttcataatttatttttcaaataacatggtatgactcatggttttatataaacacgcgcacgctaactcctataaatacgcgcatatatttatctgatttccttcaaataatgggtcgacgtatcttgagatcaatgagttattatagacacttcgctgtcgatgcttatgtcacttacctagggatgaaaatggtcacggaaattctcgatcgaccagacgtcgtttctgtttaaggggtactatttccgatcgtaccgtttttgtctatttttaaattttgttttttctaatttttttatcgtattaatgttgatactgagtagtttaaatgataaatatggtcaattaccggttagttctgaagagatgctgctgattccgactgttttcttaccaatggaagaataattagcttttttttaagtatttggctgttttgactaataattgctttgattagatcattgatatcttttagttgtttgattattatgaatggaatttacatggtgaacgtaatatgcttaagtaatatgttgtcctttctttttctttaatattcatataagtttgatataagacaggaccgatgaaactaaaacattgccggtctaaaattatatgtacttttatgaaacaaaggggtaataaactgtatacatttaaaatcgtggatagaaggctaaaaaacatcgacaaacaaagtatcgtatatacctataaagttcatatctactaaatatagttaatactaattatctttttatttcatgaaaccacatcacctcaattattttttaacctttgaatgatttatcaagaatgtaaattgcatttttttctccaaaaatcacaccatacaacacagtcatttgaaacatttgaataattgatcaaattacaaaatatataaatacatgaaagaaaattgtatagtaagtaataatctttttttttacaactcatgtaggagtatgggggtgtttagattcatgggtgtaaagttttggcgtgtcacatcgagtattatatagggtgtcgtatggggtgttcgggcactaataaaaaaactaattacataatcccttacggcctgtttggttggagggagtttttagcagggattgggagtttagagagatgatgctattaagtgtttttgtttggatgggaggcatgagaattttagtgggatggggatggagaattgaggaaggaactccctccttttcaatacttgagtagggacaggtaattgggagggaattcctcctttacgttgtttaaacgaatctcagccatcctttttttattaatgacctaatctcctaaactccctattaatttccatcacctttaccaaacaagatattgggattaaaaatcaaattcctatcttaatctcatcatcaattccctcgtgtaaactcccaatccccttccctcgagttaccaaacaagccgtttagtaaactgcgagagaaatttattaagcctaattaatccgtcattagcaaacgtttactatagcacaatattgtcaaatcatggagccattagtcttaaaaattcatctcgcaaattagtcgcactatgtgtaattagttattttttagcgtttatatttaatactactttatatagatgttcaaacattcgatatgacatgctgaaaaattttaaggtgggattacacgattctcaccgtatcaacgacaacgatcgggtgcactggagcctggaggagcctaccgctgctccgctctacgggcacagacaaacgttcccactcgttaggcggtggcgcgcgtacatacgttcccacttatcatctctaccctccaaacaatttcaaattccaaccacggggcgtccaaaatagcaagggaaaaaaaaatttcaggcgagtagatttgcattcttctcccccacctcgacgccggcgagagccccccggtctcgcttccgccgcccgatccggcgccgggcccgcccgcccgccgccgcgtgacaaggggaaggcgaagggatggagttcacggaggcgtacaagcagacggggccgtgctgcttctcccccgacggccgctacctcgccgtcgccgtcgactaccgcctcgtcgtccgggacgtcgtctccctcaaggtatccgcgccattcccccccctcacctccttcctcccccgcttgatcctgttttagtggtccggaactggaatgcgggtttagggtttgtgccttctggagtagtcgctgaatctggggttgggggaaatgccatctaccgctgggctcaattttgagtgttctggttcaggaattgcgcctagttttgcccgatccgtagcctagggttcagggtaggtttgtactggatggacgaaatcagtaccaagctagctagattacctgctcaattgtgcggactagataccatgatatgcatgtttatgtttgaggagagtgataatgagactatatgttgtactgtgcctttaatacctacgattaaaatcatcagcctactcattgttcaaatacttctgtagatatgatatctatattcgataagccagatatgtataatataggctcaccaactaaacagtgaaaatatttctttatttggtgtgattgacatggaaatttctagttttaggcagcaccctcctaccacgattttgccaaaataggtgcgctaggaggtcagcttgcctagggtggctgtaggaagtctaaggtagagcttgacatcatagacttgctatccttctcgatgatctaagaaggtatggagacatgcatggtgggcacgacgggccctgtgatagggagatgctgagtgggaagggaaggggaatgatttagaggagaggaagtacctatgagaaagtagataatggggcaaaggtggaggcaatagacaatttggggtagctggcattgccctagtacgtatacggactacgtacaagggagtaggcaagcttaaggcctaggcctagcatttaatgttttctcaaaagcgacaaaataggctatccccccccacccccacccccacccccgtcacaacatgcacacagagcagcggcattacattacattctggcataggagactgagactgagcgagcaagtaggggtgcagccatggcatcgtcatcctccaccaccatgtctgcatgccacctctcaggttatgttgtctgttgttctactttaagttggccagatctgaggtgagaagtacatctttcaggcaccagattttgcctccactcagcctgaatttttcagccccatcactgtaattggctaattggcgccgctacttgtactgcggatgctcaactctctgctcccttggtttggccttcttgctggcccctccctcatttctagctttgtatctggctgggcgggcaaggactgtactgatccactatctgatagtgccttggtgaacactgaccctttaacatacctttaatcatatcacagcaataaatgcctgaatacattgtactattatataaccccacaaatcttttgcatatttgtgaacagtataactctaggaatatattgtattaataagacaatctgtcggccatatattctatgtaataactgttgaaactgtgtaggagagagattaccaattcacaatcatctcctagtatgtactgacatccaatgggcatcatattgggtgcacacacttagtgcttgggaattggaatgcaggcttaaaagttttgggccttctggagtagttgctgaatttgtgatagggggtattgtcatctggtatagctaaaatttgagccttctaattcacagaaaatatgaaatgttccttgttttgcctgatctgtagccagggttcatgagtaattggcagtatggctggaccaaagaaatgttaataccaaatggtatcgtatagtggctaatgagtgcatgctgtttctggggagatttatataagaactgctagtcatatctagagaatacaattgacaacaatgtatggtttgctttaatttatgcaggtggtgcagttgttttcatgtgtggacaagataagctttctggactgggcaccggattcagagtatattctatgtggactttacaagcgacccatggtgcaggcttggtcactgagccagcctgactggacctgcaagattgatgagggccctgctgggattgcatatgctcgctggagccctgacagtcgtcatatactaacaacatcagagtttcagctccgtctgactgtttggtctcttgtaaatacagcatgcatacatgtacagtggccaaagcatgcctccagaggtgtttcttttactaaagacgggaagttcgctgcaatctgtactaggcgtgactgcaaggattatgtaaatttgctgtcatgccattcctgggagataatgagtgtctttgctgttgacacggtagacttggcaggtgttgagtggtcaccagatgatagtgctattgtggtctgggattcacttctggaatacaaggtgcatctcttcattgtactcccattgttgttttatttgcttacttttgaaaatcatcatcatttactgtatgtcattatatatgcatataacttgttaatactttttgttggtagggtcacttatttacttcagaatttagatgggcactggttgtgaattactttatcttgcatgtatggcaaaccacaccaccttttcttcaaatggcacttataacaatttttttttgcttattctggtttactcaagtttctcggttgatatttgattacattgacggatctggttattagttggactttaatgatcaatcagttggtatattgggtcatgactcccccaaaacatacagggttatttcttaaccaatatcctgttcaagagctcattgagtcatttctctctgcagcgaaactaatctcttatctactcttaagggttctcttttctgtgtagctgaacttattttatattctactattaatagttctcctttctctgtagctgaactaatttcttattgtactcttaagggttcatcccagtctgtttttatagagctatgttttttttttctgctttagataaaatatagggttcatctcaacggatactaatctcttgttctactcttatgttgttgttagcagtttttggatttaaactgataatcctaagaacatgattgtcacaggttctgatatattcaccggatgggaggtgcctgttcaagtacttagcatatgaaagtggattaggtgtgaaaactgttgcgtggtcaccatgtggacagtttttagcagttggcagctatgatcaagcagttcggactttgaaccacctgacatggaaaacttttgctgagttctcacacgcagcatctattcgaaatcctactaatgctgctatatttaaggtaagcctactgatatctatcactaattgacatcttagcagatctagtgtttttctgttcatggtatctgattgtaactacaaaatgtcacaggaagtggatgatccatggcagcttgacatgtcagagttatgcctaagtgaaggattctcccgtaacatgcaaggcaatggtgctggtgagattactaacgatacttttatatcgcatcttgttcctccttttttgataaattatttggcatgttttatgatgccttgtgttagggccagcgctaaccttatgtttagttttggagactgatctttttttgtggtcagaaaatgggacagagggaggttctcgagttaagtatgctgtgatggatgctccaatcactttgccttcacagaaacccgttacagacaagcccaaccccaagcagggaattggttagttgctcctatttctcatgcatatggatcaggatgttggtctttttcctaatgcctaatacacttgtgaccagtgtcatgaacttgtgaactactgtagttactattacacattctgtatctgatgtgcagtagatctctaattcattttgtaaactgtgataatggttcctactataaacattatcgataacccttctaagtactaaaatccccttgcgtgatttgtgttggccattcatgaatttctagtagaatatggttcagtataaactgcattgttaacatttcatattctactattaagggttcttttttctctgtagctgaactaatctcaccttgcaattcatgtgcaggtatgctgtcatggagcagcgacagtcactatttcttcactcggaatgacaatatgccaactgctctttggatatgggatatctgccgccttgatcttgctgctgttcttgttcagaaagatccaatccgtgctgccgcttgggaccctaattgcccacgccttgttttctgcacggagagtccgcacctgtacatgtggacaccatctggtgcatgctgcgtcaacgttccgttgccaaactttcgggttgtggacttgaaatggaactcagatggaacttgcctcctcctgaaggaccgtgattctttctgctgtgccgcaattgtctctcctttgccagaggaagaagaggctgatcaatctgatgttacctcagaagatgaatgaacttgcaggccttgctctaacaatgggatgtgcagcttttaatcagtggatctacatttgtatcatatcgatagatgtacctgggtaacagcttgttctgaagttgctgatcgatctgatgatagctcagaagatgaatgtgagctttgtatgccttgctctaacaatgggagggaagacacatgtttctttccgctttaaaacacatagagacgctgtcgttgtaggctgcatctgatattcttaaaccatctttgctacacaccctacgctccttgaaactggctagattgtttttttgtagatgtcagtaaacgtggaatctttactccatttaacgtgtaatatccgttttccagcgttgaatgctaatatggcctgtgcatgaagtcgtcaaaatccttttgaacatcccaagttcccaacccattttttagctacaatgcagtgaagttgcctttcctactcggattccaattccaaaagtacgattctcttctgatcaaatttatttacattcttctgaaacacagtaaaaactcctctctcgagctgatcaaaagctgcaggatgtacataaaccagctttaccttgccttgacgttacgtgcgtactgctactaccgctatatatatataccgtattaccgtatactccgtagcccaggtcgccgtattttggagcccggaatacgcatacgcgtacccgcatacgctatatataaattgcccaccccttccagttctccccttgccgtcaccgcaccgcagaggaggaggaaagggcagggaagctagctcgcctcgcgcgagcgagcgagccgatccacccacccccgcacgatccgccgccgcgcgcgaatcggagctaccaccaccgccctcctcctcctgcatccgcgtgcccgcgaatcggatccccctcccccgaattggggctcgagtggcaccgaaccctactcgatcccggcggcgtgaggggtggggatgacgcgccgggtgcgccgccggctgtgcaaggacggtgggaagggtaaggatgtggcggcggatgaggagagggagctggtgagctgctcgtcgtcgagtcggcggcgggggggtttgggggtggcggtggcggcaagggggggtggcggtggcgggagcgggagctgcgtggtggactggaggacgctgccggatgacacggtgctgcagctgttcgggcgactgaactaccgcgaccgggcgagcatggcggccgcgtgcaggacgtggagggacctgggggcgtcgccgtgcctgtggagcgcgctcgacctccgcgcgcaccggtgcgacgccgaggtggcgtcgtcgctctcgtcgcggtgcgggagcctgcggcggctgcggctgcgggggcacgaggcggcggcggcagcctcgggcctccgcgcgcgggggctccgggaggtggtggccgacggctgccgcggcctcacggacgccacgctcgccgtcctcgcggcgcggcacgaggccctcgagagcctccagatcgggcccgacccactcgaacgcatctccagcgacgccctccgccaagtagccttctgctgctcgcgcctccgccgcctgcgcctctcgggtctccgcgatgccgacgcggacgccatcggagcgctcgcgcgctactgccccctcctagaagacgtcgccttcctcgactgcggatccgtagatgaggccgccatcgccggcatcctatccctccggttcctctccgtcgctggatgtcacaacctgaaatgggctacagcatccacctcctgggctcagctgccctcccttgttgccgttgatgtgtcccgcaccgatgtctcaccaagtgccatctctaggctcatctcccactccaaaaccctcaagcttatatgcacgcttaactgcaaatctgttgaggaggaacaggcacacaatcctggagcatttagcaactccaagggcaagcttgtactcaccattacaagccacattttcaaatcggtcgtctcactttttcctgataaggttgtgaaggagaatgaggtgttcaatgaatgtaactggaagggcaaagacaatgcacttggtgatatgatgagctggctcgagtggatcctgtcgcagacacttctacggatagcggagtccaacccgcaaggaatggatgacttctggctgcagcagggcgcagatatgctgctgagtttggtgaagagctctcaggaggatgtacaggagcgtgcagctaccacacttgctacgtttgtggttattgatgacgagagcgcgaatgtggatgctgcaagatcagaggcagtgatgcgtgttgggggcattccaatgctactggaccttgcaaggtgttcaagggagagtgcacagtcagaagcagcaaaggtaatgatgtccattttagctgaatccctggatctaattgccgatatctactatgtttggtattaccattttcttacagttgttaatgtgacttcaggctattgccaacttatcggtgaatgccaaggttgcaaaggcagttgcagacgagggaggtatcacaatactaaccaatttggccaggtcaatgaatcggcttgttgctgaagaagctgctggtggcctttggaatctctccgtgggtgaggagcacaaggttgtcactccttggatgctgaatactctgattgcaatgtctgatgtgttgctggtactaacaatatattgattattctttttcaggcagccattgcagcagctggtggtataaaggctttggtcgatctcatactccgctggcctgctgggactgatggagttcttgtatgtatctttgatacttctcaattttcagtaatttcaatgctgcttgctatccttttctggataataaattttttataacggttgctctttttctttaggaacgtgctgctggggcacttgcaaacctagctgctgatgacaagtgtagcatggaagttgcaaaggctggtggtgtccatgctttggtcatgcttgctcgatcatgtaaacttgagggtgtcctagaacaggtgagcgggtacatcatgtcgtcatgcttgtacgcattcgttctagtcagctagttataccatagctttttttgctagctctgataatacaactaacggtacaagatctacaaaataggaagcacgataaagacaaaacgggatgacctgtgcacatgctatctttattttatgcttgcatattgaactttatcctgccaaatgaggatctcttggttcacgcctacttcattgattaagcactgggtgcaacttttcatgcatggacttggatgattttttatatttatcagatcgctcaatctcatggcatgagccacgtggattcccaatttcctataagaaaggaaagtctgtacctgccatacttatctcaaatgatttgtcgggatgctgactggactcttaccatgtacatgtaattccaagatacagtttattctcaacttgcacaatctatatctgctttaaaacaattggatttgtcgtggagccacttaaaattgctattttcttatagtagcagtttgctgcgttttaagctctacaaataaatgctccatctaacttgctacctagtgctttgtcttttacatgctcacaatcactgtatatgtactgcatttactttctaatactatcactgttgttcatgtaggctgcaagggcattagctaacttagccgcacatggagataacaacaataataatgccgctgtgggtcaggaagcaggggctcttgaggcattagtgcagctaacaagctctcaaaatgagggtgtaaggtatacttctagctgatgtgctgttttaagttgcaacgcctgattttgccattaaattatactttatattatcctaatttaatattgtgattcctgtgcatttaattagacaagaagctgctggtgctctgtggaatctgtcatttgatgatagaaaccgtgaaggcattgctgctgcgggtggcgttgaagctttggtacgtgccccatttgtgctttaacacagctttgcatccttt

SEQ ID NO: 23902 - DNA, 649 bp, Oryza sativa
ggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccgatcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtacaggcggaaacaccagtcggcagcggcgaaggcaagccggtcggtgaagacgtagacgcccaacaacggtggcataataggccagccgtgcaggcgaaaacaccagtcggcggcggcgaaggcaagccggtcggtgaagacgtagacgcccaacaa

SEQ ID NO: 23903 - DNA, 843 bp, Oryza sativa
tcctatcatacatttcttgtggtgtctccttgacatccatcacaaatcttccaagccttccttccaataattcaatcttggcctcacgaacggcgggtgatccctcatgagccaattgcaaagtatcccatatctccttagcctcctctagtccatcaaccttgttgaactcctccggactcaaggcggagagaattgcattagaagcttgagcattgcggtggatgaattgttcttgccccgaagtgagctccatgtcatcatggggtatatcaatacctgtacaaacaactttccaaatacttggatgcaaagagattagatgcaacttcaccttgtgcttccaagcgtcataatatgtcccatcaaattgaggagtatgcccggaaggcatggagacgaagtagtgagagggaatagtaagtttgctgtaatcaaaaggtatagtagctcccttgggtggtggagttcccttgctgcttgcttcatcttcatttccattttccccattctttccccctaagtccaacatcgtggatcactcaaagcggtgaagcttgaatcaagagcacctcgctctgataccaattgaacgtgcagagatgtaacctagagggggggatgaataggctttcctgaaattttctcaacaaacgcagcggataaattgacagggtccggaacctcctggtgatgaacatcggaacttcctggcagtgatgagtagcctggaacttccgaagttcttgagccaggaaccttccggcaatagagaaaaatgaaatatgagaagtataacaggtcctagttagtgaaaatcagggacagggttgcacaagatga

SEQ ID NO: 23904 - DNA, 1230 bp, Oryza sativa
tgttgggcgtctatgactttaccgccggcctgcctccgtcgccgccgactggtgcctccgcctatacggttggttggtcacaccaccgttcatgggcgtccacgtcttcaccgccggcctgcctccgtcgccgccgattggtgcctccgcttacacggctggcctattatgccgccgctgttgggcgtctatgacttcaccgccggcctgcctccgtcgccgccgactggtgcctccgcctacacggctggcctattatgccgccgttgttgggcgtctacgacttcaccgccggcctgcctccgtcgccgccgagtggtgcctccgcctacacggttggcctattatgccgccgctgttgggcgtccacgtcttcaccgccggcctgcctccgtcgccgccgagtggtgcctccgcctacacggttggcctattatgccgccgctgttgggcgtctacgacttcaccgccggcctgcctccgtcgccgccgactggtgtcctcgcctatacggttggttggtcacaccaccgttcatgggcgtccacgtcttcgccgaccggctggccttcgccgccgccgactggtgtttctgcctacacggctagcctattatgccgctgctgttgggcgtctacgacttcaccgccggcctgcctccgtcgccgccgactggtgtcctcgcctatacggttggttggtcacaccaccgttcatgggcgtccacgtcttcgccgaccggctggccttcgccgccgccgactggtgtttttgcctatacggttggcagacttcgccgccgttaatgggcttcatcatctacaccactggcttggttccactggcgccgactggtgtttttgtcaccatcgatggactgcttcgttcccacatcggctacttttgctgtcaccgagggaatattacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtg

SEQ ID NO: 23905 - DNA, 1057 bp, Oryza sativa
ctgattcaatcaagcaagccatacaccgctgatgacatacatgcattaaaaatcttggattacaagccaggtttatcgttttaaattctttcgcaaattagattaattcacagattactaattattgtttgatctgttattgtttatgcatgtatgtcggctgctgtcgtcgccgctggctggcttctttgcgtacatggctggtgtactctgccaccattgctggtggcgacattgtcttcaccaaccggctgcctccgtcgccgctgactggtgtcctcgcctatatggttggtcggtcacaccaccgttcatgggcgtcaacgtcttcatcgaccggctagccttcgccgccgccgactggtgtttccgcctgcacggctggcctattatgccgccgctgttgggcgtctacgacttcaccgccggcctgcctccgtcgccgccgagtggtgcctccgcctacacggttggcctattatgccgccgctgttgggcgtccacgtcttcaccgccggcctgcctccgtcgccgccgagtggtgcctccgcctatacggttggttggtcacaccaccgttcatgggcgtccacgtcttcaccgccggcctgcctccgtcgccgccgattggtgcctccgcctacacagctggcctattatgccgccgctgttgggcgtctatgactttaccgccggcctgcctccgtcgccgccgactggtgcctccgcctatacggttggttggtcacaccaccgttcatgggcgtccacgtcttcaccgccggcctgcctccgtcgccgccgattggtgcctccgcctacacggctggcctattatgccgccgctgttgggcgtctatgacttcaccgccggcctgcctccgtcgccgccgactggtgcctccgcctacacggctggcctattatgccgccgttgttgggcgtctacgacttcaccgccggcctgcctccgtcgccgccgagtggtgcctccgcctacacggttggcctattatgcccccgccgttgggcgtccacgttttcaccgccggcctgc

SEQ ID NO: 23906 - DNA, 2600 bp, Oryza sativa
tccttcttcatatttgtcgttctcgacttgtaggggtgtccgagggctctcaatcccttccatcctgttgctttcccactgttcgcgacttcttaccatgcagtgcgaaaatgttcccacaaggtagtttaatgtagcactgcattgtcaaatcatagcgcaattaggcttaaaagattcgtctcgcaatttacacacaaactgtgtaattagttattttttttatatttaatactccatacatgtgtccaaacattcgatgtgacagaatgtaaaattttatcaggggatcaaaacaggcactatgtacttaaaagcgtagtcatcctctttatatccccttttcgccatgtgtaggagttcgtccggcgtccgctgtaagtaatcgtgataggaatcaatactttatcttcaattcatccactcaattcttaattatatcagtatggtccgttagaaagtacatacatattatacatattgctataaggagtgagcgttgatgtgtgctcaaagtatataaagatagtgttgaaggtatgcacaactgtacaagaccatcacatgaaacatacgtaaaccaaccaccatcactaccaattaaaaacccttgaagtagcgaagtaaagcaccgagagagtgaccattttccatcgcaaaacctgtggtccggacgtgagagaacatcgatcgatcaatctgcccggccccaggaggtaaagaaacatccacacaaccgcattggtcacggcccgtgccttttcagaaaggcaagtatatatatctggattggacccaaaagggctcggcgactccagctccaatcaaccgccgatgagcctaccacaagacttcgcgtaaagagatccccaaatcccaaacgcgatcgaccggaaagaaattccgctcgcggcgacggcggcgaggcggcgcacggcgtagccgagcctcgtttcggctcagctgcagggccgcccgcctttcggcgtcagaatcggcgccttttccgggtcgccggatcgatcccattcccaggggggttcccaggggaggcagctaacgtgagctgtttgttggtagccatcgattttgcgccgttggatcgagggatggacggctcggattccggccttcattccaaggagaatctagaaaaaaaaggcgtttgcttgctggtgctaggatgatccacggcatgatcacgtccacagcggatggctcctttgtttaatgcattggcccaactgctgcctaccgtttctggcttgcacgcttggatgatgggcgtggatgggatcattaggggggcaacaatggatgatggggtttgaatggttagtaccacttgtttcttaattagcagattataaataataacgcagcgggccaagattctgacggagtacgatatttttctgtagctggagtgacgcggctgatggtgctgtgctggctgcctggctcgcgtttgcaacctcaggcagcccatgctcgcacggcgcagcacacgcaagactgacagcatcactgcaccaagccgttcgctgtaccttgctgtattatttggaggatgatactgtgcgagctcagtttcccgaactaaacctcaaatgtctatttcggccgtaaaagccagattaaatccttgcaactaataatcctattgatgctaaactggtttttggagtattgcaaactctgcaagtcgtatgctaacataacacggtgtcacatcagcaatatcagtgctgaatcagcaaagaaaaaactatttgaatccatctgtcaacgtcatgtttatctaattatcttctttctctttttctggctgttgcatactagtaggtcccaacttgaagtggcaatcatagataattccgcatgggctcaggccttgtattttttaggaataagtccattttgcctccctcaactcatgacccggttgaatcacacccctcaaccacaaaatcatgtataacacgtcccctaactcccgaaacagttgcaaatcaactcctcgagcggttttggaggcgattttgttctacggtggcacttacgtggcgagttgacttggtcttcatcctatgtggcatcaacgtggcgcttacatggtactcaaataaaacaaacataaacgggacccacctgtcagtgaataaaacaataaaaatacatatcggccctgaagatgcacttaaaccccctagggggttttggtgattaatgacaaggtggttaaaggggactaacgtgtttatcaagtttattcacaggagtttagtcccaaagcgagttgtgatggctaagaatgcaaggagacccccccaattcaaatgttcctaagtgcaaaaatcatcgaaggtgattagactaggtttttcactttcgaaattgagtttaggaaaaaccgtactattaagaggggtttcaagtgtggttctagggtatacaaagtgctcttagtcatatctatgagtcaaaagattttttggaatcatttttgaaaaatgattttctccccgggacagagagggctacccggaggttctggccggaacttttgggcaccgtttatttgcaaaaaatttcctaag

SEQ ID NO: 23907 - DNA, 1157 bp, Oryza sativa
caacaagattaaaggacttgggagtgaggacatgacaaatcactttgtggtcaagagacttctgcgtgcatttggtccaagaaatcccactcttttttatcaatgatacgggaaaggaaaaacttcaagagactcaccccaagtgacattcttggaagaattgtgtctcatgagatgcaagaagaggaagctcgtgaagtgagacaaatggtgaataatgccgccatgataaaaaatcaagaagttgctttgaaggcaaaacaagaagaagagtcaagttgtgaagaaagtgaagatgaagaaatggcttttattgtcaagagattcaagcactttcttcgcaagagtggctatgacaaagggaggaaggatgatgacaagggaaagaggcaatcaaagagagcgtgcttcaattgtggcgaatatggccacttcattgccgattgtcccaagtcaaatgaagctaaggctaagggaggcaagaagaagccggagcgtgctcatgtggcggaggcacacatggcggaagtgtggcactccggagatgaagaagatcccgaggtcaagcccaagcccaagtcaaaagacaaggttgaaggagaaggtggtgttgctaccgtcgccttcaagtcatcctcttcaagcaaggagtgtctcttcaacaacttgagtgatgatgacgacgactcctaccactactcttgcttcatggcccaaggccgcaaggtgatgactcaaaagccctctcaaacttctcttgatgttgattctagtgatgaggaaagtgataattaattagatgatgtgcttaagagctttagcaaacccgctatgcaacatttggctaagttaatgagagctttggatagtaaagaacaatcactcgaaaggcaagaagaattgcttattcttgagaagaaaagaaatcttgccttagaggagagcttagctaaagaatgtgctaaaaataaacaacttgctaatgagcttaatttggctaatggttctttagctagccttagggatgtcaatgaaactcttcaagaaaaatttgctaatttagacaaaagtcataagatcttgaagttcaatttgacactctttggaatagcacctctcaaccaaatgtggtttctaattcttctaaccttttacta

SEQ ID NO: 23908 - DNA, 16909 bp, Oryza sativa
ccgccggtttgccaagaagtttccggccatggccgtgcacaaaaaatgaccggaagttccgggcattatgccaggaagttccagccagatggtctttactatgattcatatgtaatttccaaaaattcagagggcaaagtggttgcttattttaatgtgaattacaatgatgagtaccgcacttgtgtgtgggtgccaaaggctttggtaactaacatcaagggacccaaacttagacaggtttgggttcctttaaatcccaagcttgaatttcttttgtaggcatactcctccggggtcaagttgggttgtggacagtggttgcaccaatatatgactggagagaggagtatgtttacaagtcttgataaggagaacggaactcgtgagaatattgtgtttggagatgatggtaaaggaaaggtaattggtctaggtaaaattgccatctccaataatcaatctctctctaatattcttcttgtcaattcattaagctacaatttattatctgtttctcaattatgtaagttgggttacaattgcttgtttaccgatgaggatgtgaccgtctttagaagggatgactcctccgtagcattcaaaggcaagttaaagggtgatctctatcttgtcgatttcgatgtggatagagtgaatccggaaacttgtttgattgctaaatcctccatgggttggctatggcatcgtagactagcccatgttggaatgcggaatttggcaactcttctaaagggggaacacatcctcgggctcactaatgtcacatttgagaaagatcgtgtgtgtagtgcttgccaagccgggaaacaagttgggaatccacatcctatcaagaacatcaactacaacacgtcctcttgagcttttacatatggatttatttgggcccgtggcttacataagtattggaggtaataagtatggttttgtcattgttgatgatttttcccgcttcacttgggtgtattttctctatgacaagagtgaggctcaagatgtcttgagcgcttcgccaagcaagcccaaaacctctatgatctcaccatcaagagggtacgaagtgacaatggaggagaattcaagaacacacaagtggaggaattccttgatgaagtgggaatcaagcacgagttctccgccccttatgatcctcctaaaaatggcattgttgagaggaagaaccgaactcttattgaagccgcaagagcaatgcttgataagtacaagacttcggatatcttttgggcggaggccgtgagcaccgcatgccatgccatcaattgcctgtacctccacaaaattctaaagaaaacttcatatgagctcttgagtggtaagaaaccaaatgtttcctattttcgtgtctttgggagtagatgctttattttgagtaagaggcctcgttcatctaagttctcacctaaggtggacgagggattcttacttggctatgagtcaaatgcacatgcctaccgtgtcttcaataaaaccttcggtattgttgaagttataagggatgtgacatttgacgaatctaatggctcccaaggagagcaagttgttgtacatgttgtaggtgatgtggatccaagtcaagctataggtactaaggctattggagacatacgaccagtcgagacgcaggatgaccaagaagatagggatcaaccttcgtcatcgacatccaatagccctacatcgagtcaagagtcagttgacccggaagttccgggaccagatgatcggatcctccggacctccccaagccaggaagttccgggtccatctgccaggaagttccgggcagaggacagtcaaggcgtgcctgtggatgggattgatgccgagggcactgtagagcatcctgatcaggctcaggtcccctcggtgcaccatccaagaatacatcacactgtccaaagagatcatcccgtcgacaacatacttggtgacataagaaaggggataactactcgttctcgtgtcgctaacttttgtcaacactattcgtttgtctcttctttggaaccaaccagggttgaagatgcacttggtgatacggattgggtgatggctatgcaagaggagttgaataacttcactcgcaaccaagtatggacgttgttggagagacctgaccaaaatatcatcggcaccaagtggatcttccgcaacaagcaagatgaacatagagtggttgtaaggaacaaagtccggttagttgcgcaagggttcacccaagtcgagggtctcgattttggtgaaaccttcgcacctgttgctcgccttgagtcaatccgaatccttttagcctatgccgctcaccatgatttcaggttattccaaatggatgtcaagagtgcctttctcaatagacctatctcggagttggtctatgtggagcaaccaccggggttcgaggatccaaagttgccaaaccatgtgtacaagctccacaaggcgctctacgggctcaaacaagcccctagagcttggtatgaatgtctccgagattttcttttgaaaaatggttttgaaattggaaaggcggatactactctcttcactaaaaaaatttaagagtgatttattcatatgccaaatttatgtcgatgacataatatttggttctactaatgcctcttttgtgaagaatttagtagtatcatgactaaaggttcgagatgtctatgatgggtgagttgaccttcttcctcgggctacaagtgaagcaagcacaagagggcactttcatctctcaaaccaagtacgtgaaggacattctcaagaagtttgggatggaagatgccaaacccatcaagactcctatgcctactaatggccacctagacctcgacgacaatggtaaatgtgtggaccaaaaggtatatcgctccaaaaggtatatcgctcaatgtgtgtcccgatatcatgcttagtgtttgcatgtgtgctcactttcaagcggagcctaaagagtgccatttgattgccgtcaagagaattctaagatatttagttcatactcctaatattggcttgtggtatcctaagggttgtgactttgagcttttgggctattccgattcggattatgccgagtgtaaggttgatagaaaaagcacaaccgggacttgtcaattccttgggcggtcccttgtttcttggtcctccaagaagcaaaattccattgccctatccaccgccgaagccgaatatgtcgccgccggttcttgttgtgcccaactcctttggatgaaacaaaccctaaaagattttggctacaacttcaccaagatcccactcctatgtgataatgagagtaccatcaaaatagccaacaatcccgttcaacactcaagaaccaagcacatagatattcgccaccacttcttgagagatcatgaaaccaaaggagacatatgccttacccatgtgagaaccgagagccaattagccgacattttcaccaaacctttagatgagaaaagattttgcgagcttaggagtgagctcaatatcttagattctcgcaacattaggtgatgggtggtttgctaatttatagccaaacatatgtcactaaaatgtaaattaaaaaaaaatgagcttttgtgtcttgagatcacttcttgtgtagaagatggtcttgatactaggaataaagctcaaacattccctctttttatccaaaaacctttttgaaaatctttgcgaaattcctttgtgtgccttttattgcgaaaatttggtttttatcttctccttgtgatgtatatcgaccatagttttgtattgattgcttgttggctagttatatacatctattcctccttttgattccttgtctctaccatggttttgggcctgactgccctttatctgtcaggccggaagttccgggcctccctgtccgaaacctccgggtgtcggggagtatatattcttagggggagttagaaaccctagtctctctcctcattcttctccctccccgacgccagccctagccgccactacagtgccccgagtggtgattttcttttccctccaatcaaattcgattattctccgtggattcatctacattgatggctgggaggttctttccgtgatcgattcgcagtttcctctctcaaggtagcacttttgatcttctcttttggttcatcatgtttttgccccgatctctaaatctgtgaacctagggagaaaaccacttggatagtcttgtttctgctaccttgtagatcaccgatctataggatttgttcacatgcactggctatttttgaaacctctgttcctcttttttgccggccggaagttccggtgttcttgcacccggaacctccgggcgctgtccagccagcctgccattcttgattctctcaaattttgcctaactactgcactccaatttgttgattcctgttgcagtaagcactatgcctcgtgagaaaagacagaaagcctctcaggatgtgtccggtgataagagtcctcctattcgttttcctcgtggtcgtttgggtaaagagaaagtggttgatgcggcagtggtagcagtactcgtacttgtcctaggtttaccaggtaatccaacaaccgtccagttcagattcgggatgttgatagtggtcaaggaagtgatgtttctaatacaagaggtcgtgggagaggtggtggtcgcaattctggggctggaagggcatctcatgattttcctgttggatctcatgagaatcccgttcggctctacaagactcttggatttgacaccactcttatgcaccacattggaagacccaagtccaactaccttcatcagcttgccaagtgcagaagggaccgtttgattgatccagagactcagcctaaggagtcataggatcctcgtttcaggactttcactcaattggattggtataattcagtgattatggctagagaaaatccagtggttgagatgaagtggattgattgggcttacatgaggaagaagaacaatgaagtgttcaaccaagtgatgcaagtgtgccacaacaagaatcttggagatattcttgccttggagtatgattggaatgaggaggtcattgcacagttctatgcgacagcattctttggtactacaaggaagggaaccccttatgtgaagtggttgactgagggtgttaggcacaagatttccatggcatagtttgctgagatgttggggttagatgatgaggatctcaataggcccaacattcatagtgaagcatctctccccatgatcaagaccaagttcatgtatgcaaaggatgctcctaggacttgcatgggatctactcatggattgcatcccaactacaaggtgttgtactccatctttcattggtctttgcttccaaaggttggagatgctactgctttgccatccaagcatgctcatcttctcagtcgcatgcgctacaatcagcctcccttcaatgtgatgaaattgatttggtatgagatcgccaacaccattcttgagcctaagcggggttgcatctatgctcctttcattatgaagatgattgagacagtcaccggggtattctacatcaaagatgggcaccataatccttttcgccctcgtgctccacctttctcttctccagtggtccctcgatctgttccttctacttcagctggtccttctactagtggcccaccaagttcctcgagtttttctcccatcaagaaggcacttcaggcaattttctgtatgtgtgctaagactgccaagaaagtgaagagatcgaaaggcgtcagaaggaagatagaagagaggctaggaaagaagtgtcagatgattctgaggatgaggtctatgttgatccatttgaggcttatgaggcagcccgcaacgttgccggtgaaggtccatccaccttcttcaatgaagaatcttcccattctgatgatgatgatgatgatgatgatgatgatgatgatggtgatgagggtgacaccgaggcagctgctgaggatgcccccattgatgttgatgagggtgacaccgctgctcagtccgatgagtctcatctctccggcgataccgagattgttccctctgatggagatgagtgatcctcttcttctcttcatagtttctcgcctttttggtgccttgatgccaaagggggagaaattgtgaattgaagggggtcatttaaatcctttttgctgccttgactgttgtctggtcatttggccggaagttctggggcctgtgatccggaggttccggccaggcagatttcctctcttttatctctctctatatggacatgtaatcgtattctattatggttggatgtaatgactgttagatgctttattatcctttttatcagtaagttagaccatatggatgttgcattttgatgtgatgatgtgttcttttcatctttttgagtgattgccatgtcatctagtctttcttcttgcatatcactcatcattaagcactcacttctgcatcttatttgattgagggtagtgtgaagtttcttttgagctttcctttgtttttatgcatattgtattcatctcatttcattatatgcatatctttaggaggagcttcacacttctctcatcattcaaaatttaaattctattatctttttgtgtgctttaaccatgttgtcatcaatcaccaaaaagggggagattgaacatgcacttaaaccccctagtgggttttggtgattaatgacaaggtggttaaaggggactaacgtgtttatcaagtttattcacaggagtttagtcccaaagcgagttgggatggctaagaatgcaaggagaccccccccccaattcaaatgttcctaagtgcaaaaatcatcgaaggtggttagactaggtttttcactttcgaaattgagtttaggaaaaaccgtactattaagaggggtttcaagtgtggttctagggtatacaaagtgctcttagtcatatccatgagtcaaaagattttttggaatcatttttgaaaaatgattttctccccgagacagagagggctacccggaggttctggccggaacttccgggcaccgtttatttgcaaaaaatttcctaagtgctgcccggaagttcctggcacttttgtccggaacctcctggcaggtttctagttcaaacttgtgagtaacggctagatgatatcacctagccgttatatatatgaatttcgtccccaggtcaccttttggccattccacttctgttcattcatgttctagggttttctagccactcccaagcttcctttgcttcctccactcaaatctagagcctatcttgtgagattgagagattagacgagagtgtaggagtgttttggagatggcttgaagattaggtttgattgagcactttggataccttgtgggctgtcacttgggcttattactcttggagatcttctcctagacggttaggcgtcgcccatgagcttccaaagatcttgtggatgtcccgagaaagtttgtaaaggtttttctcacctccgcaaggaaacgaggtaagtgagtaaagtttcttgtgctgagttttcagaggttgtcctaggtagagcaacttgcacttgtggccttttctagaaggaattgtgagttggatcttggtggtcactcaattctagaaaacgacctagaagtgttgtgttgaaggctgtggacctcttctaggatctttgcataagtgaggcaaggggttaatcgagacctggctctttggagcacctcaacggagagtaggatccgtgtgatctgaactttggaaaaaaaaatcgcctatgtctctcttgtgcttgatcagtgtttgaatctgctggtatcttgtgattttcatcttgtgcaaccctgtgcctgattttcactagttaggacctgttatacttctcatatttcgtttttgtctgttgcccgaaagtttctggctcaagaactccggaagtttcgggctgctcatcactgccaggaagttccggtgttcatcaccaggaggtttcgggccctgtcaatttaaccgctgcgtttgttgagaaaatttcaggaaagcctattcaccccccctctaggctacatctctgcacgttcagggcccacacgttagttaccctttctcctctctctataacttttctctcctctcaggtgcataacgccgaccggcgttgacggaggcggcggcgggatggagcacgagggtcacgcctcccctcctcgccgaccgtcgctgctgtcgacgtggaggggtttgcctgtgcggcctctgcctcgtcctccacgaccatctccttccccctcttggacaatgccccggcgcccacccacctcctctgcgcgctcgagccgggccgacgtggaagatcgacgaatttccctgtgtggccaccatgctgaagtgcccctccccgcgcttggtaggccgacgagatcctccctgcgggcggccggtggacgagctcttccttgcgcacggccggctgatgaccacctccccatgcgtagttggctgcctcatcctccacgacccccctcttcccccctctcagacgatgccccgacgccctcccgcctcctttgcgtgctcgagccaggctgctcccccgcgtgcggcgcaacgcggccagccgacgagctcctccccaatgcgttgttgctgcgcgatgcctctgtgtcgatagaaggtgagagaagagaaagatgaaagagaaagaggaggagagatgaggtggagaccgctgacaagtgggtcccgcttgatgattcagcaagtcaactaccacgtaggacgaaaccgcctccaaaaccatcctaagagtctgatttgtagcggttttagaagttagaggacgggttatacccggttttcggttgagggatgagatttaaccaagagcatgtgttgagggtggcaaaatagacttattccttgtttgtatggaccgacttcaaaagcccatcaagtatcaacacatcttaacagtctctctctctctctctctctttttgaaaattacttcttaacagtctcatagtcatatgatcttgctacgttagctggacctttgagcagctagcatagcactcctgttattttctccaacaaaagttggatgaagattaagattttcgtggcacgtttttcaaactgctaaacggtgtgtttcgtgcgaaaactttctatataaaagttgctttaaaatatcatattgatctattttttaagtttgtaataattaaaactcaatcaatcatacgttaatactatatcgttttgcgtaaaaaacttaatcttcatcattaaaagaaaagaacaccactatatgatatttcaaaaacacatatatacatagatgtactctaaaaaaattacatagatactggcaagcttacgtcatactcctttcgtccaaaaaaaaaaacttaacctaaaaagggatgtaatgtgatcctcctagaacaacgaatctgacccctcctagatgaacgaatctagactacgctcctaggttgatttttttttattttatttttacagaaggagtacgtgagtaacgtgacaaatagtcttctcgtcatctcgtgtatgcaaagcgtattcctatggccgtgtgaagtaagcttctcagtttttttttttaaaaaaaactaagcttctcaaatactgttgcgatccgcttttttaaggaaaaatttgcttaaggatatcaaaaggcatgaaattagctgagcgatacagtaagaacctgtttatgttataggggcatcgtaaaaaatgataattttattatttttgaggaattagagagagaatccataaaattatactgtgagtgagatggtccctaactaattacatgttttacgggtgtcccgtatagcaaactttgttattttttaatgactgaaggcagctagagagaggccatgcagaaatcattatcattgtgagaacccaaattttatatataacacgtatgattatttcatcaaaacgtacaaactgtatggctcattgtttcttttatgcttatgcttataactcaaaatttaaatttaagaatttaattttaaagtttagtttttcatcgtagtttattttatagcatttattttttatcgctaaggacgcatatataaaaaatttacttagaaatattttttatttgctcataatctattcagataagcatatgaataaacaaaccaatagatatcaccgataaaataaaggaactattgataccacaccatcacagccgaattgcctagtatggtaccgaggcgttgtttgccctcttccaagctgtgcgcttgcaagagggagaaaaaggagatcgaggaagagagtctgatcattggggctagctaggggcatttctaacctatagtcctatgtaactggagataaatattttgacagtgtcttttctaggcataacttttgtcatgtctaaagctaaaaccaccacatcagaatatccggtagtaaattttggctgcatgttttgattgcgtatatagatcattttgactttggtttgcatgtgactacgcaagcaaattgttgtctgaagcgaacaatttatataggttgttacacctgtttctattgcacctaagttcgtgcaccgtagctgtaatttacttattagaataactgcagatttaaaatatgttcaagcttaaaataccaattgtgctgaacaattaatcctcttcagagttcagacccatacagttgctccaatgtccaaacaaaacatgtcaagtctttgcgaacagtactttttacaggaaaaacagtacttgcacttgacaaagtgggctactaatcgatcgattagcatactagtgcgtgcttcattggctgattagctgcgctaaaaagagattagttgatttgctctcgcttttgcggtttcggcagaccggcggtgcaacctctctaatctgccatctcttgtcatgtgccctaaaatgccctgattctgcaggaaggttatcagtcgatttgaaaactgaaaacgaaggcaaacagagtaattagttatcgttccgatattgtgccatatacgggacaaattcttcagtgaagtaacccttcttgtcccgccctggtgtcctgattacgaacagtgtaattttatcccctgatgtttacataccattggctcgagattagcttttagatatggagcataaacctcatcaatgaatcaggtgaagcagaaacaaaagacagataatgccaaccagtcatatcagttgcagtgcatggatggagaggtgcaaccttaggtggatcagttcctatctatcagtcacaatttttgtcagggaaaaaaggcttagattctttgaccatccaccgtatgatatccatgtaaaaagaacgggctttcgaccagaggtacaaagtaaaaattgttttgtcgcttcttttatcgacgttgattggccggtagctacatttcacgcggtcgatggagataagatttatagcgccctgcgactgcgagagatggggataagattagctgggatccgcgggtttaatagcgtcaaagacgatttggtgatcgcgcgcctcgatcgtccggttcacgtcagtgcacgcggtatcgtagctgattcttttttttcttggagaagtatcgtatcctgattcagtgattcctgaatcagagaattattaggaaggagacaaggccgtccgagcttgtgcagagctagtttttgcattgggcctccgctgatccgttcgccaccgccaggtgcacggagcgcagaaagagccacggcatgagcaaaacccacttttatggcaaacaaaataacaaactaagcttatagccaagttagacaacaaaataaaatgtatgacatgtgaaccacgtaactaaggctaatggttaggcaaagtagatttatggcatgaaccaaacaccgcatactaaaactgtgacatgcctaattataaggtgcggcaaatttagtcaccaaccaaacctgcccttaaggcctctccgttggaaaattaatgtgcacatattagtcatgtcttctcgttttatgtgaaaatatgtagcacaatatatatctagtgaaaacgtgaaaagtattattggattaaaaggacacctaatattttattcacatcaccgaggatgaaaattttactaccaaattcaacatgagtaaaagttttacttggaataaatttgtttactcttaatgatgatagtttttaggcttttactatatttatgatttgcactacacacttttctcgttttatagcatgtccatgtcatccaaaatgttactgtgaaattttgaaaaaaaaaagatatatcaatatatggtactctctctttcagactataatcgttttgactttgatcaaagttaaattgtttcaagtttaatcaaatttgtaggaaagaatagtaatatattcaacacaagacaaatatactataaaaacatattcaatcatagatttaatgaaactaatttggtgttgtatatattaatatatttgtctacaaaatttgtcaaagtaatttaactttaactaaagtcaaaatgacttataatctaaaacataattaatatatcaattcataaacacgcaggttcaaattcaacttatacaattagaaagataaaataataaatttaaatttaaatagaatgtgtaattcagtattaaatttattgttataatatgtgtcgaatatattagtcctatttagttacggatggatttggagttgtaatagatggttagggttagagttagaatcggactttgtaacctagcaaatctcttaaatagagagggggcaccacaatgtaaccatagaatgactccataatgtaaccgaatgaggggggcaccaaatgagaaaaaaaaacatcttccttgttaaactatcttaggctgttgagtacaatattagacgctcgtgccctcacccacatactacacctacacttactaattactatcatttattttgctgtgagttgttttatcactaaaagtattttaaacacaatttatatcttatgcatttgcataaaaaagttaataaaacgaaagatcaaacatgtgtctaaaagttaacggcgtgttatctattaaaaaatggagcgaaaagatggatagattagagcatcctgtgattaaaaaaaaaacaattggcatcaattccctttatttgccgggcaactgccttttgtgtacgccgccatagtccctgctgccatatgtatcgagctcggtacacgccgctagcaaaacacattgtcggcggatatatagagacatcttaacggggagactaaataactattaaaaattaagaaaattgataagataaattgatatgtaatatattagtttaaaaatataaaaaatatgtatgttcaaatttgacttttacaaggaaaacaacaaattaaattatactccttccgtttcatattatgagtctccttccgtttcatatcatgagtcgtttgatttttttattagtcaaagttctttagatttgatcaaatttatagaaaaaattaaaaacattgataacaacaaattagttttattaaatataacattaaatatattttgataatatgtttgttttgtattgaaaatattaatatattttctatatgtgatcaaacttaaagaaatttcacttagaaaaaatcaaacaacttataatataaaacaaatattcacgtataaaatttattattttttgttacagttggtaaagtcggatttagatttacatgtttttacacattaatatattttttatttttattttttgttgtaattatttagtttgtatgcaataaatgatttaacgtcgagttaattaagtcttaggtgaataaaaagctttaccacagttatcacacatacacatactcatccttgaccggccaatctcgcgcgccgtctgcgcagaggtgcacatgcaaatttacccccgcacaaaccacgccgcaacacgtagcgcgcggccaatcaaaaaccgcgtgctggaggttaaaaccgctccgcgatccagcgaaccgcggggcgacgcgtagcacccggcgtcacgcgcgtacacaagacgacgagccaaagccagccacccgcgctcgagccgcgtaaaaacgacggtaccatctatccccgcgattaaaggcggtcaattcgctgcagctggagataagatcgattaggaattatagctaggaaccagcagggggttattatcgtgcgtgctccaaagccgagatgtgattagctcgctagccttgcccggccccgtcccgtccacgtcgtcgatcgatcgctacttctacatgtgccatcaccgcaaccatccaaaaccggggaaccagccagacgacaaggccgaaaggcgccgagagccgcatgcatgcgcgcgtgccgacgtctcgaccgaccgatcgcccgtacgtgtacgcgctcgcttacatgcacctttagctttcgatcgctcgcgaggcgagtaagcgaccgcgacggctgtcccggcgaaactgggaggcggtttgtcgcgcggacgacgggggtggcgctgttagacgctcggaaaagggaaggtctcgcgacgagttggacggagatcgttgggaggattagtgctgttgttacagccatgttgctgggggaagacatggtcacatggcatcgacaagggcttggtaactagtctagctttagcctgacaaaaactcgtctacgtatatatatatgcacttcaatgattcaatccatatataatacatactgttgctagcacatgcatcatgcatttgtttttgagtgatcgtggatagatgctttatttctcccagatggttaatctagctatgcagcgtgtctataatatcgttttttcttataatatgtaagtttttgtttacatgtacagtacagcgtactatgtaagtgccgttctatcagcgaattactcctacgtatatacaaggatatatatcaattatatatatgtgcgcatgaaacatcaatgcatgctattaccaggggggctctagatgcatgactttagaagggcaaccccaaaggtatataaagttcatatctcatgggataatgatgaacagtgcaactagctactttctgcatccgctatatatggtacaaacgcatgaagctaacaccatatctatgtgttagctgcagcactactttctgaatgcgatatatatgatgcaaacgcatgtgaaggcaaagccatatgatctacgtgtttgcatgcggcttcttctccttattctgaacatgatctagctggttaggtcacttacctagttcgtacaggtacgtgccctaggagcaatgcggccatatatatgtagtgcatgcattagtgttgtgttcatgcaactactcgatcagtgctcactgaatgcgactgccacacacattagtgtgattaattactagtaatgttgtgctactacttgaaaagccatgcatgtatgcatgtgcatatatgtgtatgcataatgccggcaccttttattcaggaatcccaattcaccctggagagttggaacggatgctggaaattgcaggcggctgctgctgctgctgactccgatggcaacgaggcacccatgatggcttggtgttgttggtaggttgcaccctgcacgccgagaggattgataaatgcaggcatagtgtttgcgccattggcggcgtcgccggtgtcaatggccacggcgccagcctcagacaggctcctgtccaccgtcgatgacagcgacatgtcgccgatgtctctgctactcctgcttagcccactaggaaactccttggcccgtggaaggaatgcctcgaaccagttgaatggggttggagacggagcaagaagctgcttggtggcgtcgcacggtgtcgccgccgccctcgccgccgcggcgagctggctgagagagctggcgccggtcgagaggccggcggcgtcctccgcggtgagcaggccgtttacgaggaaggtgtcctcgtggctgtcgtgatggagcagtgaactgtagtcgccgccgtgcgctgcagcaactcctccggcgccgtccgaaccggccatgccagcagcagccgtggcatgctgctgcgacgacggcgcgtacgcggccaccgcgtcctccacggagtcctcgcactccatgctcctctgccccgcaccggccttgttcgtcttcttgtatatgcggcacagcacccagtcatccagctgagacactaatcaacttgatcagatcaatcagtccaagactccaagcgagactgtcacgcacaaacgtatatacgtacgtaccctgagagagacggcgcccttgctaccgccggtgatgggcggcggcggccgcctggtcgtagcgacggcggcggcggagctagacgtgtccgtgagacggtactcgtgcatgatccagttagtcttgacgcccttgggtggcttgccccggtagaacacgagcgccttcttcacgccgaccttctcgcgggtgctccccgacgacatgatgggcttgtcggtgccggtggccttccagtaccccgacgtcgccgcccggttcggccgcgccccgttcgggtacttgcggtccctcgggctgaagaaataccactcctgctccccgaagttcgccttctctgatacaaaccgatgcatgcacgcataaatcgcacaaacaagtaaacgacaccagatcgatcgatcgatcgatcgatcgagcactacacatccaagctagcatgctcacat

SEQ ID NO: 23909 - DNA, 4099 bp, Oryza sativa
atcgatcaccctcctcacacacacacacaccaccaccaccaccaacacacgctgtctagctaagctagtagctagatccctcatccaccgggtgtatatacagcacgcacagtaaagcgagcaacagagagaagctgtgtggctgtggtttgttgcggtgtcggttaggcggacgggcaggcaaggcaggcgagcgatctgcgctgggaattttgggcggtttcggccgctgcgctgcatgcatgcaggatgctaagctagcgagcgagagggatcgaggaggaggcgatggatgaggtgcgggctggcagtggcaaggcaggcaaggggggtgcgcgcggcgcgcggtgtggggagaggcgccgaaggcattggccccgagaaatacggctccgttgtaccgaacgcggccgccacgggcccgtcgccgctggacacgtatgccggccgccgctcccccaccgcgtgtcgatcgatcacctcgccacccgcccgcccgcccctcgcgcgccaacgtccacccatttcctgggctacacacggcccagcgtatggtaacctcttccaccgtcttttctggcccaatttgcaccggcttactaggcctccttttgtgttggcccgtttaggacactgtctcgctttggacaacgcgaagcagtttaggccatgggccgcgagtcgaagagtaaaagtatactggtaacttttttccctgagaaaaagcacaaccttttggacgttgattagcatgaaaattcagcgtgtaacctttgattattatcatttcttccgttgttttttactgtgactggttgcataccaaattaccaatagaatgttctatctctgcgatatacccgggagacacggtacggtttaatagaactatgaccccaaatgctaaaggttcacacactgtaatgagtgggtttgaatttcggacaaatgctgcttctggattttggttctagataagcaggaggagtaagagcacggataattgcggattgatgaactccggtctaatcggtgcgaagcgacaccgacaaatgcacaaagtagtttaatgtgtgtgctttctggacatatgtacgttcttaatcttctgttttgtctgtttccctttcagaaaatcaggtttcagagtaagttcatccatctgcatataaaataattaaactgatgaaaactttcctggtattcctaaattgctcgccgtcgccgagttgaaggtttgaatttcttccgtccatttctgcttaattggtcttccaaataaattaactaagtaggatactaattattattgcaacattactgtcatgagtccctgattgctggataagaccagttctagatgcaagaaccgtcgtaatcggaaattcaaagctaccccccattaattcatagatttgtgacctgaaattgactgccgatgatgcccgttgcaactattacacgggcaacgaataataattggctgatcatgaaaaaaaaaacgcagaatgctgtacacacattaatgacttggctgcgtttggagcgattcagcaactgctgcatgcttcccttaatttggttgacctttgatcctgtcaattcttgatcgagacggacctcacgaattaagaataagatggccaatttgatggtgtgtcgagagattagtcaaaatttccccttgaacatggctgcgtgcttcttttttttgtccatggctaatagaaatgttcgccgtgtctgacctatgaacagatcctaaactcgaattaatgttgaaggagatagtactagcactctctggattggattagtcagagggtcagacagcggcagccagtctttgcgatttctgttgctccgtgggaaatagaaacaacagatggactgaacctacagagaaaattcggataatttgatatttcagaaaaattcaggattcgacacttacccattgagcagggaatcgtagtatacaagtgggaactagaagtagaataaaagcaagtactacctctgtcccaaaataagtgcagctgtagatatttatgtccaacatttgaccgtccgttttatttaaacaatttataaagaaattaaaaaataatcacatataaagtaatattcatgtttatcatctaatagcaataaaaatactaatcataacaattttttaaataaaacgaatgatcaaacattaaatataaatagtgaaaaactgcacttattttggaacggaggaagtatggattaattatatcagatattaattaatgcaacagtttcctgtttcctgtttcctatatctttcttcgatttgctctgctcagtttgattattgtgtgtagatagccaataaccgtgtacaagtggctggactgccggaggaacgggagctttgtctgagccacatcagattgtaattgtcagagcgagcatgcttggaattaaactggaacaggtgaatgggttcatacaaatttcaatggcgtgtgttctcgtcgcatacatcacagtaaaaaagaaaatcttgcacttcggtggacgtgacaatgcaggctttagttgcaagtaaattcttctgaacttcatcatgccactacatttgtcaggaccgcgtcttatgttgcctttgtcagtcaagttgttttgctgtcacgttttttctcgtaccagacggagttacatttcacacaagcgcgcctgcagccgatcagcaataagatattactccatccgtttcacaatgtaaatcattctagcatttcccatatttatattgatgttaataaatctagatagatctatctatcatcaatatgaatgtgggaaatgctagaataacttacattgtgaaacggaggaagttctgaacattcgtagactagatcatggaagacagaaaaactgtgacatgcaaaaagtccttttagaagcacagttaaattttaccctttcctactgcaactgctatttccatatgcaaacaggaaacggtacttcgccggcctcttgagcctcaagtacggagcagtacaagatcaaagcagccaccgtcactaactctgacaagcttgagttgtggcgcatgcagaagctgctttacaacttcccaaaataacagtgcaaacttagacccgttctgtccgggggcttcggacaacgctgtcaacgcacaagatgagtccttcctcagttaatcttagatcatgcgcactgaccacacgatcgacagagaggaataatggtcaaaacgtcaagcagacggcccgcacgcacgcaccgacgcacgcaccggcgcgccgcgagggggtgtccagacaaaccggcgtctgtcacctacagagaaatcctgcggggatcgagctaggcgcggacgtatgcagtgcagggcagcgagagacaggtaagtatacagtaggatgcacggatggatggatggatcggtggcgccggtgccgtcgccggcggcgtcgtcgtcgtcagagtctcagagatggacgctgaccggggcggcgcacgcgtgcacggggccgggggggcagaccggcagaaggcgtcaatgctctgtatctagcacgagataaacgcgcggtacgtagcagttcgtggtattcgactaatactctgctctcgctagcgcgcacgcgccaaacaggagaacagctcgagcagtggatgtagcgggtgaaaacggtcacagaaattcctatcgactgagcgccgtttctgcataaggggtattgtttataaccgtaccattttctgctatttttaaattttattttttaaatttttttctatcgtattaatatcgatacagggtagtttgaatgataaatatggtttaccgattccgaccgttcaccccggtagctgcctcagccctgccttggcggtgaaacgcacggacatgcatgcggaagagatgacgcggcggatagggcgtcgaacgggatttggttaagtggaatctgatccgggattctcgaccgcgactcggtcgtatatattcgtacgacggtacgaggaatcagcgatcgaggagccgaggaatgttattctccaatccgtttttttttcctgggctgcagga

SEQ ID NO: 23910 - DNA, 9772 bp, Oryza sativa
ccgggattctcgaccgcgactcggtcgtatatattcgtacgacggtacgaggaatcagcgatcgaggagccgaggaatgttattctccaatccgtttttttttcctttttacagtttttgttggtcttggcccgagaattgatattgatttgttcgtagcgacgaattctgtgcttgtttcaacgttatatcgttgtcgctctgtcagcagcaacaagctaggtcgggaggaaggggaagacgtcgcgttccacggtgagttggagatcgatcggtgcacgtcgcgtggaccgcgacaaggccgcagggacagcgccgtgcgtgacctcctgtcgcttcgcgtagggtcatgcattgctgtgcctgtgccagtatgcgacaccaacctttgccaatatagcgtcaaggccgccccgcgcgtgatcgacaactggtgccactttgctctcagtttcaggcggccatatacagtcgcaaaccgtgacggcttcattaattacgtgcttccattttccattgctagtctcggaatgccatttatatttagtaaactttagccacttctacttcaataaactaaaaaaatattataaaaaacatactatcttatcaaagttatcaccgtcgttcgtatggaggttgcagtttcaaagtggaaacattaagaaactaggtggctgatatttttagccatgtaccgttgccttttcgaccaagagattattgtttctactttttttttaatcttcgatcatcgtcactcatgtggaagttagaatttcagagtgaaagcattaagaaataaagtagctgagtgtttttaatttgtaccctattatttcagatcactgtcacttatgtggaaattgtaattttcaaagtaaaaaaatcaaaaaataattaggtgactgagtttttccttatctatgcgtcattgcctttccgattaatgtttacctatcctttttttcatctctaaccgtcatcactcatgtggaattaccgttttcgaagtgaaaacataaagaaatttaggtgggtaacttcttacttttttcttatctacatgatatgccattgccttgtcaaccaacatattaactaggtgataccccgcgctttgctgcgagatttatggataagtatatattaaatattgtcgaaatgatgaaagttgaaatgttgaaaaaataatgtgagtaagatgatttgacacatgcttgttgatgatgtgttatacttacatgagatttaaaataggctagaatagtactttctagtgagtgaagatgttgcatgcttgtataggattttaaatgggctagaatagtaattgctagtgggtgatgatgtggcatacttgcatgttgagttttaacttttaataattgttagtgggtaccgactatatagaagactatatagaaagtatcgatgtgtagcagcactcactcatgctttgccaggtgaaagagaaaaaaagttattccaacttaaaacaaagtattgtaatttggcaaatatctacaagctagtatagatataaaaaagctaatgtgcaaaggcattcataaaaattaaaatacatttaggtgaatccgtacatgtaaaaatccacactaaacttaaatcaggttgcaataaaaaactatcaaattaatttgaaatacaagcttatgcatgcatgttacttatatgcactacaaattaaacaggagtgtttttctgaagataacttccatatgatgcatgcgactgttagtatagggtatatagcccattctttgactgccaagtgcaaacggaaatgttggaatagtgtcaaccattcagggcatgcgtggactattccaaatctaatacaggccattcaacagtctttgcacggttattctaaaattaaagcacctagagggtgaccatagttatgcatcgaacaaaatctaatcttataactagggcaagaattctccagtgaaattcaaagcattggtcttaattccatggtctaaagaatgtatggatttaaaaatgtgaaacatttgtgtggagattatgggtaccccatacccacacgacatggttatccgactagtcttaggggatagcttatatctatggaatatgtaacagatcatgacttgggtattacgtttccctgtatattatggaacggcctaaagtcctggtttgataagattgtaaagtagatttaggaaaccgataccatgttggttaaggtttctatcttgtaatcctgccctccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagttatctatcaagaagcgcgatggaatcaactttacgagtcgccggcttcgtcttcacttcgggagctgcaacttcctcgccgccgacgaattccctaagcttttcttctccaactcagatccaatctagccgggaagattaatctcggcgatggatccaatcaccgtcgccgccgagtcttttctttgatcggcaagaccggacgtcagtcaccgagttttgttcttgatcagcaaaagatttgaagccaacagctattatgagcctccataagtagttgttcctgtcaattctattttatgcaatgagatcaaatctgtcgccatgtgctgtcaagcaacagatcaagcatcagcagaaaacatgcatgcaaagctctgaagcatcggcgtctttcctcgtcgacatcaaaatttgttggcgagattcaatttcggaatcgatatggactccaacccagctgattggagcaattgtcgcacaagggcatcgatcaagccacttctgtccaagccatacatgcaggtgcatgatctacctagacagatacatgcacgcagcgacctttttgctggagtctctgattcaatcaagcaagccatacaccgctgatgacatacatgcattaaaaatcttggattacaagccaggtttatcgttttaaattctttcgcaaattagattaattcacagattactaattattgtttgatctgttattgtttatgcatgtatgtcggctgctgtcgtcgccgctggctggcttctttgcgtacatggctggtgtactctgccaccattgctggtggcgacattgtcttcaccaaccggctgcctccgtcgccgctgactggtgtcctcgcctatatggttggtcggtcacaccaccgttcatgggcgtcaacgtcttcatcgaccggctagccttcgccgccgccgactggtgtttccgcctgcacggctggcctattatgccgccgctgttgggcgtctacgacttcaccgccggcctgcctccgtcgccgccgagtggtgcctccgcctacacggttggcctattatgccgccgctgttgggcgtctacgtcttcaccgccggcctgcctccgtcgccgccgactggtgtcctcgcctatacggttggttggtcacaccaccgttcatgggcgtccacgtcttcgccgaccggctggccttcgccgccgccgactggtgtttttgcctatacggttggcagacttcgccgccgttaatgggcttcatcatctacaccactggcttggttccactggcgccgactggtgtttttgtcaccatcgatggactgcttcgttcccacatcggctacttttgctgtcaccgagggaatattacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcagaataaatcaaaagcatagagatgagataaatttattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacacatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccgaccggcttgccttcgccgccgccgactggtgttttcgcctgcacggctggcctattatgccaccgttgttgggcgtctacgtcttcaccgaccggcttgccttcgccgctgccgactggtgtttccgcctgtacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgatcggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccagcttgccttcgccgccgccgactggtgcttccgcctgcacggctgacttattatgccgtcattgttgggcgtctacgtcttcaccgaccggccgcctcgaccgccgtcgactggtgtttccgcctgcacggctggcctattatgctgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgcccttacctctacgtctggtttatacagctaccactactgatggacatcatcatcttccgtcgccgactgattatgccgcctccgactggtgcttttatcttcacaactgcgcgtcttcactaccggtttgcttctgttgccgccgatttgtgttcacttcattacggcaatacaactttgtcatcatggtggagcgacttcatctttattatcttcggcaccggcaaactctattgttgctacttcgcaagttttactacatcaccaaccatgacgttgttgtgaatctcgacatctcggcatgcgatgccgtgttattttactacaacaagtggctctccaacattcatgatttctacttggacatcttcaacacatatcttcaatcaagcaataactattcgacgacaagatgctacagttctcgactctatgttcagttgtttcccaactaatcaaagagtcgggggctacacaaatacaaggctcaaaatttgacaaattttatgtcaagctgaagaaatcaattcatcaaccaacgagtcaactccaggagtcattatcttcatctttgatttggagcagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccacatgtgccatatatttccaggtgtggtgaaacaatgtgtcttttatggacttaagcacatctgttaaagcagtgtgcgcatggcgtatgcccaatactttgaaaatttctttattcacagcattcaagcttctttatagttgttttgctatgtgaactttcaaagatgttgtcaactttaggttgtacgcatcatattttgccaagcagtcggtatatcacttggatcatattattcggggattcacaccgcatatgctatacattgatatcaagtcacttggttgattacaattatcaaaaccactcggttggttagattatttattccttgactatatgtttggttggttcaattaaccacatagtcgggggctacacctattaggtgcatctattcgatgcacctgactatatttttcagccctccacagtcttcagatttggtaaaagtactcgggagaccatggcgaagataattgaagcactcggctttggagtaatctagttcgagagaaggttatcttttcggctgtgaaggtctcaggggctactgtggagattatgggtaccccatacccacacgacatggttatccgactagtcttaggggatagcttatatctatggaatatgtaacagatcatgacttgggtattacgtttccctgtatattatggaacggcctaaagtcctggtttgataagattgtaaagtagatttaggaaaccgataccgtgttggttaaggtttctatcttgtaatcctgccctccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaattcatgtttcgacaatttgttttcttctaaattaagatccaaattagaggtattatgaaaccatgtgcagtgtggtatagcgtggagtggaaacaagagggggccgggtcaattcttttccattgtatctatgccgtccttttccctcttacacgatccatctctcctcaactttacatttaattacacaagtaactaattaattaagggagagagaaaagacaccatgagtgcatgaccatgaggggtgccctttgtggaggggtaaggtatttacgtagttaaaggcagctttggaacatttagatttaaaaatactccattcatcccaaattataagacatatttttttacatagtctccaatgatatactttgatcattaatttattccatactatattccaataaatatgaaattagcatcacacgaaaataatttaaattataaaactagtgatataacatgcataatacttagcatatactatatgattagtatgattagcagttaaaagttaccgagtttaatttttattataaaaaaagggtgccctataatttgggacggaaggaataataggtattagtgttcaattacagatcaatgtaaaactagagatattttaccgtctttaagggagtattatatatagtttttaacatttaccccaaggtatgtactcccttcgtttaaaaaaaaagacaacctagtattagaatgtgacatattctaatacaacgaatctagacatagagtatgtccagattcattgtactaggatgtgtcacgtcgtaggacgaggttgagtcttttgggacggatggagtatacatgtactcctacaagacatgattcatgcacgcgtctaatttaagcagcattatatctaaagtaagtttcttttatctagtactttatatacaaatcttgagcactactgcaatatctttaa

SEQ ID NO: 23911 - DNA, 21682 bp, Oryza sativa
  unsure (1)..(21682): unsure at all n locations
tcctgcagccctccatcgatctgttcctagctaaaagaaagtcattttaggttattttgcttaaattaatgtttgaaaaaaaaatagacttagcgctccttttttttttttgaaaacatagtgcttcttattaaatgatgttttatggggagtgggaaggtggagaggtagaatgtagagaaatttgaacttaagggtgtgtttagttcacgctaaaattagaagtttggttaaaattgaaacgatgtgatggaaaagttggaagtttatgtgtgtagaaaagttttgatgtgatagaaaagttagaagtttgaagaaatagtttggaactaaactcggcctaaggtgattgacatgataagtactactctatagtgattatatagtaactttacttttgatccagaaacataaccaaaagttgatatatttttgggtagagaggaattattctttttagggtggagcttaggtacactagtttttttccccttgcagaaatgatatggaaatgcatgcatcgtacgttaattgctactgatggtggagatgaattttttagaagtactcaacggcttaataggactcataccggtgaattgatctggtattaccgccttatgttttttagtgaaagtggaatatattgatgtaattctccttgcaaataaaggagagaaataatgtactaccggccagtggataaacagcattaattaattagttaatacggtaaaacctggtcaagtagctagcagaagttgcatagaagaaacattaatgcgtggttaaattctcaggatattaccttgtgctacttgacttaataactgaacttaatttatattccgtacagagttgagagcatgcacgcgtgtataagaattttcaagagctttgcatattttctcatatacgtagatagaataatccgcacaaattaaataagtacgaatacttttgaattttgactatcgataatttctttgaaatatttaaaaacgtttgagcattttatatttttttaagaaaaaaactatatcataatatcatatatacttattttcccaaaatatattagattttataaatttaatttaatataaaattgatcaaagttaacttaaaaaattaaaccagaattgtcttgaatactatttatgagtggaacgagtatattactaagtatggttctaacaaaagatatgaagctaggggcctgttcggcaagctgggctgctgcagcccctgctatcttgtggcttgccggactgttcaggtcctcggctgccgaacatgccctagagcaatggctgcaatgcagtagaggctgtaggttaacctaattaacgctgctgaaagtattgctacgtgcaggaatttatttttgaacgaaacgtgcaggaaaatcaaactgaagaaattgaaatgtgaacactaatactagttcaaaacgaccatatccatgcatgaacgcttgaataaataccagtagacaaaaaacaacgacgacattaataaaggcgggagacagaagtttgaatccagtcctgccatgcaaagagtggcagactgttaaaaaagcactgtatttttaatttattggtgtaatcatgtaaatacatatacacatatgcacataattatttgcaaaaccctattctcatgcacatatcggcatggactgcctagctagctagtcactcagtgctgcatgcattgcttatttttacgtatagtaccaattcaatcctgcagattaatttatttacccaaaaaataactaactagaaaaaaaatgaatgaatccatcccaagttaaatgttatttgttaaattgcccccggtttttcttagtctcgtcctctgaattgtacatggtgaagccgcgatgaaccattcaaattacagcctggacatgatcatatgtcttccttgcgtgacctcatgcttgtctatgttctccaaaactgcggtagccgccgatgttacgagctctgcaagatctctgtagaggcagatcaccattacaaatgcgtcagttgcgatcaaacgagaagctaaccgagcttagctactaagtatgagaatataatggcgccaaatggctgcagcattttaaacctaccctgtggctgtgtcgtaggtgaggccgactgtgttcttgacctcgcgtagcgcgaatttgaagcgttcaatgtcgcggggatggtgagcgacggactcgacgacggcctgcgggaggacgagatccgagggtttgatgttgtaaaacaccgggatgatctttttccgtgactcgacgaggagggcgagctcgcggaggcaatactcggagtcgcagtagtgcggcgagaagatggccaccgcgacgccgcactggctgatggcctcgctgatccgctcgtcgaggcgatcgccggggcgcattgactggttgtccaggaaggcgcggacgcccgcggcgacgaggcggtcgtagaaaagccgcgccaccgtcctcttggtgtccacgcccctgtggttgatgaaaacgtcgtagcgcgcctccccccgcgcatcctcctcgtcgtagtactccacccgtctcgccaccgccgccttctgcttctcccccctgctgctgctggtggccgcaaccgccgcctcagccgacgcgtttagccgcgacgcgatggtgcaccggcggccgcgggaaagcccggtggacgacatgatcaaacgaccgatatatagctagtgatatcgatcaagaaatgtctcctagaatactgcgagagcgcggagaaatccaagagtccaagacgttctctagttagctgatcgagctgccgcgatcccgatcaagttgatcttgatcgatcgaaacgtctctgaacaatttgagtggaagcagcaaaaactccaacaaaatagagatcgatcgctacgagttagtttgtgaattgtgatgcctgatatgtggatgaggggatgggccggcatgcatgcgtttataaaggattgggttcggggtggtcatggtcgcatcgcgcgcgcatgggaacattttaattatgacatgaaagtactgagtaagttatccgcgcacagtccccgggcggggaaatttgttattttaatagtcagatttcgctttgagtagtattatcaatccaaagatcagaccgtcgtcagtccaccgtcaatccaccccgtggcttatgctaagacggactatataattattatgttttctggtcccctatatatagtacaacaaacagatattctgcatgaattcagaccaaatattatacaatccaaagagcgattcgctacttttcaagctctcctctccaagcaaaagcatatacattactggattttcttcgctcgagcgtttcaaaagtttgaattttcctcgctcgagcgtgcacacacgcgttgcgttagacctgcagatctttgcagtattttggcgagactctgcgcagcgtgcagccaaaggcaaaaaacactccgtgcagaagattgaatagaaattttgtggaggtgagaaccattcaaatacttgaacgacggggctacgctgaactgcagcaatcaatgggacaggaatactactgcaacgatgtttggggtcgggaggaggatcggaggaggggggagccgtacgatcgccgggtgacgtgcgagagtgatgacgtcacacgttggactgtccccctctcatctcacgtgtctgccccacggtttgacttattgatgcgttcaaaagttccacgggctgctgggctggctgcgccaccggtacggtcgctgtaataaaatacggaattgctaaactacagtcaatagaaaagctacctctaaatcttataaattttggttcactagatatgcttcgcgattcgtgctccaactgcttcttcttcaaccccaacaaactcctcttcttccccgacgccggcgataacccaaactccggcgaagggccgacgaattaggttcccggggtagggtggggttcgaggggtgggaagggaggaagaagggggagttcgccgggcttagagggatggtcgtgggcggcggcggcccggaggtgggcggcgggtcgggtgggcggcgaggcgccggcggcgctgccggagccgcagggctggaggagggcggtgggccagcgtcggtggtgggggcatctcgccgccgacagctcgaggaggaaggaggggaggagggaggagaaggagggggaggaggatggtaggggggagggagtctcgccggcgccgttgacgccctccagccagccggcgaggcgggcggcgacccggtggggtggtggcggcgggggatcgggtggagctgcggaggagctcgcgagcgtgatgggagggaacgggaggaggagttgtagggttaatgtatcttcatgaatcataaagcacatccaatggttcaaaaattgaaagatgggaggtgggattttctgtcaacagatgtatagatagtcccaatataataataataataataataataataataataataataataataataataataataataataataataataataataataataataataataaagaaaaggtgaactttaaccgcaccatcgtcgagttgaaatgaagtccacgaagattaatttttgggggtttcgggtgtacttctaatttcgataatcgtttccttttgaatgtgaaattaatttgatatatagtcgaaggcacgcaatctgcttgataatgacttgtttggccagaaattaatatgaggaagagacaaagtgtaattaaagacttaggagtacgtgtgttcctagaaagtagacatatgtgtacgagtgtacaccatgtctattgatgtagttcaaaaaagccgacgttgaatactttatttgttcatgcaaatacattgttattgatatgttttaagggaatacttcaaaaatgtttgaatctcaatagccttttagtcgtattgaagatacttgaaattggtaaattgatggattatgtggtatttgtgatagctgtttgaggatataaacgattgaattaaatagcataaagttgaaaagttaggaaacatgcaaacgaaaatcccaaatccagaataagaaaagaacgtggctttaaaactagcattggattcatgagaaacttatttgtgtatttgtttagaaaataatattgttatattaccaagttaataaaataattatgttacggtaattccttcgttccaaaatttgactcagtcacgtaaccattttttaattttaagttcgaccaaatttatagaaaaagcataaaaacatttaggggttgtttatattgcagccaaaataaaccttaccaaattttggtaatgccaaaattttggtaatttggctattatgtatttactaaagtttgataataaactaaatgaacgcatatatttggcaactctatcaacaaatgttatgatttaaaatggcatcaatctgaacaagcccttaagcccttagaacatcaaacagattatatacatatatttagcggtggatttaataaaaccaacttggtattgtatatgttgctatattttctaaacttaaagatgtttgacttagcacaaaaccaaaacatgttatattttaaaaaggaaggagcagaaattagttgttaaaattatattttcaagactgtattgatacccaaaagacacatttctaaggatagatggagtaatacactaggtttacatataattagaataaccactaacacagtaagtttatatgtaattagaatatcaattaattaaatgagaacatgcactggcccaaaattctgtattagacttggactataatttaatatgacgtatattaatttacataaatatgattttccatctctgtataaattaagttggttattcattggttatataagttggttgtaaggatagtggtagagccgagctcttatcccagtccctgttcttaaacaaatactcctaggtaccatcagtccttaaaaaaacgttatcatcattaataggtaccatcagtttgtacctacatgacgactagtatatgaactgatcacatcctaactagctcataatcatcacctagaagtgcaggttttggcataacttcgttaacaaatatttcatctcgatattatcatcacttggattttctactatgttcttacttgtttcaactaccgagatttatatcaattcatagcttttataacacgtttctttactatcttcggtgttccttatttactgtactcttactttcaataggatttaatttacatactccctccgtactagtaaaggaagtcgtttaaaacagcgacacggtcttcaaaacataactttgactttgtgtttctataaaaatatttattgaaaagtgatatatgtatatttttatgaaattatttttcaagacaaatctattcatataatttttacattttcaaactcaataattttagaggtattcacgatttatatttccaagatttgatttaaacattgtcctaaccgacttcttttacgagtacggagggagtataaccgctacaatttgtaagttctaataatgccctggctttcacttttaacataaataaatccacttccaacttaagactgtgttgttcagtgtttattgggtacctactacctcatttttcgtaagcacatatttcaaaatgctaatgctcaactcaactaatcctatgctaataggtcttattgttttgtgtgctgtgaaaaagcctaaccattaagccatatgaaatgaatcatgattaagtggttatagttcttgttgagcagtgcaaatagtcattcctatatttttttatagaagatctattccctcttaaaaagtcaaatcctaaaaataaatttggatatataagattcatctcgaggattaaggttttttttacagagggagtatgttatacatctctactattataaaaattgaagatgttttgccagtattttggtacgttattcgtgtatgagtcggttttaagtttgtttgcttttggaaatacatatccgtatttcagttggtttttaagatagttcacttttggtaatacaaaaggaatcatataaaaaatctgtttaaaaaactcacatgttaacttgagacaatcggactcctatctgtagctcatgattttctaaaagaatatatatgcacgcaaacttccacagtaaatttcatcttaaataaaccatataacaataataagattaaaatagacttcacccgttacaacgcacgtgcattttttttctagtaccataaaaattctcagtcatccgagtaaacatatctaatttttactactactaaattggttgtactagatggttgaacgtcggggattttattggcttgaattcctgcacgcatacatttcctaagtttccgataattagttgacaacccattttccaggcaaacgttaaatcactagtgctggaatctgaggatacatttttggagaagtcaagggacatgtttgctacacgcgctgagtcaccgaccaatgggacccacccctagcccggcacgtcggaaggccactaccgcagtgtgcgccccaaaatcgccgccgtcccccgtctcactccccgccgttctcctcctcctccgccgccgccgccgtcccgcccgcccgccgccaccgcccacatgtgggagcgcggcaggctaccccgcaagccgcgaccgtcccctatcctcgtgccgccgccgccggcgtccccgccgcccccgccccgcctcctcgccttcctcctccctagatccctcctctcgctcgccgcccgcgccatgccgtcgcgccgcccgtctcccctgctcctcctcctcctcgcgctcgcgctcgccttcctcttcctcctcctctccccatccgcgccctccgccttccacctttccagctccctcgcctccgccgccgccgccgtttccactcccgcgtcctcccctcccgcccccgtcaagatctacatgtacgacctccccgccaagttcacctacggcgtcgtccgcagctacatggcggcgcgcgcccgggcgggggcggcgggcgcggcatcggcgattcccgacgacgagctgcggtacccggggcaccagcactcggcggagtggtggctcttcaaggacctcaggcgccgcgggccactcgaccgccccgtcgcccgcgtcgacgacccggccgacgccgacctcttctacgtgccgttcttctcctccctcagcctcgtcgtcaacccgatccgcccatcggcggccgccgccaatgcgtccgacgcggcggagcccgcgtacagcgacgagtccacgcaggaggagctgctggtgtggctggagcggcagccgtactggcgacggcaccaggggagggatcacgtgttcatctgccaggatccgaacgcgctctacagggtggtggatcggatcagcaatgctgtgctcctgatctccgacttcgggcggttgcgtagtgagcaggcatctctcgtcaaggatgttatcctgccctacgcgcaccgaatcaactccttccaaggcgatgtgggagtcgaaagccggccttcattgctattcttcatgggcaaccggtatcgaaaggaggtgaaattcttaaatcttgggagaaatgtgatggcttgatcaattaatttgcattgtacctatcatagagcatctgcattttcagaagggatattgtatgctatagagtagagagtgaatttttttgccatatcctagataacattagcattgaattttattggtggttatatgattttccagagcactccaaaatcatgttaactttatgtcttaagttgatggttctgtctgagaatttttaggcaatcagaaaaaaaatgaagcttaatatgccattagctcattatatattttttgttaccatgtgcctttgatttagcttgtttagatgagttttcttacatatattataaataggaaactatcacaaatgtatcatgtgcaaacacattaattgatatgagatgattattaaaaaaggtgtgattgatttttcagtttttacatgcctccttctctagcgaacttttggttctggatatatctgttgactggtcaacaacctttcttttagaattcaagtcaaattgcatgatagcttccacattttgcaagccatattcacttagaaagttctagcctttcatgcacgttcttgctgattgattatttttggtgttctgttttggagagatcaactctcaacatgaactcgtccattcctatatttttctacttgtcctcataattttccttctttcacacatgcaaaactaagttggaaggcatgtctcatactattaatgactgaagatttctgcacatgccctggagcctgggcatatttattgattggtcaacacatttctttcataattcaaatatgattgtatgataggtttccacagctttgcaaaccataatatttagaacattctagcctttggtgcactttcttagctggcccatccattagtttttcttttaaaaatcaagtacgattccatgatatacttctacagttttgcgagccataatcttttagaaagttctagccttccgtgcacattcttgctgattgatccattagtcttctgttttggagagatgaactctgccaacatgaactcttttgttcctatttttgtatacctggtcctgataatcattcgtcttctgcacatgtaaaactttaatgtttgaaggcatgactcgcagcatcccattgctaaagctttctacatgtgtacctaattgtataaactatttgtctctctctgttccaatatagttgtttggaatgagtgcactcaatcttggtttggaacaacagagaagttaagaacagtatcatctgaagcagtaagctttggaaatgaccaattatggaaatgtaaaaatgtttgattcatttgcataattgttcatctttgtttccttgtgagttttaagattgttaggccctgtttaagattatacatatgattcatattcatccttccctttatttttgctgtattatttagagcactgctacatgcactaaaattttcttacaaagctcttactaacaaatttctcaaccatttgatttaactagatggaagttacaaaaaatctagatttacttacagcttgccacatcagagtttgtaagcattttgtaagaaaattttagtacgtatagacttttcctattatttatgttattgcctacagagtttactgtcagtctgtcattttcttttcttcctttcacactttgtttatgaaataacatcttatactaaggttgttaaccttctgataatttagggtgggaaggtgcgtgatacgctgtttcaagttcttgaaaatgaggcagatgtaatcataaaacatggagcccagtcaagggagagtaggcgtatggctacacgaggaatgcactcatccaaattctgcctccatcctgctggagatactccctcggcatgcagattgtttgatgcgcttgtcagtttatgtgttcctgttatagtcagcgattacattgaattaccatttgaagatgttatagattacagaaacatatcaatatttgttgagacaagcaaggctgtacagcctggatttttaacatcaacacttcgaggaatcagttcacagaggattctagagtaccagagagaaataaaaaaggttaatttcatctctctctcatagttgatgctgccatgtgcatattacattcagaattagcttcgtgggttacattgccaggaaaagagagtgagaaatacataaatatttagtatctgcaccttcagttaattttgtgagcacatgattcaggtttaactgcttggtacatttttccaggaagataaccatttttctcctggcatttagtacgaaacattggcaatatcttgaatcacctagttgttttcagttattttgcaattttggcatgttatacatatgatattttggcacgttatagttttataggcatgttatacatatgatattttggcacgtttgtcttaactagtaaaacctgaaattttgtttcaggtaaaacattattttgagtatgaagatccaaacggaccagtgaatcagatatggcaccaagtttcttcaaaggcaccattgatcaagctgttgattaaccgcgataaacgcctagttgaaagaggtaccaatggaacagattgctcgtgcatctgttcgaccacgaaggaacttctacgtaaataagatggttctcatctcctggacgaacccaagttttgtggacgacccttctgattgagtacagtacctgaattttggctgacgctgagctctgtaactatgtgcagcgaggatcctaacaatttgttttgattgctaagcgcccatttcctgctgatttttcttcaattttcagtagatattagaatgttgtgaacaatataacaccactggtgcccctggctaaagcagaagtatatcattgttttcttttgtacgtgtgacttatatacatcctacattcctttttctcccaaggatgttaccctcaagtttacatgcctctgtgttacccaatcgaattgtgcaaggtacttgtatacatagaagcaacagagacagagggcctcatggaggctggagtgtgacggagagccacaaagccccatgagcagctgacactgctcggtgtgcttcggcgtgcgagaagccgtcgagcaccgagaactactccgaatgtgtgaagagaaattatggaaaagattaatatgattttttttaaaacaacttttctatagaaacattttagcatcgtttagcaggttagggagggtgaacgtggaaatcgaatactttctcttctgtcattcaaatgaacgcactcttagttattcataaaatatatgaataagataatttagttaacaccattcaataataattgtcagactaaaaacatgtaataattacaattttacaacttttagcacagagaaaatttagaaaaaaagcaagagttcaaataaaaatacaatttaaaagaactgcaatttgaaataaagaataaaataagaatacatctaatccaacataagattaactaaaattcagaataaaaaataaaataaattctgaacttagttttttcaacatgaatctatccaaaaatcagaatcaaaaggatcattaaaacttgaaacaaaaatatataataaaaataaactagtaaagacaacttaccaagaaatacaattctataaatatccaaaagtaagattaaatacaatttggaataaaaataaataaattccaaaactggatcagataaaaagaaaaataagagttcaattagaaatataatttgtatacaaatgcataagttatagatcatgcatgctcaaagtaattttagtgataaaacaacttaaagaaatgataattacataatttttttaataagtcgaatggcaaaacttatgtccaaaattaacagtgttatttattaaaaaaatggagatattatttaagagttttcccacctagaaactagcgacaattttttttagcaatttccttcgtgtaaactagccacctccgtggtagaacggtcacgtacgtaatgaaatgcgtgatgagccttggcgtgtggtgtattgtaccgtgtacatgtccgtcgcctcgttttttaaaagatatatatatatatacgatttaaatcttacaatttttggcgttccttccggtacgtcctccgcgccttgttattacaggctctgcctgtacatacgtacgtgttggtatggacatggccgcagccgctgccgtctggttctccgccatagccgccgtccttctggcggccagcaccatcgccgtggtggtggtggcgaagatgacggggaagagaaacggcggtgcggctgcagcggcggcggcggcggcggaggcggagctgccactcccgccggtggtgagcggcgtttccctgataattccggtgatcaccaggggccccatggctgtggccgacgagctgtacgtgaagctggggagcgtcttcacggtgagcttcctcggggtggtgaaggcgaccttcctcgtcgggccggaggtgcagggcggcttctactcgcggccggagtcggaggtccaccagggcggcacgtacaggatgacggtgcccatgtttgggagaggggtcatgtacgacgtcgacgtggccacgaggtcggagcagatcgccgtctgcttcgaggcgcttaggccgaccaagctcaggagcagcacggtgaccatggttcgtgaaaccgaggtgtgtacgtatacagtacctccgtttttcatttgatgatatcgttaacttttaggtatgtttgactattcgttttatttgaaaaaaatatgtaattattatttattttgctatgagttattttatcactaaaagtattttaagcactttttatgtcatacatttgcataaaattttaaataaaacaaatggtcaaatatgtatctaaatgtcaatgcgtcatctattaaaaatagagggattatgctttgccgctcctcttcgtatgacttttttgtgactttttgatgctggttattagaggggttagaccaaggttttaaatctctgtttataactatcgatatttcttcgatgataactgtttgagtaggatatagttatttgctcttatttatctcaccattagtcgtttgaaaggtcgagtgctcaatatcttaacccttttaccttttttgaaaaacactaggctagatagatgccatatcggattgaggggttattattggagatttggaggggcattttttttagttattttttttctaaattttttggatggtgaggctatatgaggtgctcttgaagatgctctccctttatgtccgagtgattgaattgtataatttgcaacacacaagcttgcttttacagaactcatggacttctttacttatatcgtataattcgcaggaatatttcgcgaaatggggagagcaaggcacggtggatctgaaacgcgagctcgacctcctcatcctgacgatcgcgagccgcgtcctcctcggcaaggaggttagggagaccatgttcgccgacgtcgtggcatccttccacgagctcatggacaacagcatgcacctcatcagcctctgcttccccaacctcccgatcccgcggcaccgccggcgcgacacggcgtccgctaggctcaaggagctcttctcccgtgccatccagcttcgccgcggctccggccgcgccgaggacgacgtgctccagcggttcttggagtccaggtacagggacggccgcgccatgtccgacaacgagatcaccggcatgctcatcgccctggtcgtcgccggccagcacatgagctccagcgcgagcacctggaccggggcgttcctcctccgcgaccccaagcacctggccgccgccgtcgacgagcagcggcggctcatcggtgacgaccgcgtcgactacgacgcgctgacgacggggatgagcacgctccaccgctgcatcaaggaggcgctccggatgcacccgccggcgccggcgctcgtccgcaccgtgcgcaggggcttcgccgtgtggaccagggaagggaaggagtacaggatgccggcagggcacagcgtcgtgtcgtatgccgcgttcaaccaccgcctcggctacgtgtaccgcgaccccgacgagtacgacccggagcggttcggcccggagaggaaggaggacagggtcgccggcaagttctccttcacggcgttcgggggcgggaggcacgcgtgcctcggcgagcactacgcgttcctgaagatgaaggtaatatggagctatttgctgaggaattttgagcttgagctggtctcgcctttccccgaggttgaactcaacaacataatgctagggccgcgaggggaagtgatggttagatacaagagacggaagctgacaagcacctagtgcattaagtcgtaattacagtcaaaattatttgagagcagacgtactctttactactacctccgtctcaaataagtgcagccatggtattcgtatttaatatttgatcgttcgttttatctaaataaataaataaataaatataaaaaaatagtcacgcataaaatacaattcatgttttatcatctaagagtaacaacaataaaaatactaatcataaatattttaaaaataagacgaatagtcaaacgttgaatatgaacaacataaaactacatttattttgaacaacataaaactatatttattttggaacggagtgagtactttcagtcataaatactgtaactgagagtctcttccatgatggaacgtgttttgcagtgtgttttgcgtgcatatgtagtgtgatgtataagtaaatctttgagatagcaaataaaagaacaagcaagttctcacgacgaatttagtcagaacttcagagatggacagtgctgcacctcaatcagcaaaattgggatatatgcacctcggtggaggagtggtggtacctatactctcgcacaaactgccaaaccaaacaaaggccctagaatccttgataatcctcatctcttgggagctttggtgcgagcgcaatgtaagaatcagtagtaggccccagcagcagtgactgcaaagataaaataagaaataaccgcttgggtccatgtaggggtgtctagtctgcaagtgtttaccgttctaggagaagtcccataatatgctctcttttacggtcttcgtgttgcaaaggtcctatacatatttatttttcatatatcttctgctctattaatatataagagccaaaatttttgctctctttttttttttaaaggaacaagcgagaaaacatcgttactgtagttgcacagcgcgtgcgatttctccacaggaaggtgaccttcttggttggacctgaagaatcgagccatttcttcacagggttggattcagagatcagccaggacgaggtttcccggttcatcattccaacctttggctcatgagtggccttcgatgcgagcaggaccagccctaggggggtcaggccgtgcggccgcccgaggcccctaaaatctagggcccctatacacatatagtatatatatactatgtattgtataattttaattcatagaccataggcttatattaagttagacagctgaataacccaattcagaaaatgaattttagtctatcgccaggcatgtttcagcgaagccgaagcgatattcatctgactcccgtcgcttcgcctcgatcacatcacgccagtcgcgtcgcgccgccttgatcacatcacgctactcgctgctattgcgctcgcggcaacttctcggtcgcgtaaatggaaacggcaagtggacacagcaaatcgtagctcgccagtagccacactcatgtcaataaggacctccatataagtttttgccctgggccccaaaaccccaggaccagccctggatgcgggttatgccacgcagtaagagcagttccggttctttggtgatacaatgaagccgaccaagctgaggagttatgtaagtcacatggtttacgaagtggaggtatgcaaaaaaaaaaaaatcctactccgtttatcttaaaacgcagcaagttttagtctttgacacaggtattaaggagagggtcgagtaaaaaacatggttaccttctcggggtaggtaattagttgtggatataataaagccaaggaatagtaacagtagataaaaagagttacatattatgatagtttgtgaaataataaatctagtaacatcaattttacatgattgatctttttaattttttttgctattaatagttaaatttgaaaatagttgacttagcattattcaaagatacttttattttaggacgaaggacgaagggtttacgtcgtttctaaagttgtgaggagtacctttttatagttagtggaaagtcatatggctcaattatcaatcttgtttttttttttgaagaaggaaaatcgggcccgaaagccatacagctgcatggttaattgcaggaaaaccggttaaaacccaccgctacataactaataacgacggcggagcccaattgcaggttgtcgccaccaaactaaacacaaaagcaacacaacagcccccacatcgcagaagatgtgttatcgttgccgagttagccgcccaagcgacctagcagcaccgactccacaaccgcagcgatactgaagccacgaaagtcgccacagcgaaaagtagctccgacatccaataatggacatcagccaagctaccgaggagcaacttccttcacacggccaacaccagaactccttggaagagactgcaacatgtcatcgttgccgagcgttgccgcaccccatcagcgagtagcttcgacttcatcagtagaaacaaccgaagagcatgtcgcccaccacaagaaagaagcggacccaagaagacgaaggcctcgccgaacactaaggtatgaaagcttttgaaccgaaaaagaccatcgacagtcgtcgatgcgttggagcttcggacaatgcgtgcgacgcccccaaggagaacatgacgatcaatcttgcttgatcttatataacttatcataagtgtttaaataggctctagaaaatttatgaatcctgcgaaacaaatgcaacgtctatattcaggggcggatgcaggcctatgacagttatgatttgagccctagacttgtctccaaaagtaagcttatatttctcaaatcagcatgtaaattttaaaagagaatcttaacagtccattggttagaccagagcttagtcccaagtctttagtagtttctagctccgtcactatgtgcaggagcatgnnccgacagggaccngggggggggggcgggtccgacgcacggacggtcccatctccaaacccctcctgcacatagcagtgatgatagtcgtaacgctcatcgccactaggtgcctgttcggcgaggtccggtcgaagatgctcggcgaggtcccgacgctcctccgcgagctcaatgacagcatgcgtctcatcaccatcgtgttcccgtacctcccgatcccggcgcaccgccggcgagacagtgcgcgcgccaggctcggcgagatcttcgtcgagatcgtgaggtcccgcaggagcagccccggcggtggcggagccggccacgacgacatgctgcagtgcctcatcgacgccaggtacaaggacggccgcgccacgacggagggcaggcggaggtcgccgggatgctcgtatcggcgctcttcgcggggcagtacacgagctccagcaccagcacgtggaccggcgcgcgcgcctcctcacccaccccgagcacctccgcgccgccgtgcgggagcaggaggagctcgtactcgtgcggcaccggcacggcggcgacgtcgtcgaccacgatgccctgcagcggatgggccacctccaccgctgcgtcaaggagaccctgcgtctccacccgccgtcgctgatgctgctccgccacgcgcgccggagcttcgtcgtgagggccagggggagcggcgatgccgagtacgaggtcccagcagggcacacggtggcgagcccgatggtgatccacaacgcgctgccacacgtgtatgaggacgccgggtcgttcgacccgggcaggttcggccccgcgagggaagagtacagggcgtacgccgccgaccacgcgtacacggtatttggcggcggccggcacgcctgcgtcggcgaggcgttatcaaggtgatctggagccatctgctgaggaacttcgagttggagctcatgttgccgttcccggagacggactggaacgacgtcatgccagggcccaagggaaaggtgatggtactccctccgtcacataataagataataagcgtaatcgtgggttttagtgtccaactttgatcattcgtcttatttaaaatatttttataattaacatttttattgttattagatgattaaatatgaatagtactttgtgcgtgacttaacttttaaaatttttataaatttttcaaataagacggatggtcaaacgttaggcacggaaacttatagctgcacttataatgggacggacggagagtaagctacaagagaaggaagttgcagacaaaagaacgaacatttcatagaagctactacaccttatcattcaaaacatttgatataattgcctgtgcttgcctaagtgttcaaatcgttgggatatatagttaacccttcccttaggatgtcccgaacaaacaaatgctcgttcggtaatgaatatgccgagttagagagtacgataactacaaatggcacacaggtggaatcaactggttaaacatctcaatttccaaatgcctctagttcttgagttgagtgtttccagtaagcaaatctgctgtcaaaaagtgacaatgggtagtcaggtcaacacaattgtacatgcctgtagcaccaacactgcagccctgttgaaaagaatatatatctacaatgccaccattttatccccccaactaatttttgggcaaaattcaacaatatactactagccatattgtcgcccattaaactcatgaatttcttctgtatatgtattctaacccaaaatgaagctcttcgtcagaacttcaacccgctacaaactataaaacatcaaggcaatgaagacagtaacggttaaggattctctcaacaagagagttgggttcaggaaccagcgaagaagtaatgctgttccagaggtggaaagtagtagagtcatttacaatcctagaaaacagagcatcatgttgggctctttcatccgtgctatctgcttctgagaagtacctgcagtacatggatatcataatgagagtgcatattgcaaatttgtagccacacatctaaagagtcaacaattacttgaacaacaaaaatatgtgaaaggttgacttttaagttacttgaacaacaaatatatgtaataggttgagttttaagagggctggggtgcatctggtttatctctagtactgtaaaagcggtgtagttgtcctccccaacaatcgcacctcccccacataaaaaaaaccaccccacccaaaaaactagtgttcccatgcgaaaattgacccatcagaaaaaccggatacaaaaaaccgaacccggtaaaaccattcagccatcttcctgagttccttcagatcaatggcatgacactaataggttgaacttggctagtgaatagagttcagtttttcttttaaaaatgctcatgcgctacgtcaacaatgtcgcaaaaggagcagagcatccagtgcagccactacggcttgatgtgggaagggagagcttgacccaccaacacaagcttcaaggctgcctgtgttgacctatgtacacaggaaatcaagttgcagttcattaaattgaattgacaatttgaacattctatgactattacagtttaattttggttagttcaaatcaatggttacattcaactcagttcaaggactgttgtaatgcaggtgaacgatcatagctctaggtaacactaactggcaaccagaacaagtgtcaaagcaaaacttccctggaattgagaggcactataatctggtgagaggtggctgtaatagaggtgtttgatggccacctcatagagtttggaaatggttgaagggggaaaaacagcatgttacaggcaagagctaatagcaatgacaagaggattagaaacaggtccaggtttggtttgtgcatctctcagtaaaactagttaacatgtgatagcatggtgacaaagtgcaaggggcttgcactgaatatcactgcaacaatgacaagctcgtgagccttgacctcccctctctgtgtctgcctcatagtgattttcttttagttatcttaaaatgaaacattgcagtcggaagagttcaccttgcggcttgggaagttgagatggaactttgatgtaccaacaaacaatcttaaaatttaatactgaatatcaatttcaaatagttaaattgaagcaaacaaattcagcataccttgtaatatctgttgagcttatgggataaaatgcaacagaaggttcaaactttatgtcaagatgcccactgttgtcatctgctttgtcggacatatttctgattactcttgtcataagttcagcaccattccactgcaagagttcatcatcatatgttgaatgaaattccttcaggcactccgctaagaaagggctgcaattaacataagttaggtgaaaaatacatgattgctatgattagttatgcataagcatatatatacgcctgcaaagttataatcaacaaaaagaaaccaagatgagatataaaccttgtgtacttgagacctagttatttatacccattatattttgtgatacttctagaatactgttcatgatccatatactaattcatagtacaactgtaacaaaagaaacaaacca

SEQ ID NO: 23912 - DNA, 24278 bp, Oryza sativa
  unsure (1)..(24278): unsure at all n locations
catccagtacaaggttgctatattttgggacggagggagtagataacagtacagtagtactgacttgtgctttcgactaaattgcattaatttattaaagcatactaaaagacttattacttccataacagtaacacccggctaatacatcacagacctctcatttaatttgatgacatttgaacaacgtttccgacattgctcttgatcaattggcttactaagccagcccttgaagggtaactggctaaatcacatccaatttgcaatgcagaaaagcaccacatatcattttaaccaagatgaccagaattaaagcaaaaaaaaacagttacaatgaaagaaaagtatataatactattacctgtttttttcaaatgctaatacagcaccactaaaactggaattttcagaaacttgtttgacaacaccaatagaattccggagtgcgtttaaaggtttaagaacaacaacatcagagtcaaggtatatcccaccgtatctgcagatagggcacagaggcagcagtcaataatagtcctattcaaaaaagaaaaggaactaaacatgtattcatgactatgtttagttcagacgaaatagcaatataactaattaaaattgaagtatactgtctttcaaactattggtccagtaataataaagtatgacgaaagtaaaattctatgaagtctcataatatttgctggtcaactttttttcctttgtttacaggaagaatgctactggcatttaaacctcgcacagtttgtagcactcatctttttttcatacgtgaatgtgaagattccccccttttgatgttatgtcaactactcaactgttttcatggcagcattcaaacaaaatactgatttagctcagcagaactgagaatccatacacagagctcaagtcagctccagagaaattctaaagtggtccactaaaggaaagaacattttacacctcttaataagatgtttatgctctgtttagctgaatgtttatttgtgaaggaagtatttcaattcagtatgaatgtaaatttggctttggctgtttgtaagcaattgaatatattaatctgttggtgactgtatttgcattttgatgttcgctcatgctagttacacttttagaggcatatgaatttatatatatattacaaatcagtgtattaaattcagcagaaagctgctcatcttctttcagtggtattgtcggtcagttcctttgtaagagatattattctttcaccaagagtaaattacttgtggattcgtctacatggatatattactacattagattttattttcaagaaggtatattgacatctccctatattcttctaacagattgtaaagagtgaagttaagcttgcatgtaactaaacaagtctggtcctttcttgtcttacttgtaaagagcagcaaggcgtactagctcactgtaatgcaaggggtagtattttgttttccgccattcattccacactgatacaaaatcatgggttagagtgccctccaaaagttcatcaagattcggcaacgcaactgcaactttgtatctgtaagaggaaaccagtcacatgcagtggcattagttatcacacaaaataaatagaagctgcttctggaatgtaaatgtgaagttcaaatataacattaaatgaatagttactgtggagaaatatcttaattttattatttaatataagaaatcaactgacaacagatgatttgactccagtacctagcagttagtagcaacggtaatatatagataagttgctttcccactccacaaataacaaaaggaaatgttaaaataaatgttcttcaaattacaaaagtaacagggttataaaaaaaacttgagcacagcaggagcaaggtagtaatcatggtgtgtgtagctgttgagcattcaatatgtcagactgttagttactgaactgtttatgacctaatgacacaggacagaaggtaatggaggagaaaaaacaatggggtgaggtaggtcatgggtggctatttggggaaggggttaaatgggttactctggctcaaagcatgcatggatgcacatataaagaggagtgtgtgttttgacacaataatcatcctgtttctttcgttggttttcagccagtaatctgtctgtaagctctaaagtagctggcgttgtgtctttacattctgaactctctgctaggtcactacaacagatgggatggcatcttttaggtgatagcttagctgctctttttatgttgctttcctttcagttgtaaagagctactatctgccatttctttactggaaatgggaaggacttggatccttctagctgaaaagaaaagatatagaggagcacagtttggttatcagaactatagactttccaagcaaagtggcagaaaatgaaccaaatccatcacaaaacagaaaaaactatagaattgagttttaagtgccactaacaatacaatgagttccagagagagagagctcaaataacagtacaatatagccaccaacggacactggccattgagagagagagagttctggtagtgaaaactataagctgattcaaaataacatattaacatgtcgacaacaccttagctgtctgtagcagaatttcaaacactgaaatggctaggaattacctaggttctacttctatgagcatcatttgtattttgtaagatttaaaaattgttaaattaagtcaaactggaatatataccaggcccctctacttgatcagatttcactccatgtgtcaataagacaagactccagaaacatttttgctagtttcattactaatgagtccaatattagtagtatgtgatacatcaaacactaaatagtaatcctggattctatatgataccaatcaaatcatttcaggttttgggtcagaagcataaactcatttctttgttaattagtgttagatagtaaaattagcacctatgattaatcaaatgctacccttaacaagagtcacagaatgagaactacaggaacatacccttccttcacaaattcctggaagaactccagctccagtgtctccgacagcatgacgacacaagcttcagggtgttgccgcagtaggctctccagcccacgctggtgccgtacgccatacgcccactgtgggctgttccacaccatgaacaccttcacggagcacttcccatgctcaaaaaacttctccatgaactcattgaagcccaaatgtggatcaattcccgggtaatatccccacctcctctgctgcaccttctcggttactcccattccctgcttaatatcagacgattgcagactccgccgctcaaaatttttggaagcagccttctctatctcggcgacaagcatccggtgcaccatgcggtcgccacgggtgagagaggtaaggccggggctgtccgggtcctgaagcagcgggtggttgcggggattgagaaattctaggttggaccgcagcatccgatcgcgccggaggtagtcagccttcccctccagccaccgcgcccacccagcacggaggggagtctcgggggcgctggaggcaggcttcaggagcaacgcgtcctcgacgccggcgatggacgagatctccacccggagctccagatccaccggctcgtcgtcggatccgaaggcggcggcggcgatccggtgcgcgggctcgaggtgaggtaaccccgccgggagggggtcgccggcggcggggaggcggaagggcaggcgggcgacgccaacggcgtggtcccagacgagggacgacgcggacgcggaggcggggacctcgtcggccgcgcctaggccggacgcggtgtcctcgtcgagcacgtcgagctcgtcgatgggatcgtcctcagggttggagacggaggaggcatcggtggtggaatcagcggcggcgttggtggtggtggtggtggtggtggtggtcgccgtaatcgtaaccgtggggtcgagcaccgcggcgccgtcgtcctcgtcctccacgagcgagagttggagaccccgtcgccggaggaggagagggggaacggggaggaggaggaggaggagaggcgggagtggaggacggcgagggagacgagcaggaggagcgccgccaccacggcgcagagctgcgcgcccaggccggagcgccgccgcgcggccgggtgcgagtgggagcgcggcagcatctctgcgcggcgcgggcgcgggcgcgcgcgtccgtgcgatgcgacgccgctttcctcctccttccttcgccctttcccccctcacctcacacacccacacacaactaggccgcgcgtttcacaaaagctttcgtgttttcttcgtgtttaaaccacaacccatgctgcggtcgccgtcgcgctcggcctcaccaaccctaccaaccgccgtcagagagctgacttgccacctatgtacaacacttgacatgacattttttgtatgaatttcacatgttttttgaaactaatgctgtgtttagttcgtgtgctaattttttttaagtatacagacacatatttcaagtattaaacgtagactaataacaaaacaaattaacaaaacaaattacagattccgcatgtaaactgcgagacgaatctattaaatttaattaatccatcattagtaaatatttactatagcatcacattgtcaaatcatggcgtaattaggctcaaaagattcatctcgtaatttacagtcggattgtgcaattgggtttttttcgtccacatttgatgctccataaatgtgtccaaacatttgatgtgacgaaaaagttggaagtttgaaaaaaaagttgaaatctaaacacggcctaagctactttttatttgtatggatttcgttgggattttacagatgcaaacagcacacctgactccaaactatacactggttcactgaacaatgtttgccacttgtctctgttgtgtcggtgaactaatctccatcgccgtcgatcttaggccagccattttcagcctgcgacttgacaaacgcggccagtagcttgatatcatcttcgaccagccgaggtccgaaagtgcactgccctctcggggtgcatttttctccgaagcccttaacgcagcaaacatacaatcaagaaattaatgagtatctatctatactactcaaacatcatcatgatagcagctaagaattactcaccggcattcttcccttcccgtagtacgttatattgtatagctcgtcctccgtggcaactccatttctgcagcaaatttgcccttaattttgccttgatccaatccaacaatgggcagtaaatttcgagcagttaaaagttttcaagagcacacatacctctcaagatccttcatgtacagagtggcgccctgtacatgacaaatcagcaagctaataaaaaggttgaaaatttgtgtccggccatcgagtaatggtttcagaagcttaccggctgtaggatatttcctcccatatcatggcagccgatgcacgccttccggaacagcgctgcgccttcggattgagcaaaagctacaacaacaaaagggggggaaagaatgtgatgtgcgacgcgtacatttcagcaaatatggtaaattggcaattaatcatgctcggtgtacttgtgtagaatcattcagagttacttctgttatgttcctctactgcttccccactaaaaaacttcaagaggaactagattctagtactacgcatcctgacgtttgagatagaggattaacctgatggtgtggaagctaggaagccaggagatgcggcagaaaggaggagcgccgccgcggccaacagcggcgtggccgcgcgctctgctgccgcagacgcagcgacggcgagagaggcaaatgacggcgtcgcctcctgcttcaggcggccgcagcacgccgtcgtcgtcctctggggagcgcgatgagcggcggccgccgcgcgatgcggacccggtggccgtgaggccagaggaagccggtgcatggagctgctgcttcttcctcccccgtcggccgtcgcaccggggacaaggctaatcttggaggacagtgttgagcctgacgtggttcagatagcagccacgtaatgtccaaaaggattagacgggtcaggcttagtaagatcagaacataatgtatggttaagacgtatttttgaacgaatcagcacgtattttttgaacaaattggcactagacggtgcccatttctttgaatatagtgtaaaaagtttaatgtattgtttagacattttatagcgtggcagatgcagtgatgctggcctgtgcaccactgaagcttgatgcctatagacacaatggaacagctcaccaacgccgggttcagtaaaatcagaacatttggtaggaagtataggaaacaaattattaaactctatttggatcaagatgtaaggtttgaacggcagttgtcggttgtcacagcagcagacgcaattttcccctgatgcaggggttgtataacttagcaggcacgctgaattttggactttctatggtccgaatatcgacggcacggagaattaattccttttccccatgattcgtgagcaaattggaatcctgcatacaaattcttactgccaccatgtattgacatttggatgaaggctggacgataaacaccaaaaaagaaaaaacactaccaaattaaatgaaaaatatgcaaaaatcagatgggatattatatatttgtcataattcagaatcgaagatctttttgacggaaagaatcgaagatctcaaagactcaaatcttactcccccccccccccccccaaaaaaaaaaaaaaattccaaaccttgaaatacatccatatgaggatttttgatttattaatagcagaaaacataatagccttttacaacagaagaaattggtcaagtattccacatagaaattaaatctggctaaaaaatctcaacttatgtcagttatgtgtaaggcataaagccatgctaatatccattattttgctaatttgcatgtttcttgagggtacttgcttcgaacttctacatctgctaatctggagttcacagtgattttgacttctgagcctcaatatattactaaaatgatgcatctaatataacttatatagcagacatcccaaccacaatgcaaggtagagatgtaggaactggaattaatcctgaactcattggtttcttnnnnnnnnnnnnnnnnnnnnnngaagttcattgatatatgagtagctgaaaacagcaacatgtcatcctttaaagtttcgaaggcaacctctaacctctgcctcatttgagcatcactgctatgaacttcagataatcctgaatgcaagtgtcatataaacaaggtaacagatgatggtcacctatgtttgcaatcggtttgtgctgtgtaagcatataaattagttgtgcacaatatcaaaggacccatctaaatgagagatcattgagagaccgtaacatgtacttggcaaaaacatgacttgggagaatgagactcgttttattattcgctctagacttcagaacacaaggggtttttaaaaaaggaaaaaaatcacaccagatgttggaccaaaatgattcgccgcaatcatctcttttaatttttgaacctggcatcaatttttttaagaatagaaaattctctttttgaattttaatggacgatttcacagctcaagtttcaaaacatatataagagcagtgacttccttactgtcttcaggagttaggtaaaactttaaaagaaacagtcatttgtttgaactaacaaagaaatatccacatcataacttagtggtcataactggtgttgcatgatgaacatgcagataactacacaagatttcataacaatgaagttgagtagacgatgagcaatgcattcaagactcagaaaatttaatgtgtttttagcattacttagagaaaagaagttccgaagtagctataattgctgagtagatactgctgccatttttcgttggtttagttttgcatagagaccgcttttggaataaagaagaaaagaagaacaagtaggtaagtggggaatgtgaagtagctcatgccaacctatccaaggacatgacagtcagcagttgatgaacgcaacaattaaacatgtatattgatggtatagtggtatctggaacccaacaaatacatacaatcttaatgttattctcgttgctccttcagctttgtgctctatctctataccataaaaacactaatccctagtacactacgcagcaaggggtgttccagaaccaaatcacatctcccaaaatcaataaatccatagaaaattgcagaacaaagtgtcttgttcactataccagcgtaggctccattgccctcagggctcctgatgcgactcgaggcagagggagaggccgatgcgcgcgcgctggcactgggaccgcttgagcgcggtgccggcgctcccgcagagggtgcggacggcctccgtctccccggggcagcacgaggtcaccaggcactcggccagcgcccggttgaggtgccggcacagcacctccggcctcagcgggccgcgcgccgcgctgcggtggcactcggcgagcgcccgctgcgtcgcggcgcagggccccgggacgtgcacggccgccgccgattcgggctctgacccctgccgcccgccgctgccgccgccgcctctcctgctcatcgggaaccgcccggtcgcggtggggactggggaatctgctcggcgattccgtccccccgcgatctcgtactctatggactctcctccccaacgaacaccatgagattgatgcaaggagagtttcttctagttggtccgattaacttatgggccgtgctcgcactacgagtccgcgggttctcaaacaaaagcttattgggcctccaatttcatctgttgacagtgtgctgagatgaaaaaagtccatttgcctctctccactacgcacgtctaattagtactttagtagtccctccgttccataatataaaagattatgccctctaaatttatcctaaaatataattgtcaggttacggataagatataccctctacccttggatgtacgctatacggcaatacggtacatcggcgcgtgtacggacattctctgtatacgttaaggaaattcgtctcgaagtccaccaatggaaaggttcctacccgtataggactgggtcgtcactatatcgtgcagggtccgatgtctccgagtcctacttgtagaccacctgacctgtgatataaaagggaccccccgggaagacctaaaggatggaatctcatagccaacacaacgaccacagcctacgaagccgaagcctacaggagccaagtcgccggatgatctagtcgaatcaactcgactacgatctcgtcggtatcgtcgagttctgttattccctttgtaatttgtggtcatccccatataatcccatatcaactggattagggctattacttattaaggggcctgaaccagtataatctttgtctcttgttttcttgatgtcgtattacgtagatcctcgtaccagcgtaccccaataccctctatatccggtctacgagtacccaccgtcgacaataatggattttataattttgaggtagtactttatttcccaaccacgttcttttatagtacccctttacttgatattataagtcattttaattttttttcctattcaatttttttaggtttgaccagatttatagaaaatttagtaacatatataacaccaaattagtctcattttaatataaattaaatatgtttgatttttgtgagaaatattgttatatgtttttataaatctagtcaaaattaaaaagagtttaactataaaatgtttaaaatgacttatataatatgaaatagatggagtactagtttaatccctaacaactggcatcttttccccacctactagtttagttttactattttattctcgtaaccatcacttattgattttgtactatgcattgtccttttgccacttcctatattatgggaggaagggagtatcccttggccacaaaaccagacatgaagattccccaactggttcatttgtctctctgagcaatttaaatggtcgtttcatcctgcagggcacgttgacacagttttctcaatgtaccacctcgggtggcatcacaatcagaaaaagaataaaaaacaataggatctagtcatcgtcttcctctacctctccattcattccatatctcttccactctccgcagccttcctccttcctccctctcccatctctctaggggaagtgatggtgagtgcggaccgtgtgtgccgcttagtgtgcctatttgcctttatttgctgttcatcctccgtgtgactgttattacagacgagtatggaggtagtatcgaggaggcctgagtggacaggataatcccagcgatgtggcagagctcaagctatcctacatggtggcaacagtgtgtggaaaagatagtggcagtggagacaattgtctccaagcctcaccccggcgatgaattcccttaaagggaaaatgagacagaggatagggaattccttatgtccccaatgacttagttgctcagatctaggtggcatcgagacagcggtttttcacggagacggtgataacgtcccgcaacttctcttgcttgagaggtggggaccgcttgccactgctagggagaagccgttgtctccgatctactccaaagaggagcttgagttccgcagcacaaatcaacgtcggtattgttgttgtcggagagaagacacgagggagaatggcacgttggtcatgttttagagattaaagagggattgttttcagtgtcactagcatgtggttcaattggagttttttacttttactcttttttttatttttctgattgtaatgtcgcgtaattgccatcatgaatgaagaccaaatcaacgtgacacatagttgacgtgttagctgaaaccgccttataaaccaataaggaagataaattgatccgggtttcatagttgagggagcacctatatttgattttactattgtaattggacttgaactatagctgagagaggtgaagtggactttttcctgctgagattagccaagttcacgtgcattcggccccgagtctggctctgctcatttttggggctttggaattggaaaggaaaggaaaaaaatacaccgaaggtccctcaacttgttatcgagttacgaaatcgtcctccaactgtaaaaccgaatatccggcgtcccttaactaatcaaaaccggtcacaatagatccttcggtggttttgtccctggttttgtcctacgtggcggctgagtcagcgtgtgacccacgtgggccccacatgtcaggagcccaggtcatctcacttcctttctcttcctctctctctcccctcactcttttcttctcttctctgggatggagttcatggcacggcggacaacggaggttgactgtaggctggtcccacgccgcggctccgccacactcgctcgacagtccacgccggcacggtgtgtgcctaaagccaccgcaccacccgaggcagctcaggcgcgccacctcctccagatccacgcccagttcgttgcgtccggcctcctcgccgacgccttcgccactagccgcctcatcctcttcaccacctccacccgcctcctcccgctcccgttccaccactcgctccgcctcgccccgtcgttctgcgcagcccgagccaacgagagcggcgagcaaccgctcgggcaaagcccgctcgaggccgagcagcagccgccgccgcagccgcggggaggggacggagggagcaaggacgccaccgccgtcgcgccacgtccgggcctggcagggagggaacggggagagcgaggacgccgtcgtcgtcacgccgcgtcggggtctggtggggaggggacggggagaacgaggctgctgccgtcgcgccgcgtcggggcctggcggggagggaacggggagagcgaggacgccgccgccatcgcgcacgcagctccatcgtttctcgttccccaacctcagctggggcaaccaccgcctcctccgctgctccaagaaccccgcctcatcgcctccacccgcggtgccggacaccccgtcgccggacaaggagaagaccgcccacagctccactgacggcgtcggcgtcggcagtttgcctcagcggggtccgcaacggccgtggaacctccgcacctgccgctctgccaccgccgcaccgtgtccagagggattggacgatgcggctgatgccgcgctggagtgagcgccgccgccgctggcgacgaccaagaagcgggtgtcctccaacgtgctgtccgaggagatcgcccatgtcttcaagacgataataggggaaagacagaggaattgagggtgccatgacgtggctactctgacatgtggggtccacgtgggtcccatattgattcagttgccacgtaggacaaaaccgggatcaaaaccgcttgaggatgtaaagtgaccggtttcgaaaattgagggatgtcatatatctaattttatggttgggggacgattttgtaactcgatgacaagttgagggaccttcggagcactttttccaattggaaacctaaccaaaaatatcacaaagggcccatttggattcactgttacggttttaccattgcctgaactgtactctcgttgttcagtttggtagttgagttgacagcggggatccgccgacgccgcacaccgtcttttcctgtggcgacatgcatcgcacagtgacgagccagtcagtacccagtacagaaaccgcgcggctcacgggggaaaacccaccaatcgcgacatcatcaacgacgctggtaaaaaacccagtacaagtacacaaccttctcacatcgcaggagatcaaccagacaaccaaccagccgggccagcgctctacagactagtacagactacagagatcggcaaggctgcatgctggaaccagagacgctgacgccccactccaccaccgatcgatcgctggtatccgagggggaggttttgtccgtcccctcgtcccccgcactgttcgcgctcgctcgcccgctgctctgctcgtctcttccaccatcaaatgatcacatgctgtccatcaactcacccccgtcgtctcgtgtgcgtgcagctttcccccacggcctcctgctgctgccgacccgacccgacctagcgtccctcgccatcgcgcgatcgtgagaaaaatcgggtgttattgtgtagtagaaaaaaaaaccggtcccgtcctttgattccctctgcctgggcgccgcccgctacgggacgcgagagcagctaccagcaacccgacaaaccgcacaggcggcctccccctcccgcgcgcgccagcgtccaacgctaacggcgacccgcgcctctctcacagtgtctctcccgctagcgttatcatcatcagctgcgggcttgctatgctatgcttgcttgttgcagtggttttgccacggagaagggtcaccgggaaattattgtttaggctgacgtgatgctccagggagtcctgtcgcgagctcccggcgccgacgcggcagcgatgaaggcgaagcgcgcggccgacgacgaggaggaaggcggcgagcgggagcgcgcgcgtgggaagcggctggctgctgaggggaagcaagggttagtggtggtgagtacgggggaggaggaggaggcggcggcggagacgcgtgggctgcggctgcttagtttgttgctgaggtgtgcggaggcggtggcgatggaccagctgccggaggcgcgggacctgctgccggagatcgccgagctggcgtcgccgttcgggtcgtcgcccgagcgcgtcgcggcctacttcggggacgcgctgtgcgcgcgcgtgctgagctcctacctgggggcctactcgccgctggcgctccgcccgctcgccgccgcgcagagccgccgcatctccggcgcgttccaggcgtacaacgcgctgtcgccgctcgtcaagttctcgcacttcacggccaaccaggccatcttccaggcgctcgacggcgaggaccgcgtccacgtgatcgacctcgacatcatgcaggggctgcagtggccgggcctcttccacatcctcgcctcccgccccaccaagccgcgctcgctccggatcaccggcctcggcgcgtcgctcgacgtcctcgaggccaccggccgccgcctcgccgacttcgccgcgtcgctcggcttgcccttcgagttccggcccatcgaggggaagatcgggcacgtcgccgacgccgccgcgctcctcggcccgcgccaccacggggaggccaccgttgtgcactggatgcaccactgcctctacgacgtgacgggctccgacgccggcacggtgcgcctgctcaagagcctccggccgaagctgatcaccatcgtggagcaggacctcggccacagcggcgacttcctgggccgcttcgtggaggcgctgcactactactcggcgctgttcgacgcgctgggcgacggcgcgggggccgccgaggaggaggcggcggagcggcacgcggtggagcgtcagctcctcggcgcggagatacggaacatcgtcgccgtcgggggccccaagcgcaccggcgaggtgcgcgtcgagcggtggggcgacgagctgcggcgagcggggttccggccggtgaccctggccggcagccccgccgcgcaggcgaggctgcttcttggcatgtacccatggaagggctacactctcgtcgaagaggacggctgcctcaagctcgggtggaaggacctgtccctgctcaccgcctcgtcgtgggagccgacagacggcgacgccgacgccgacgtcgccgtcgccggcgatacccaccatgagagccccgattcttgatcacatgatcgcagtagcagccaggtcgattcacctgtcgcagcttttcttggtcatattcattatcctctttctgctagctacttcattcgatcgttcttcctcctgtgagtagtattttggccgatgattaagcttgtaatataatcgtataggcttcatcattcgttccctctccaggttgccatgaacaacaccatttcaattacaaaatagaactcttctacctccaaaaagaacttgaactttcgtgagcaagatatccgcaaagtcgcaatctgcatcatcatctgcctgctgctgcttcatcgaaattttggattattagataggtcgtcaactagtgatcgatttaattgtggacaggggagccagggatcaggatatgatgtgaggtgatgaggtgacaaatgacaaaataattaaggagaggtgcttgcacggccggattctgataattaacttgataatattattgtcatagctgaatagctgaatagtgacagcttacccgtcggctctatcgaaaactcgcaaatctactggcaacaggtactgttcagtttcacggttttatgccctattcagttgtcttgttacaacgcaacgactttgagaagctattagcttagctgttgcgagagtgactgtttgcacgtatcggtgtacttcctccgtctcaaaataaacaacctaaaataaattgaacattatataatacaacgaatctgaataaagataatgccttatactaaatcagaaagagagtaggattttgtaactgtttttcgtgctctgatgcaattgggtttttttaacgaatcacacgagacggtgcgaggttctattgatagagtatgaaaaaattacaagattacaaccatagagagtcgtaaccaggaaaagaaaaaaaataccacccacacgccgacatcgccaacacacacgcccaggagagggctagcaccggatcggccgcttctaaacgtaaccgaccgccactagaccaacagaggggcacagacgagatcgccacataggggcactgatgcaattgggttgctgtatgaaattatgaaccgcggcaattgggttgctgtatgaaattatgaaccgcggcaatacagaagggacgctgtttctcttggatttttttttcctttttggtgatatgacgatggaatacttaactacagctatatatacaggcggttgcattagacagatcacgaggataaatctctggacacatagcagatggacacgaaaaggctggggccgaggcgatgacatgatatttcaggacgcagatcaggttggttgacatgattgggggcagcacaggattgggcaactcgtgagccacacagactgtttccatccagttccggcctgctggtgttgcctcttctccgtacgctaaagctgggattgctgcaatgtgagtggtcattcttgcgatcgtgagcattgatttggatccaagatgcactgttcacattcaaatacatttccaatggatcagtagggtgaaatcggtaagatcttttttttttggttggtaagaaatgctaggttcatttagggcccctttgaatcgcaagattgagaaaatgtaggaacaggaaaaacgtaggattttgataggaatgtaagtgtaaaacagagaattgcaaaacacaagaaaaacacaggaatggacgtttgattgaaccgcaggaattagatgagaaagatagactcaaagaaaaattaccaagaggttgaagctcttactaaatttcctccaaaatctctatagtattgtccattccatagaaatttcaaataattggattagattcaatgctttgtttcaaaggtttcataggaaattttactataggattgaaatcctccaaaattcttatgattttcctccaaatcaaaggggcccttagagcaagtataatagtaagctataagtttactataagcttatgtggaggagagaggtagtgaaaaatcaagagtgttggctctcatgcaagagcaagcttatcacaagctccaagacaaatatattaaatgtatatgtgagagatagagagaggagaagaaaattatagccaaccttatagctaatctattatatatgttggctttaagataggctaatagtaggaagtaagctctactgttatccttgctcttatacttttgtcataaatggctctgattgtactaactgaaataaaggaacggcttttaattgcatcagaaccctggccattgattaacatactccctccatcctaaaagaagtgtagttttacactattcacgtttaacgtttgaccgttcgtcttatttaaattttttttatgattaatatttttattgctattagatgataaaacatgagtagtactttatgtgtgactaaatatttttaaatttttcacaaatttttcaaataagacggatggtcaaacgttgggcacggatatccatggctgcacttattttgggacggaggtagtatctagcaacgattcggctgactagtcaatgcggaagacattcgatcattgggagaatcatcttcttgaaccagggcatgggagcctacgcagtcggtccaggaatagtgggagaaactggaactggccaatacggtaggagttcccaaaaaagaatggcgcactctcatcctccttgtggtgcgggagatctggaaggagcagaatcagcagattttctagcacaaggagtccacagcgacgtatttgcttgccaaaatcaaagaagaggccaagctctggatgctggccagcgccagaagattgcgtgagctcctgccacatcttgtatagtgtacttttccctttttcgcccctagggattatattttttcctgctatattcaatgaaaaggcagtctgtgcctttttcccttaaagaaaagtcaatacgaaagacattcgatcattcattgttaaaaaaaccctatgtaatatcatttgtggcttattttaccattaaagttattttagtataacttatattacattatcttttaataaaataaaatcaaactgatgtttaaaagtcaataatatcatgcttttcaaaatggagagaatacgtggttttactaaggaataagttcatctaaggtcccttaacttgtcaacgaatccgattttcatctttcaatcacaaaaccagatacaactgatccctcaactaacaaaaccggtgcgaattaggtccctcggcggtttcgatagcagttttggctgacgtggcgcctacgtggctaatttgactcggtcttaatctgacgtggcactgatatggcgcttacgtggcaattcaattcgggaaaataataaaccccgtgggacccacatgtcagtttcacacacaaattaataaaaaatgacggggcccacgtgggccccacatgtcatttcacccctcttcttcctcctctctctccccatctcccatctcttcatctctctcccctttcctctctcgcttcggtgctcgccccgctctcctcgtccccaggcctctccgaccgcctcctcgccgcccgccacgagctccacgagcggcaggagcacctcgccgctgcctcctcgtagccgacctcgctgctcgacttcgtgctgcccgcgcctcacccgaccccctcgccgccactgccgagctcaagcctctcttggtggatcccgagggatctggatctagtcaggacaaacccgtcgccgtcatcggcgtctgggcacggttcatgagcaaaggcggctgcgccgtcgctggtccatcaccagcttctcgctgtccacgctgaccaactcgctcgtcgtcggcgtgcccatggcgcgcgccatgtacggcgagtgggcgcagcagctcgtcgttgtcagctctggccaaggattacagcaacacgcgcacttcaactagctggagcgaaaatctttgtggacaaacacagaagaatttctcgacgacaacaccttatctagtttttctcattcacttgacacttaactcaggagattatatgacttttatagcccagcaaacacaccactaagcaaacaaacttcagccgcatcgtacacgcacgcagcacgcgatccaattaattcggcagccactagctagccacatgcacgaagctaactgccacacaaaaataatgctaacagttgtccagctctccgtcttccaggccatcgtctggttcacgctgctgctgttcgtgctcgaggtcaggaaggccgccatcggaatgtacgtcgacggcgcctcgtcctccgaagagtcgtcggcggcgccggcggccagcaaagggcgtcacgaggccagcgctggcaccgccgcatccacgcctccacggtcattgtcgtcaccgcggcgagcggcgccggcaagccgtcgctgtggggcgctggtgaaagtggtggcgccgctccctcctcaccggtcgacgccgccgcgcgccgctccctcctctcccgccggcggtcatcgaggagaagggtggcggacggcggccatcggggacaagggcgacgagcggtgggaaggagctaggcgagctccctggtctaccggcgagcgcgtgcaagagcgagttggccggtggccactcttctccatttccgccgccgccgtcgtcgcaagagagataaaaagaggggatggggagagaggaagcagaagaggaggggtgagttagactgacatgtggggcccacgtgggcccgccattcttttattaatttgtgtgtgaaactgacatataggtcccacggggtttattattttttcggatcaaattgccagtaagcgcccacgtcagtgccatgtcagatcgagaccgagtaaaattagccacgtaggcgccacgtcagtcaaaaccgccatcgaaaccaccgagggacctaatctgcaccggttttgatagttgagggacccgttgtatctggttttgcggttgaaggacgtaaatcggattcgttcataagttaagggaccttagatgaacttattccttttactaaccacgagccagcatgaaatgctttcacttgaggttccatcggtccagcctattacgtgattacgtccgactcactatgcccaattaaagcccagcagcccagctaactctcctgcccataatacggcccatgcgattcggaactcttgcgaaaaggaccctgtttagtgcttactccctccatccaaaaatatttgatgccgtcgaatttctttaaatacgtttgatcgttcgtcttattaaaaaatctaagtaattattaattcctttcctatcatttgatttattattaaatatacttttatgcatatatatagttttacatattccataaaagttttcgaataagacgaacggtcaaatatatatttaaaaacgtcaacggcgacaaatatttagggaatgagggagtactaagttgcagattttgcagttacaaccctgccagctgcgttcgggagaacccctcctccctggcacgcaaaacggagcacgcattattgcatgattaattaagtattagcttttttttttcaaaaatggattaatttgattttttaagcaacttttgtataaaaactttttgcaaaaaacacatcgtttagcagtttgaaaagcgtgcgcgcggaaaacgagggagaagggttgggaacttgaaggaaagaacacactgtaagagcagactataagccagctataaacatattttaaagagataaaagaagagagaagagcagtgggctacagatttgtagccagctgcagcgcggactccaagagaaatatgtgtatgacaggtgagaccaggtattaatattatagtcagcaactattgtataaattggctataacattaactatagatgatttagagccagtgtctatactataaacttgctctaagtgtctagtgtctactatcgctacatcttggacgaccgcgtcttctttcctccatgcatgctccatcctagctgcttgtgtgactccgcccagttttgtctctcgcccaattggcaatcacaggttcaattcgcagccaacctagctaggcactcgtccggccggcccttcgtcgtcgcttggctatctagcttccttcgatcagcttcaaaaccgaagccgcccccgttgtcttcattccaccgtacgttgatccgctagactctgctccagttgaccagtactcgatactcgtgtgttcggtgttcctcctggctatatatacacgacgcgttgccgttgccgttgccgttgccggccactcgctctctccatctcgtctcgcccaagcgcacgcgtttccaccgtctgctactgctagcgtgctactgtctcgctgatcgatcatgagttactacggccagcagccggctcccgtgaccggtaatgctacagatgactttgggaattaattgggagacttctgctgttcttggttgcgttcatgcttcctttttttttactgatggagtgatttcggtgttcgaattttttgcttccttgatttcttttgcgagcagcgtacccaccgccggcgatggcgccactgcagcagccgacggggcaggcgccgtacacggcgccgccgcagggcaactacgcgccgcctccgccgccgggatacccgggcaacttcgacgtgggcatgaacccgccgcagcccgcgcagacacagagccgcggtgacaaggccttcctggaaggatggtaattaagctcggtgtcactgataataatgtcttgtgtgaggcagtggctgagcctaccgcctaccattttctgtttactccaatcgatcataacctaatagcagggacaacataagctgtgcactttgttaccaaaattaaccttattaaactgtggcaatatcaacttttgacaagctttggtgttatcgaattttagtagcgtttgatgtcttttcaaaatttagtactagcgtttttatgataggaaagttctagaactactaaattttagtagtatgataatattggtgacatcatatttagtttgttatcttactaaaatttaataaggttaaaagcgattataaaatgaacaagcccatagtatcttcctacgtttatagaaaacctaactcaacacctaagttatagggtttatttatgattaaaaagaggttgctagaattggggtatgaagtagacttttttacccctatttttcgtaatgagacaattactctttttcataactagaaaaaaaatatccatgcgttgcaacgggtaaaagctattttaatcttatcactgttgtacagtttagctaaggtgaaattcactctggaaattcgtttggatatttattttacaaaatcataagctacaattaggagtcctttctgtatttttaaaaacgaacgaacttaaaaacagactcaaatacatatatgtatttctaaaagcaaatgaaattaaaaaccgactcatatacggacgacgtacaaagtaccggcaaaaacatcttcaatttttataatagtagtgatatgcgaaagtagactgaagaactgaaatacttaaccgttctgttgttttgcagctgtgctgccctttgctgctgttgcctcctcgacatgtgcttctaaggctattgagagtacaagtataagcaaatcatatgttgcaagtagagtatgttcaaggctgtactgtccagttgaaggtttgtacttatgtgccatgtaagagttgaatgaagatttaccatgttcaggctcctattggatagcctaatcagccaaagaaaaagctaaattttggattttcaagcttaattttgagatattttcaacgtagtttcttttttaacattgtcttttaagtcaccaagaacacatttataaaaatttcacctacaaattcatttttatttcctaataaaccgttttggattattaggaaataagccaaaccatggggacttcattttttagttcctggatacttatgcacggaaaagaaaatgaggacagtaaatatggattatcaatttttctgcaagtatataggacattaaactactagatgtttaaataactacaatcacctccctgcataaataactcttatgcctcgggatccgtgaaatatacaggagtttctagatcatcattgtttgcagaagcaaatgaatcttcagatcctatcgtcgatggacttgaaatactactctcttcagaatccgagatttcatcatgtacaaccacaggctcctcaagctcggactcagatcctgaagtccctaattgcttattaattgcaaccttggccatgtcgaggaaccattcatcctcgggtagagaactgaataatgagaggaagaagacaacagtctgagcaattcggccatgaaagacaggcaactaaataaaaggaaaaaatgtgaacggcagaaagcatgattacagacctttgtgggtcaacatttctcactgagaaagctgcgattgccctagttatgattaccgacacaagctgctgaacaggtctgtgtggataccgtccacagacagcaatctcaacgacgaagtgcatatcaagaataagctgaaatcataaagtaatgatcttttagtatttgaaccaaagtaacatgaaagcttgagaaaatatacctgctgtagtcctgaaggccggagttggatggattgatcctcgaaaacatcccagaattcctgttcattggagagccacatgacaaccgtttcagttagccttgagagcaagaccttctgtatcttctctttacccagtaagacatcaccagcaacactagctagctgccgtaactttacaaacagcgcctgagaaaaatatatagatagataggtgagataactgtgtttttttgtttaagcagtaaattaattagcttgaggataacacaaacacattgcctttgctctcttaaaatacatcaaaggcactgtatgtaatcatctgaacagaaatgcatgataaattgagctgaaattattaagtcatctttaacatgttcagatttctatttttaacatcaaaggtactgtatctaatcatttttaagtcaatgtatgtcctccccttcaccagtttcaagctaataggaatgatccactcagaaatggggatgaggattcccatataataaaatgtcatgctttgtgatggactg

SEQ ID NO: 23913 - DNA, 3554 bp, Oryza sativa
taaatgatgcacttttctgtttagtgttaactagcaaatgaaatgtaattaaattaaagatcaattttgagattgaaaggaaacaagaaaacagttatcaaagaaatattatgttcctaagttatccccttgtgcacagcatgatggtccaaaagtagtaccagacatcgcagcatcatcttttttcagtttgatcctatccttataacaggggattgttttaatatagacctgtgaactgcaatgccgtggttttttcatggtgacaagaaatcattttgagcttttaacacgatcgatgcaaaaaactgatatcacatcattgaaatggaatcacctggaaaggcagagaaggtgaaggatcacactcccaaagaagatcatcagttttcagctccaagtacattctagcatccagtcgtgatttcccttctaagtaaataaatgataagacatactgtaggcaaaaatgatccctcagtttgtccagtgaatgttgcagactacgtttccactctttgtattctatggagtatatagatccagagccaaggccctcgcctgttccaccaattctcttcttctcggtttggatatcaaaaaatttggatacagctgctggcaataattcatctgctacagtgtatgctgttccaatgagttgaatctgctgggcatcactctctgctttaaattctataggctcttttgactccactagatgatcatcctcagaagctcctggtaagacttcaattagtgcttcaacatatttatcaaatagctggacaaatttattcaaaatcgttcctccaaagtgaactatagtcattggggtaatttgatccaaaacatcctgaaagaagcagatacagagatcagctgcttcataatatagacaacaggtggtgtacattaaattctaaagcaactcgatgaactgcacgctgttctaatttccattcattccataaaagtgtgtcatttccaaatttctgtaataggctatagtattttggtgcctgcactaactaatgctagtgggccacgtatatttatcatatgtatgtgggcgcagggatatgttacatgtatctttggttgctttctaccaagtaaataacataaagcaacggcgtacattaatccaggtgtaatttcaacaaggttttcaagtggtgctagaaacccataccaacaaaaagaaatgctgctatagtgctagaaaccaggaaatcatgtgtatcttaaaatgagaatgcattggatttaatacatatcgagtttagtgacaggatcattcaattacttaataatattgttcagttgaacacaacagaaaactgaattgtcagacacattaagaaaaaaggttgtaataaggaaaatccagtaaaaagaataaaacaggaactcacattgacaatggacatgaacttctttccactgcttgtaagcattatatttggtgcaactgaactagagagccgtgatccttcttgagggctgggaagcagaatatcatcattttttgctgaatctacaatctttcttctcagccttctaaaattcagctcaagcacttcttcaacataggggtgcaatagtaccattagtaaatttgagaatttcaggccatatgattctagataagagcagtgagtgagactagtttggatgcatatgcaggcagaacgaagggcagatacgctctcaggcaaaggagaattttccttaaccaaacgcgcaaaggtttctatttcatattcagcccactgaataatccggttcaaattcatggggctatccccaaatagcgaactagattctttggatacctttgagatagctgagaaaacaatctttgacaaagttgcagagtaagtttctgtgtagatcgaacatgttggaagaaatgcttcaacatttttctgaagacgtgacccataagcttttagaagtacttggtgggctagagaacctttgccaatcttaataaggccagacaaagatttccttagctcggtaatagataaagaaggctgttctgaatacctaacaagctgatcctcaagaattgatttccttttagatagtgctgtcttataggtagaaatctctgcatctaattctttgccaggatcatccgtagccatacatttcttctcttcggtttccaaagcaagcaatgcctcctctattttgtgctccgcgagcaaagtatctaatttatccagaaaactaaccttggaatcttgggtatcatatgacaaaatttcatcaagttctgtttgaaggtctttctcttccacatgttcatccttgcaatgtttttgccacatttcgagttcacggcacacaccgctcattagatcttgcacaagaatcccctgggcagacacatgcttctgcaactcaattaattcttgttctgcctcaacaacctcctcagatattctgcatgaagaaaacaaacaccagaaaacattgcggtagattaaaaacagcaaatgagtgcaaggaagtaggaagaaacgctaaacattatatattactttctaaatttatagcgactcaaagataaaagctgaatcgtgcgttaacaaaacattgatgaacttgggaaaaggttaacttgtacgtttcagcaacaagacttagtaaagaataaacgaccaacaagaatataaagggaaggatccatagagacaacattctctctaatatcagaagggaatgaatcgatcagtaattaacattaacctgaggaaagcgtggtatttcgactgcatattcccgcacaagttttcgatagcatccttcaactccagtagctcagagcaaattttcctgatgccctgttcaacacagcaggtagcatcagtgagtagagtaccatcaccacactagcaagaaggtctcagcaataaccagagtccccagttccccaccagaggccccagcagacacaaatgcaggtgaaccaacacctccatttaagttcaattgcaataaggtcaagctagcctaggttgtacttcagattgcattgcagtttgcttcaattataactcacaccagattgtattatcgcacacgctacacaatcaagattcacaaattataatttgttaaaaagaactcgatgcccaaactgctgcatagattaattagcggttgccccttgcaacaccaccacaccacagatccgaaaccgtaatataaactcgaccacaaagcgagcgaaatagctgcaaggagatggcgagcaagaactagccgagacagaatgtgggagcggggggagagggcggagtggaggaggaatgaaggaaggaagggggggcaaaccttctcggtctgcgactggtaggcggcgcggatggaggactgcggggtgatccactcgtggccagggaagtcctcctccagctcctcctcgctgctgctctccatcgccgccagcctccccagcttcgtcggaacctcctcgccgatcgagagagctgcggcttgcgggctttgcgcggcggtgtgcggcggggaggggaggg

SEQ ID NO: 23914 - DNA, 8694 bp, Oryza sativa
atgggcggggcgggtcacccaccggcagcgaccggagggctaccgtgtaggggttttttctgcttcgtctcgtctgcgatgggggtgtcatcacaaggtgggggtggtcatcacaaggacacagggggcccgggctgtcggtgtaaagatgctttacctggtgaaaccttttccctttcatttttttacctattgttaattttgttctattaaagcttggtttagttcctaaattttttttaaaaaaacatcacatcaaatctttaaacacatgcatgaagcattaaatatacgtaaaatctatttggagaggcctctcgtttttgccttaaccagcgacacctgaacgtgtggagaaatctactatagcgtactacatgcatgcattttttagaagtctactacatcacatgtatgttattttcctcttcaaacaaagttttctctcaaattacttatccgacctacaatccgattacaccattgtgttcgttacaattaaatcttcacagtaagatcttacatgattatattacgatgaaaaaatatttatatttgtaaattacttttattatatatgtaagttactttttatcatatatataagttacttttaaatttgactaaattacttcttagatatataaaagtaaattcaatagagtctaaaagtaatttacatatattataaaagtaacttaaaacaaaacggaagtaactttgtcacgacatagaagtaaattcgttgtacggataaaaatatgactttatctaaaaataaaatttaatcagcacaaatcaacacatgtaagtttaacaatttttaaaagtaactttaatgttaactgaaagtaacttttgcatggttcaaaagtaactatatataaatctgcttaatcatcgattgttttttttcttttatttttagctgtgtagttacgtccaatgaaaaagggcattcattaaagttactttccttttgttataagttatttctataatatatgtaaattacttttaggctttattgaatttactttcatatgtctaaaagtaatttagtgaaatctaaaagtaatttagatatattataaaagtaatttatattttttcatcaaaatataatcatgtcggatcttgttataaagatttaattgttacgaatacaacggtgtaattggatcgttgatcggatgagtagtttaagagaaaattatatttgaagtatatgtggatagtgtctctcatagatggagtggtagctggtttagacaaatcagctaccactagctgtatagtcacatccttaaatatagattaaaaaaactaattacacagttaggagggaaaatcgcgagacgaatcttttaagtctaattagtccatgattagccataagtgttacaataacccatatatgctaatgacggtttaattaggctcaaaagattcgtcttacgatttccaggcgagttatgaaattagttttttcattcatgtccgaaaaccccttctgacatccggtcaaacatccgatgtagcacctaaattttttttttcgtgaactaaacatgccctagtacgattcacatgtccatgccgaaacttctttttttttaaaaaaaattattcacgcttataacacccgcacacccacccatatgaacacacatgcacaccctatctctataagcaagacatattgttagattgacgaagtcactatggatgtttcgttgtccgtggcaaacaattttagatggtttatttaatgttattatatccatatttttttaacaagtctatcttatatcttatttatattaaggaaaatacgaactagtgttggaaaaaaattacaactaaatttaacaaagcctcttctccactacatccattgcaatcatgtccgctctatgttgtttccattcttgtcgattttgccatgggtgaaggaaaggggaaatagagaactaagtaaaatctggacggacaccaattacacagtagcttttaaagaccacaatagtcatccatcccaaaaaatggatcatagaaccattgaaaaaacatcgacaagtctatgccccaatcatagatcagatttgctccttcgccgcaattcatctacgcaaccatagccctccaccagtactagatggaccaccggtgaagcagagagataaggaaagaggtaattccaaataatgttatcatcatctccccctatgtaacgtgccatggacacagaacccatagccaattatgcacccataaaagaaatcacagaggcaagatgatcaggggatcaacagtaaaagatcctccataaacaaccaccattaacgacgaggaaagaaagaaaaacttatttagggaaaaacctaaacaaactactagatccattaaagggtggatttcccttcccctctcgtacccgcgcgccatgttggagaggaggaagaaggggactagtggatgaaacaaggttttttttggcagcgctaagggaggctctatgcaccaaagagagcccaagttgtattgacttgacgtggaacaataagttttatttgggtgcatcttttttgttacggagagtttttttttaagtgagatatgatgagagaagagaattgcccttttatagtagtagagcaatggaactcatggaattggtttttcgaagagttttaaaacaagagtgataattaggacggtttacgcaattttatcttaaattcagtgctatgaaaatagatgcacaacggagacacgaatttttacgtgaaaaacccttgcgggaaaaaaccacgggcgccgaccggcaatgatcactatagatgaattggatacaaacgcaggggatacattgggctgtcgcaccctccctgtgcggcttacaaggaatatatataggagaaatctaggagtcctaataggaaactaatcctataatacaaagtcatattagataactaatccgaatatattgtgggcccaaaatttggatcacatatttaacaatctccaccttgagatgaatttcccttgtagcataaaaaaacttcaatctccaaacaaccttgtgatgagaaatcaatgtgctccaaaatattcacttcgactataatccataacacccttaatccagaagaggtagaccatgcttcaaactcgccattaggaacaaatcctgaatctactggtatgatattgtggaacccagtagagacgtgaaactgatgcacaaatttcaaactcaccatgggaataaaatcctgaatctgctgacattaatttctagaatcctagcagaaacgcgaaaaattattatgctcaaaacgaagtacttagatctccttattaaccttccggtttgttgggcatgatggtagcaaaattcgccggacaatttgatcaccttgtgatctagacaggagcgaggctccctcttgaccacttgaatgtgcttctctttttttttcagcatacttctcctcctaggtaaataccccgctgcaaaaattcacttggcataatgagaatattgcatctcaatccaaaagcagtagatcaaacttcaaagtcgccttgggaataaaatcctgaatctgctggtacaatttgttaaaccctagcagaaacgcgaaacactatgggtgcatataacgaagttgatctacgtatacaacctcctggtaaacatggcttgtgaacgtagcacaaaattgaacctgaattggattcacccaaacagaaccgaagcaccgcaattgaattgaatccctggtacgaaggggcatgtgcatgcagcaaaaaccaacgtgaaattcaatacacgtgaacagtaacaaggctgagtgtatctgctgatttttctttccttgatcaacgtgctggagtagatggattgctgctttttctccaacacgctgcgcggcggcaccaaatcccgatcggagtcgacggctgactccgcttcgtaccagctaatcttatctcagcaaacaaatcaatctgacggcagcgatagatggaacgacgcgacgacacgcgcctgctactgccgatcagatcttgcgacgagcgtaccggcggctaaaacttgcagatggggtctccaagcagactaactcggcagccaagatggtagtagatcgatgctctgataccacttgttatgaaaatagatgcacaacggagacacggatttttacgtggaaaacccttgcgggaaaaaaaccacggacgccgaccggcaataatcactgtagaggaattggatacaaacgcaggggatacattgggatgtcgcaccctccctgtgcggcttacaagggatatatataggagaaatctaggagtcctaataggaaactaatcctataatacagagtcatattagataactaatccgaatatattgtgggcccaaaattcggatcacatatttaacattcagcatataatcacccttatagtttgatatatcttcaaaacatttcaaagaacaaatttcacagtttaaagaataggccatagatccagggacccgtatgctcagttggatacttggatgtggacagtgacgggttcgaatgaaatgaaaggccgaagctttaaattcagagtaaatccagctttcaagcccagttcaaaaaaaaaagaaagtcaaagcccaacccataacatagcccattcattctagcccatgggccgattcagtaagacgatcaggaagtctcctcgtggtgtcttcctctcgaatccgagcgagacattggccttcctgattcctcccttcctccttgctttggtcaaccgcgtgtgtaccgtagcgcccagctccggggggagtcgccgcgccgaggaatatccgctcgcgactcgcgaggatgatgacgacacggaacgaaaagaagcggggcgcgcgcgccgtcgctgtccgcggcagcgtcagccgcctcgcctcgcctgccgagcaccagcagacaccgcgagaaagtacaaatcggagtcggagctagcgccacccaccccgctgtcgccgcgctgaccccttccaccaccaccacccgcctcgccttccgccggcagcggcagcggcagcgccagcacgcggcggcggctagcggccggcccgctcctccaagacatggccgcccgcttcggccccctcctcctcgtactccccctctcctccgcgctgctcgtcctctccgccgccacggcgccccgtggccgtcccagccaaggtatgggagggttgtggattgttcacgatcgtgtccgtgctagagatttgttgttgttgttgctgctgcttcgctgaccaccttgttgcagtggatgtggggaggcagctgagggaggagttgtgggagagaaaccaagggcacgagatgctcaggtcgtggcgcgacggtgacccgtgctcgccgtctccatgggaagggttctcttgccgatggaaggacggcaacctcttcgttgtcaagctgtgagttccctgaatccctcgttctcactctcacgatcacggccatccattggtgctattcattcggctttgatgagaatttatttggtcgttcctttgaatttgttatatatgcaagtatgaatttgagttgaattgcaactaatgtggtacatactgatgtctttgcaggaacttttcttcaaagaaactgcaggggccgattcccgccgcgattggtaacttaacagaactagatgagatgtatgtttcactaatctttttattccaagtgtattcgtgctatctcagatgcttgttttatattcttattattaattgtgggtgcagtgatctgcaggacaacaacttcactggttctattccagaatctttctttgatctcacacacttgctgaagctgtaagtagatgctgttctttaccatttgctcttacaataaaaaaaatgactatgcacaaattccttgtgtcattctgggatatcaagagttttacataatttagatcatgctggtttcagttgatatacatctcacatatggacatgtcttattaaacatgatcatttgtccaggtcagtaaagtgcaaccccttcttgaacaatcagctacctcatggcctatctatcagcgtggaatttaggtgagatatctgttctgatgttcaacgtatatgatcttgagtggcagtaacataattgtactaaacttgcttatggaatataaaagctatggaggctgcgcttatcatagtccacctggagcttccaatcagagaatagctgttattggtggtgttgccggaggatctttggcatgcacttttgcacttggatttttcttcgtttgtttcaacaaacgtgaaaagaatcctcagaaaaaagactgctcttctacaagaagtacgcacccttctacacaagtttgttcccttatgcttaatttagatagtactcactctgtcccaaaatatagcaaactagtactggattagacacaacctattaatacatatccagattcgtggtactaggttatatcaaatccgatactaagttcatatattttgggacagaggtagtaggtgttttacactcttgcaagtctctttttgctgtttcatttgcatttatgtgtccgtatgtgcatttcgtgtgcatgcgataagaagccttcatttggtagatgaagccgctcttatatatgtctcacactttgttagatgaacatgcatggtagtaggccttgaaatttgagagccgtgtagtaaacaggtttatccaatttttgctctttgatggaggctcatcaacagaagtaggagctgcattcatcagttcatcgtgtcctataaaataaaatacacctcataatcacttattgtctaaatactcaaaacaccaataaattctttctataatgttgtatgcagatcctgtttttgaagaatgtagcacccacaaagctacaaactctgcagtacaacagttatcccttaaatcaatccagaatgcaacgtgcaacttcaaaaccttaataggggagggtgggtttggatcagtttatcgaggaacattagcacatggtgaagaagttgcagtaaaggttcgttcaacctcgtcgacgcagggaacacgtgaattcaacaatgaggtacagatgaaacctgcccctgctagtataaaggaatcttgttgtgggcttggggtgaatcaaattccaaaaaagttgttcattgtgttgcattctggtaaagaagctaaatatggattctttggccgtaaattcaagaacaaggaaatggtagcatcatcagttgtcatattgttgataactttgcatcaacaatcagttctgtttgaaagaatacattaataattagttgtttagtttttcagtatttatctactgaaatcattgttttatgcaaagttctgatcatcaatcaatcaattgacacagttgaggctgctttctgctgtgcggcatgataatttggtcccactaattggatattgctgtgaaaaggatcaagaaattttggtctatccattcatgtccaatggttctctacaggatcgcctctacggtatgaggtttcattagatttaatcactttcagtttaagacccttctttgataaataatatatttcttaggtgaggcgtcaaaaaggaaagttcttgattggcctaccagactatctgtttgcattggtgctgctagaggttagcatttagcactgtcttttttgtctggaaaggcctcatcccattgtttttattgtgattgaagaaaatcctttctgtgcaattcagggacataagttactctgcaaatgtctcaacattgcaaacgctttctatcatttcttttacatgatcgaatgcttgttttgcttgttcaggactagcacatctgcacggttttgctggccgctgtatcatacacagagacgttaagtccagtaacatacttctggaccacagcatgtgtggcaaggttgcggactttggtttttctaagtatgcacctcaagaaggtgacagtaatgcatcaatggaagtcaggggaactgctggatatttagaccctgagtaagttttttcattgctttcacaaaggaacaaaacttttctttcttttcttctatataacaatcaattatcaatgcatttgttagttgaaatgcctacctgtcttgttccctgcatatattatgtgattcaacatccggcttatcaattatgcgtctttctttcagatactattcgactcagtcattatcaaccaaaagtgatgtgttcagttttggagtggttctcttagaaattgtaaccggaagagaacctcttgatgttcagaggcctagggatgaatggagcttagttgaatgggtaagttctcattgcggaccaagtgaccaaccaccaatcacttatctatcaaaacaaatctctctcctcaaagaaaaaaaaagtgaaatctcatttgttcggacacctgcacaaaatgatttctagccactacaattctaacatgtcttacccttgtttgcaaatgtaggctaaaccatacattagagaatacagaattgaagaaatcgttgaccctggcataaaagggcaatattgttcagaggccatgtggagggttcttgaggcgcatccgcatgcactgaacctttct

SEQ ID NO: 23915 - DNA, 2749 bp, Oryza sativa
agggggatgtcatgcttgtgttgaaggcatcaagcaacgattggcaagataaggatatggagatgctccgtaaactatacccatctgtacagatatcagaattcagagatcatgcagtgatgatatgggaaaagcttcacaaacagagcagttttgcctttgcagtttgtactgattcaatgcttctgaaagtgccctcatatactactctttggtttcggtcttagatcacttcattgtttcgattcctcctccttcagaaagtatagtacaaaggatgtaattcatttaatgctactatattgccttttgcaatctttcagacaatttgagtcgcagttatcaacaattggatgagtgcgtctttgttcaaacaaggattatcgatctggttcacttaaatcaagctgtactgttcccgatgtttcttcccaagcgctatgatacaggaagtgtcaattcaaatggaatggaacaatatggcgttactatcaaaatcttgtgatttcatctctgaaatattctagatatcttacacaggtaaatcgtacgcaacagaatcaaaaagaaaattgagaaagcaaaaacaaatgtgacaccatgcccacaaccccagccatgtgtactcctaaggaagaataattcaataccttcaaaaccaaacagggagaatgacacgattttgaacctttggacgagtcgccacgaaaaaaaaaagagcaaacaaggatcgaatgtatgtatttttggttctccattttgaatttatggtttgcttgacaagattagagttccaagctataatatggttcatagtatttttggttctccattttgaatttatggtttgcttgaaaagattagagttccaagctataatatggttcttatatgagttcattgttacacactttccaatttccagccactccacatagtacatgtaaaaaaaggcaaagagtataactgcaggtaaaggtccatcaaaaacctccagaggaaggtaaatgcttcagcaggtgacttccgaaggagagcatgagtcttgcgctcattggtttcttttcaattaatgttaatccaaaaacacttaacaagacacagaaggatgacctgagggtaaatatccataaaatctggaaagagcattgggtccatctgttcttgatataagcttgaacagtaggaggcatatgcaccaagctatagctgaaattggcaatgagttgtataggcttcctccattagttccttagcccaactcaaagttcgacgaagtattgattctgaacacaatatcagatcaattagttaaacaacagctaatctaacatgcaaaaggttaataaaaatccaaggaaatagctgggcatgaaatgccttacccattttcatgtgatctaaggtatgccaaataattcatgactacctttatcagcagatttgtctgccccaaaaaattcacgagtccctttatcagcagatttgtctgccccaaaaaattcacgagtccctttatcagcagatttgtctgccccaaaaaattcacgagtccctttatcagcagatttgtctgccccaaacaattcacgagtcctgttatcagtggacttatctgtgggggtgttgtcaaggacttgatactgacggttagtcatgtgccattcattgacaataatggctgaatcggtaaaatgagaactacttccctcaccatcagaaggaaatgacactgcaccatcagttaatctccgtggtcgccggacaggtctgctgctcctgcttgaagatgggaagtttccttccgcgcccttctgctttgtcccaataaagccacaagcaagagcttccagagctcgggttgttggtgggcggcttctggtactctgcctcctctgctcactcaatagcccattacaggaggcattgatgtctggaagacagtcatccatcctgttggtttcagaagaatgtatagatctatccattgtatgtgtattcttgtcagaagaaggcacgatgtagctcacagctgactcataatcagaaggcacttgtggaatattcagatcaataacatgcttatcttgggacttttccttgagtaccattttttcatcggtagggggcacattgtactgcttgtgacataaatgaatgttactcatgtcaaagtttatggtagttgatgagttcggaattgaaccccatatgaaaggcttagcccctgcgcttgcttcatttgatttagacacatcatgttgtgcggtgtcaacttgcttcccatgctgtcttttattggcagcagtatttctgcgtccagttctctcattcttacaagatactaacctccttctctttgcaacagatgctgctaagaaaatctggggctcaggagttaccctttgatcaaactgaaagtttatttcagtggaagaattagtagcatggaccctttgagtaccgacaggaagaatagttgcagttgaggaacaggcattattcattaagctgaaaccttgatcaaatgacatgtgaccattggttgatgtcattgtgcctgcgaaagtagaattcttctgaagtacatcaatatccatcctatcacctgttggtggtttacatttcttctcattgacatacttagcacctgtcttgttttgatttgtatttatatgttcataagactgagagctgtcctctgagtcagagtgttcttctgaactgtcactcccagaagggctgcagg

SEQ ID NO: 23916 - DNA, 37364 bp, Oryza sativa
  unsure (1)..(37364): unsure at all n locations
caactccaaagtcaagcagtcttggttctgatgcaactttgcttaacacatcactaacagaatcaaaataatgatttcctctgacaagcttctttctagaaaatttctttacgcctggaatgaggaacactaaagcatgcttgccaactagagaagaatccttaggctgctccgagtgccaccctcttgcaagcaggcgaggccagacagcctcccagaatagatcattagattttgccttgcttagtctgaaatcaccagtcaaaaactttatgatgtctccagatgaaagcgatgagcaagccttgccgatagggatttctgcacgtgttgagataccatggtttctactaggatctaatgcaaatccagtcaagtcatattttcccttgccaattccaactgcctctacaagaactcgtgcgccaactgtggaccttaaggacaaaataaactcctcaaaggtagatgttccctcgttgaatgttttaaagacctgcaggacaccatatacctcttgagaaaattaacaacaaatataactcaatgcttggattctttgaaaagtagaatgacatgattttaatggttttatcatgaaatactagtgcattaatgctaatggaaggtaatcccaaagtgtttttagcataatgggaagtctagaaacaatgaaacataaatacagaagtgattgcaaacatcacctcacaacgcattaatgttcactaactcaaacatatctaacagggaatggaaaagagaaggtagtagttgagcacacctccaacaaaggatgttgaacttcccttgctataccagcaagcatacgtgacagcagttcctgctgtcttgtaccagaaaatatgcgcaacccaagtatacatctccggcttcttacttttctacatgcagcccatcgattatatgaatcagacctgaagaactctccgtagtaataggatagaacttctcccattgtcttacattgcaaaaattttgtcacctgaacaagatttttgccaaaaatatatagaccaagaagaaaagtttgtgcttcttcatcagtccaggaataatgtgtcattcctggcagaggaatataatcactggctttcccattttgtaagcagttaatatcttgttcagcagattttagaagtttctcatcatgctcatcacattcaactttacagcctggaacatttctaggaatatcttctgtgacgtggctattacattcatcttgtgaagaacatgaactgcgtcctgagaatcctgtctgctctttttttacatgatcgcttgttttttgggtccatgtgactggaatagctagtcccacaccaacaggataatcaaaaccgaaaattccactgtcatcaactggacatgaccttagtttcatgcgttcctcttctgttgctagatttggaatttccacctggtactcatcccccacacgtgggtacactcgtgtatcttcattaacctcttcaggacatatgggctctagaaaccgtggctgctcaacaagcatctctattgaatgctcttcaccatccttgatttcaataggatccatctaaaaaaagaatacaccagattgtgatccagaatggttgaacatatagctgagcaatacagtatgattatacaaatgagcatgtctacctggtactcttcatcattttttacttcaagatcatccatctgtaaaaaaaaaaaaacagtgaagtataaggagtgtattagccaactgttgagtggtcagtcgaaacccatgcatataacctgaacagcaatgtaaacccaggacaagtctgcaaacaacttggtatgaagattaaagggaaaactcatacctcaagcatcagtgagaaagcaaattttgtcattaacaaaaccaaattccagtccgatggacaactaaagctctaacatgtccaaatgtactgatttgtagagcacttaaagtataatgagtttgttgtattgaattatgccaaattccgtccttgaaagacatggtttttgtctttacaaacttgatctgacaattgaaatgcaagataaaaggcaagtacatttattagattttggcataatagataattaaaagttttatatatatatgacgggacggcaatataagagaactgcaattttaagattcaagaagcaacatagttagggccgatttaaatgcagcgtggttctttacagctcataagaacatgcaagttcaatattaggctactggtattaattattgaaaaaacaatggagaattccatgacctacaattgctagttctcaattatctcggagctagtagtctagaactcatgaacaaatgcacgccgcccatatctagacaattcaaaaaaggaaaacttttattgaggatcctcaggtgttcgcgcgggaacattggatggtacatttgatcaaaagatattcaaatacgctactagatccaaaacactaactaccttaatcattacattcctatcagcataacgaattacggcgcggaaagcaccaggagtgttcaagcactgaacccccaacccgttacaacaaaacgttcaaacctcccttgccacagagccccgatcttcgactacgcggggcaattacaacctcgaacgcatctcaaactattcccaaaacagttcatcaccacccactgcgcacatccacgccgccgctcgcgaaccacgaccgcatcgacatcgcatcccccacgcaatgcaatggaaaataatttacatccgcaacgaaggctctctgatccagatcggagggggaggctcacctcgcagtgcagcggggttagcacggccggggaccgaccgggatctggcgccgccgccgccgacgacgacgaccgctaccccgaccgtacgagggacacctgggatgggaagacgatgcgccgacctggaccctggagctcgataacgacgagcggaaaaaggaaacccaaaaaaaaaaaaaaagcggcgcggcttcaaccagaccacgacacggccgcgcgtcgagcaggcaggcggcggcggcgcgacagcagagagagagagacggcggggtagtataccgcggatacgcggtggtggtgaccgggacgagttgatgacggcggcggcgtcgcccagttggcgagggcggcgtccccgttggaggcgaggcgagaggggggggggggggggggggaataagcgagagggagaaagggctaggaccccatcattcagtggcgagcgacgggggttaattttaagctgctgcttctatagtgctggtctagagtttgcttgtggactaaaaaccgcaaaagctagtacaaccctaaacatctcccccatgaggataattgctcagaatggcagtatggcacatatagtaaaaaaaaatttattagttaaggaggatgtgggagtttaatggaccatgaaaatatgggaaactatgccgaatcgatgtgtggctcgtgagatactttgtccagattatgatttcgtatatagaattaagtaagctcatatggtgactactttgtgacgtagatcggtttggatgaaataattaagttggctgctagattgaagatagtagtatagttacgactataactctacgaaacaatatgatgtgacaataaatatatgataggataatttacaatcaaaagacgtgcactgtagcactatattactaccttgcattaagaaccggtgacacgtataatttagaagtgaatgaacatatctgtggaattttatctatcattaagttgtaatttgtgaaataaatataaacatcgaacgcttttctcttcaaaacactaaaataatggaggtgcacatgataattttttttgtgaagaataattattagcaagtggttagttgaatgcctatggtctaccatgaacagtgatagtagattagcaaatgattgtatcattatctccacgattacaacaattgaaagattgggtgtgcaatttaaattgttgtgatagccaagggcccaaggcataacatatttcatagtaaaatagttaggttaaatctaaccagcaaactgaagaggaggttttgatgcttaaagttacaatgtcactcaccccgtcctattttaagtgcagttctaattttctgtgtctaacttgtgaccgttcgtcttatttgaatttttttatgattaatattttttattattattggatgataaaatatggataatacctcatgtgcgatttttttttaatttttttcataatttttttaaatatgacggatggttaaatgttggataccgaaacccacgataacacttcaatgggacagagggagtatcttggaatggcaagtccaaagtagagggacaaagttcattcaaaagttaattttaagtgtttatctgcatgatcatctgtacaactgccttgagaaagtttaagcatcaacctcacatttatcatatagtatttatttatcatacaatattatcttatagtaatgcaataatagaaactaattctcatgttgaaaattggaactcattccatagcccaagactaatttctaaagtgagtttggattggtctactccacccgtaatcatgagtatgcttcccaatctgttaaatgttgtttatataattgtttattcaaaagaatcaaaatgaacctgctttttcaagtctataatattaatacttaattaatcatacgctaaatgcctccccatattttacgtgctgtgcaaaatcccaacaaacatattcaaacacaccccaaatggacccaatacctgtcagttatgaggtatctaggctcatcggtgtaaaataattaagggcacgatttgatcctgggcaaaccccatcctagtctcttctagcaaagctacgtatttggaaccggtataataatctggcttttggcggcgagctagcttgacggaatgagaaaaatctagcttgctgatcggctctcttttgacgacaaactccattcgtgtggaaaatattggaacgaggggcaaaacaaatccccgaaattagcgattaatctctgtcacagaaagcaaaattcaattgggaaaaactcagcaacaagaggcaaactcacctgcaacaactagccattaatctctgtcacagaaagcaaacaatccaaacagagaatgcatgacaaggctagcaagcgggcaaaaaagagatggtttagcgttgccaagctagactagctgggcgagcgaaccaaacgctccctaacatgcttactgtatctgtgcccatcattgatatttagacatcgttgtgatttatcttactatttactactccctccattttaggttacaagatgtttgactgctttaagtttaactaagtttatagacaaatatagtaatatttacgataccaaattagttttatttaattaataattatatacttttataataaagtatcttgtgtcaaaaatattactgttttttataaattttgtcaaacttaaagtattttgattttaaccaaagtcaaaacatcttataacctgaaacggagggagtataaaatattaaatacatttaatttaatacaataattatcgtatgagccatcctaatcatacattttttgtttggttcgatgtgcaccctaatcataaatggagctgcaggtggtgccaaaagagggactgccaaatggtttactccttccgttcaaaaaaagacaaaccctgatttccgtgtccaacgtttgaccgtccgtcttatttgaaaaaattatgaaaaaaattaaaagataagtcacgcataaagtattaatcatgttttatcatctaacaacaatgaaaatactaattataaaaaaattccgtataagacggacatttaatcgttggcacaaaaacctatggtttgtcttttttttttggaaggagggagtagaacacgagggagggtgccgtcatgcaatgcgtggaagccaccgaagtacgactagtgtggttcagtcatgttctgactcccgacggttttatcgagtactagtacagaaggaagcaaaccaagcgagttgatgaaaactcaaaacagaggacgcaaaccacagaatgtttccgtcgctgtctttgctggctgctgccacggcttccattcctcccgtcccttcctcccactgacacgcgggccccacgtcccccaccccacgacgtctcactgacatcctgtgccccacccccaccagcgcctcggcgcgtccgcctccgcccgccgccgccgcgggggccatcctccgtggaccgcgcccacggcgtgtcccctgcgtgcgtggcgcacccgcacgttttgtcacattccgcggcggcggcgtgcgtgcgggcgcagtggaccgagcccacgggctcgccaccgacgacctttctcgcccccgcccgcgcgccgaccttccgtacggcgtagcggagatacaaccgaggctttcggcgccgaatctcccgtccaccacctgcccccgtcccgatcccccgccgtccatccacctcaccgacggccggatgcgcccccgcgtggcgagatcgcggtcgcgggggcaaaaacccaaccccccaacccaaccccaccgggacgcgagcggtcggtcaccaccgtcgcgcacctgtttgaatcccactcgtgggccccacccgcgcgcagtaaattccctccccccacccccccgagagcaaaaaaatcccccgaccgcctgagcctccgcgcccactgacaggtgggtcccacgtaatgccccgggccctcgtgtcagcgacagcggagggaggcgggtcggtttgcggtgggggatgcgagggacgtggcgcccgaggaattagaccatttaactcgtcgccaccaccaccagtaaactgcgagtcctcctcctcttctcgtcgccgtgctactctcgctttctctctctctctctctcacttgttccccaaggcgagaagcagccgccgccggcgagcgtcgcgggggaggggagggaagggagggaggagcggtggatccgggcttgattggattgggtcggattcgattttggatcaaccccggagggcgggaggtaaaaacgctactactcatttattgctttcctttcctttctccggtcgatccggccgaaatcggcgattgctcgccgcggaatcccgattgggtgtggggggatgggctgatctccttccgagaaccgggagctcggatgcgtcgagttggttttgtgctccttttgctttccctttttctggattcgggtttccatattggaaggtttcttgatctcgatttcgtggcgagagctggttgctgaatcttatatagctttccttcttcttcttctagcggttgctacagatgcgttgagctttggttaatctatccggcgagagataatgggcgagcttgctgatctcgttgtcgtgccgtcgcagccgccgctcgccggcggccggcgggacaggctggcggcgctgctggagctcgcggcggcggatgatgttgatgggctcaggggggcgctcgcggagggaggcgaggaggcggcggagttggctgatggggtcgggctgtggtatggtcggagcaaggcgtacgaggcgcgcacgccgctgatggtggcggcgacgtacggcagcgccggggtggtctcgctgctggtgggcctcggcggttgcgtcgacgtcaaccgtcgccctggagccgacggcgccaccgcgctccactgcgccgcctccggtggctcgcgcaacgccgtcgctgttgtcaagctgcttttggccgctggcgccgatccggccacccccgattccgccggccgcttccccgccgacgtcatcctagctcctccggcttcgccagatgcccttggcgatctcgaggtgctcctcggccgccgccgagcactcgccgtggcgacctcggtggcttcaggttcgtcatcccctccgctctcgtcctcaccagatgagggcaacaggtcgccctcgtcgcgttcgtcgtcgctgtctcccatcactgtggatcgtgggaagaaggagtatccggtggatccaactctgccggacatcaagagcagcgtgtatgcttcggatgagttccgcatgtttgcgttcaaggtccggccctgctcccgtgcctactcacacgactggactgagtgcccgtttgtgcaccccggcgagaacgcccgccgccgtgatccccgcaagcacccatacactgctgtgccttgccccaactttcgccggcctggtggctgccctagcggcgatagctgtgagttctcgcatggcgtgtttgagagctggctacacccatcacagtatcgcacaaggctctgcaaggagggagcagcttgcgcccgtcgcatttgcttctttgcccatgatgaggatgagctccgccatgtgcctcacaacagtggtgccggcctgctgtctccccgcgcttcttcatccattgatatgactgctgcagctgcgctcgggcttcttccaggttctcctaccagacactttgcaccgccgcctgtgtcaccatctgctgggagcaatggaggagctgctgctgcgcattggctccaaggcagtaggctgcgttcttctttcaatgcaagggatgctgctgttgatgaccttggcatgctcctcgaatgggaatcacaataccttggggcactctgcctgccacccagcagccgcccccaaccacgcctttcagctggtctgagtatcaggccaacaattgctccatccaatcttgaagacatgtatgcttcagacatggcaatgtctccgaggttccctaatgaccaaggtcactcagtctactcaccagcccacaaatcagccctcctcaacaagcttcatcaacagaagggcctcttatcacctgttaacaccaacagaatgtactccccaagggctcttgatccgtcatctttggcacattctccatttggtggcatgtctccccggtccccccgtaccatggaacctacatcacccctaagtgctcgtgtaggagcccctgccacacagcggccttctgttggttcaccacggaattccagtgcttggggcaccgtggggtccccgatgggtaaggttgactggggtgtcgatagcgaggagctagtccgcttgagacgccctgcacaaccagggtttggagaagatgagacagatgtatcatgggtgcagtcactggtaagcaatgctgagcttaatggcaagaggggcgaagtacaaggcatgcctggtacttctgcattgatgaacaggcctgacctgaacaatcagggtgacttgttggaccagacggtgatcggtgcttggcttgagcagatgcacctggatcagaagtgatttccaagggaagccatgaagtcccaaagtggatgaagcctttattttgccaaggttatttaccaaagaatagttgttggtcctagtaaataataatttattctttttaattcttgaaatttttggtgggcaaagtcagagatggtggtcaagttcaacaaaacatttggtcacagattggtagctgaaatcagttccagagattggtaaacaacctcattacttggggtcctaactagtattcttttgattatctcagatgagtctttattttagtgggttaaaattcatatgttccccatggttattatgtccatgatctcttcctaacaaaagagagattataattgtccatttttcatttatcaatgaatgattttgttaaaacaatgtaagttacattcttaattttttctctgttcaatggaattaccttccttggttagtcctctattggattgtgttttgatgcgctttctgactgttcctatcaatgtttgagacatgggaatgggccactgccataaaattgtgtgcataaccatagttggaaatttgacctggctaggcaaaggcagacactaatggacataaaaagcgatataataactgctcatggtactgtatctaactgctcccaaaaatattcattatgtggaacaatggaaggttcgttctccatgattgttatccatgaaaccagtattatatttatttatttactaaaaaaatgcccgtgcgttgcaatgggtgaggactattttaatcttattattgctgtattatttagctaaagtgaaattctgggaattcgcttggatatttttcttacaaaattataagatacaattaggagtccgatcatctcatgttagcccgcgaatttgtttaaagagatttttttatgcaactccttttgtatttcaagtgtacgaacttaaaaaccgactcaaatacattccaaaagcgaatgacttaaaccgactcaaacacgatgacgcaccaaagtactgtatttccaaaagcgaattgacttaaaaaaccaactcaaacacgatgacgcactaaagtacgggtaaaaaacaacttcaatttttataatagtagatatttttataatagtagggatagagattactgcgtgttctgcaaatatggtcggctgttttctctatgatctactcggagtaagcctgatgtgtggttaatgccctcggattattcctcaaatcagatttattttctccattcatgcgacttaaattgttctccacgaaactcacgctaagggcaatagtttgtgttaagagacctcaattcatgtttgaactctgtaatctgaagttctgtaagtttacaatcgactgcagtttttcccttttggccaaaattgaatagtaatgaactgcgttgatcggtcttgtgtgaaatgagatgcattcattttcgcatcaaaccaggcagacagaaaaacatttacagaacctcatttgtactaggggaacacatccttgcacacaaatttcccctgtacactccgtgcagatcaactagcaagtatgtttccttgtactagatgcaaaatctgaaacgttaaattaccacatctcatgccaacagaataagtggtttgatagtgtcgatctagcttaagcgacacagaacctgtcatgctcatattcacattccactaacaagctggaaatcccatgaaaaatacaaagctggaaacccctaaataaataagctggaaagataatctaaataaacattactgtagcacatcgacacaaatgtatttgctgtgcccttgccaaacacacttaagaaactgatgaagtcaagctcatgtttcatttctgggggtgccagcctcttccgttgtggttgaatttggcccttcgatcgctgctctgaccgcttctgattgttcaggaccgtttattatataatttgctggtccaaacataagtagcacagtttagtttgcattgaagctgaaggttttagtgcaaaataagatgcatatcatactaatgtatatggagtgctgacataacacaggacaaaagcaaataggatgttgcacgggctactaaagcttgcaatattaaggtgatgaacttaatgtctatagtttaaaatggtaaaggactgagtgcagatgattgagaccttgaatgagacaaacacaagacataagagataagctatgaaatcgtgacgctgatgacaagtccacagaaatgctcaaaactaagctaaataaattgaggtcccaattcatctcgctattttatcatctgctcccagttgttaccacagttcctagttttttgttgaagcagaggtttgtcagtctagagaatcgatttcaaattctgtacctgttgaagcacccctggcggccatgtgctctatgaaatggtctcatcttcatggctgctcacgaacttgtctggtttgattagtggcaatatgatttgcatcagaaatacattcacgaaaaaatgcctaaagaaatgcatactagaagcagatacttactagttccttcgatagaatatttaggattctatcgatttttgcttgatgtttcaggaaaaacggccgcatataccttctatatacatgctttgctccctaagtaaacaataacaccattatcagcatgtacagaaaatcaaattttctagttcaccattcatcgatgcagatgtatcaagtgccaaacataggtcacaccagtcaacaaccttacaaccatccagaggaacaatagaacaaatctagccacaaacatagaaataatgtttagctagaccaaaagaataaaatgtttcctaagcgattgacagaagacaatgccaattgaacaatgatatcaagaaactataatcacaggttttcatctagatgatcacagcaagtgcttgaaatggaaaaaaaattgggcaaagcgatgcacagggaacatatgcaatgaacatactgattgagctatcatatagccaagactcaaaatgctccgggatggattgtcctaccagatatatggaacttgtcaatcacacgtgtcatgtctagataccactgaccaaataaccatctgacctgaccctgttagagactatattctccccttgattttgccattttgggttcatgttcatataaaacgtttgtcatgtggttttcagataatgaataccataataatattcttcagttcaggtcttatttcttgatagcaaaaccatagtaatgctttctctttggtcaattatgtagaaatatgaaaatatgaggaaacattttaagatcagagagaaaggggaagggggggaggggggcttacactgtttgaaggaaactggagccagacaagaatagcaaacttcacgtgataatagaaaggaacactgcagaatatcaccagagtataaatgttcgaaaagtttacaaggacatcaaactttacaagattagaaacatcaagttaataaaggcaatgtaaatttaaacccatgcccggcgaaactttcaaccaaatattcctagtaatgcaatttctttcagttaatgctacattccgcacatatactgtccccatgcactgtcaactattcgtagggtcctctttcacacatcctctccactggaatgttttgatttattccatggtttatataaacataaccagaaaggcagttagaagctgatcaataaagatcagcaactcgccaggttatacaggaaaattccctggtagattaaatgttgtgtcttaatgcaccatgttcgcttttcttaacttgaacatggacaagctgattgaccacgaccaccaagtagtgagaatggtgatgaacagcaaggattacttctttggtttcggaagtactcggcattgtcttggccgatttatatagtttttggtcagaaaaaagaaatgatctactagagttcaatagctgtaggcagcagtatattgtgtgctaggaataacatctccagaatgctacgagtagcactaaattcccataccttgaaagaatctgatcagcaaagatttccgcaatgctaaaagatccatatgctgcaaaacattttgaacaagagcatctaaaggtcaaagcagtaagtttgatatacatctgtatcttttctatttcttagagatgttcatttagatgaaagctgattacacaaataattaaccaactgcctttgtaactataaaccataagatcatacaggtatgtcctccaaggatgcaagtggccagccgctaacccacaatattaaatggccttttggatgggatagtaggctggcccacttgcatccctaactcctcagcaaagtaaccatgttaaggtgataggactagtaaatgtgcagagtattagctttgacacttcaaataactttctgagcatgcagacaccatataaataactttcgaaaaatgcaacaacctccgtcatcatttttcttttactttagcagtaatattatagcaattggtcacatagagtacctatcaatatactgaaaaggtgcttcaaagttaatagtgaaaatttcataggattttgttttattacagacctgcccaatacaagagccaccgctctttttctttttgatccttcttttcaatagctctgaaagtggagtacacaggcagaccaaccccaattgcacaactgcaaaagcatgaagtgagcataataaattatggacgaatttcttttccacaacagtaatagtagttcattattttgaggaaagtattgacagacaaaaaatatagtttttaggtttattgcagttgcagccattatacggataggtgactctaaatcaccactgtgtcgcctaatagccaatatgaatattgcagtttagattctgcttatctcacatcaatgatgtttatagatgtgagcataaacttgcggtaacgctttccccataggtaaaaatctacgtcattgcaatgtgctaatagcctaatatacgtaaccgttgacaacacaacaatgacagaagtgaatagctatacaatgaactaattgacatactcttatgatggtcctaaagagaataaactttcgatgtattattagaaaaaaaatcaatcaacataatggacaagcaacgcagataagagtaaaaatgcaatgaatacctggctgtacggatgacaacagtagagcttagtggtgccagtaagagccgtaaacccacctgtcataacaaatgcaatttcaatacaaagtttcaataaatctctgtaagacaagtatgggggtcatggaacttccaggaatccatcagaaaacacattatgagataatatgcgtaatataaatgtaatctctacctcatacaaacagattgattagccgaactgccccaaataaaaaagaaagaaatttgaagtgccatatttagaggcgttgcaaagtgcaaaaaattacaaaaggccataaaaaatgggctatcaggaaaacgttaatgtactgataaaaagggtatctatctgtttctgttggcagactggatatatagatttgatcaagagtgatgctcattgcaaaacgaaaataagttaactcaaagttaatttttccctaaaagcaagcccaaataaatttgaacgcgctgaaaaacgataaggttgagtcgtgtctgccaaattcccgtgagatgaatcctcacgtcaacgggtggtttggtggatgaactagaaagcgttcagcacaaatcggaacccacgagaaattacaactcaatcagctccacccccaataccatcccaaggcaatgggagcaaaatcgcatggctccggaacacaaaatccaccgaacgaagaaacccccatgctaacccacaatctaccgtgctcttcccgtacaatgaagaagaaagcgtaatccgaggcgcgccctcccccaatccaccccgatcgtccccccgatcctcaaaccgaacgcgccgccgacagcaacgtctcaagcgatctagggtttccgtacgagccagccaaagggatcgtacctcgccggagatggcgggggccagaagcgccatcggcgagttccgcacgccgcgcgggggtggaggaggaggagcaagggatcccgccgcggaggcggaggcgcggctgcggtttgcggcgtggagggcaaggaatccgcggcgagttcgcgtctccgcgggtaggtctcccctgagtccaattggtggggggatggtggtggtggtggtggtggaggaggaggcgccggcgaaagcggggggagaaaccagaaagcggttagatggaatcgggtgctttgggggcccttttccggtttagtcccaatcttactctagatttttaattaagagtccatgtcttctttcgatttcagaaatatattaaatttcttcagataatccaggattctagaaatttcgattatcaataaaaattcaatcaagaaaaagtaactttttcttacttaaaaatatattctacttcctctgtcccaaaatgtagctatttctagcacagtaccttgtcttgaaatgaagctatttttccacctacctcctcctctcaaccaattacaaatattctccttcacctaccttttcttttcatccaattacacaacttctccaatcattctcacatactttcttaatacccgtgccaacataaaaaatgctatattttgggacggaggaagtaagtaatttatgtatagaaagattatgtaaaaattgtaccgcttataaaaacaaaaaatgtgttcgtgccataaggagaaaagaaccgggccctaaagaatggcaaattatcaatcgagttttagataagggggcatttaactatttgctactcttaagatgttatgataacagatttgccactcgctgtctgtaacatgtgggttctcatgtgtctatgatatatgggtccaatggcaaacctgttatcatcgcttgtaagagtagcaatagttatttattccttagataagtggcacatcctaattaaagtgctcgtttgaagggtggtaatagggcataaagagttatattaaattatcccacattcctacttatcaaaccgtagcggcccgtttggttggattgagtttttaggagggattgggagtttagagggataaagctattaactgttttgtttggttgtgagacatggaaatttcggtgggatggggatgagaaattgaggaaggaactacctcattttcaatacatgggtagtggtggtaattgggagggaattcctcctttactctgcctagaaaggaactccctccttttcaatacctggcagggggtggtaattaggagggaattcctcctttactctgcttaaacaaatctcaaccatccgttttcattaatgacctaatcttcaactaaactctatatcaatttccaccacctctaccaaacaacatattgggattaaaaaccaaattcccatcttaatctcaccatcaattaccttgtgtaaattcccaatccccttctctgaagttgccaaacaagccgcagatgagccctccattttcttctcagtttaacagcaaattgatatggcgattgatacagtgaaatcaatctcagtgagtcgtgaaacagacaaacagtttaatggtggagaaaagagtctcgagtctgctgaagacaaacttcatctttgcttgagacggtcagcttgcaatttggctgtcacaggcaaatgcagcttttagtaagcgtgattccagccttcaaatttgaaacgaacgggtaaacatgattttcaccagtagtttttgggaacaggttcaaagcagagggaatgcagatctacacatttcgagaaacagaacgacagaaaactaaaatacaggaagaattcaacatatccgagatatctaatcttattgctgttcaaattttgttgcaacagcaaaaggtgatgtttatagcaattacaggaggcttagaaaatataaataaattaaatacagtctatataactgtaagcagctatgacaaaataaactactaccctacttgctcttcttcccttcagtcttctgatactgatatggtgggcagttggctacctgaacagattcagatcagaatggataaatgccgtgtgagatatgaaagggacattcgggtacatcccagcaagagcgcatcgcatgcactcgagcactgtgaagatctgtatgaaagcaatagccatccagaaatactgcataggcgtcccctgatacacgatgctgggcatccaggtgcacattgttgccactgcttgggagccagtgtccaggaggatagccaagatgacatggaaccttagaaagtgcggcgaccacttccgtctcacgacaaagaagtacactgtcataaaaatcaccagcaaaagccatcctggaaacagtgtcattgtatcgatgaaggtgtacaccaacgaaaacccctgcaagtatgtgtgtagctggtagatgacatcggcatatgaccacatgttgtggagtggaagcaagtagggcacacatgctacagtcctccaccaccatctgggtttcgaagtcaactcagggtagctgaatgacgctaaagaggatgctcgacagccaacttcaagtcttcgatgctgactgtgtcgtgctgccagtgatggaatgcccttgatagaatcatcccttccgaacgatgcaagcatgtcattctgaacaaaaccagtgccaactgcaagatatatcagatatatcagatatgcgtcagaattcaaagctctgaattacaaacttactgagaatcaaagacaagtacaacctacacaaaaactgtctcactgccgatatatgttctggctaacatctaactagatagcagcagcaatacaagctttcttcaatgtatcatgagttcacgatgatatttatttgacccaattttttttcgataagctgtagacccatttcaactaccacctttattaaaacctaataaaatcaacattttacacaatgtggtgcgtatttacttcatatattggcttgtacttgtactgtctacaatatacagttcatattggtccttaaaatgtgaccagtgaatccgaaaaccagaagttccagaagggtatacaagtgcacaatatcagactatcaactggaaaatagcaacgcaatatattaaatataatcaaatataattgacccgaatccacaagatgttgtcagaaatcacaaataggataatatggcatgaatatgccaacatggcaacaactacaaaagaaatggtagttcagtgctaccagccctctggacaaacgcattgtgtttactcgtaagtgctgaagagaaaggaaagaatgtagggcaaagagtgagcatgtcatcaaaattccctagtgcttcatattttaaaagaagttagcaaaaactatgtgccttatattatgaaattgaaaaggtaaactactacttataatcagtcataagtcatcataagtactatgtgctgcgtgtacacttcgagcagcagaaaagaactgcttacggtgttagaatttgacagaagccccccagaacataaacaaaggttacagccactcacttaatgtacaaacagaattacaaaatttgtgaagctcatgataatatggttgttataattcatcgcaacatgcaagtgagagaaattaaggaaagcattatgggtaataaagggcatataaatgatacatcacaacaaatttaaatgagagaagcaacttcgtctaatccatacctcgcaaagctcccatggaaaaactcttcctttcggcatgaagtcgcgcacgttttacactccatgatcccgccggagtacccaggcacgatgttctcgcgaaagagacattatgcttagccgcaggaaaggcaagcagctgagcgtgtccagcagataagccttgacagagaaccattctgcataaatacagcccttgccgaatcaccgaattacctggacagacatgtgagcgaatcggatcactggatcgcagagagcgaaacatttgggttagatttgcgcccagagaataaaaaaacaagaacaacatcaaaacaatccaatcaagttggaatccatcacccaaccactaaaaccaatccaagtccggatggatccccacactaagcctgatcagtatcgaggaggattgcgagagaaggataccttcacaccgagccgaggtggcgcttcggcgagaggagacccgacccgcccacccgcgtgttcgccggagagaggaatcgatgggcgcttccgccgagacggggaggcaaagaggcgattgcagatagggttctcttttccccgatttgcagatcagcccctacagttgcgggaattcgcatagagaggatattcttttttttttctctcgtgtaacctgtcaaaagcaaaccaagggtccaattctagaatcgcaaaacctgtagctttaacatgcttcaaccaaaatctgatagtagaacatgctccatctacagaataacacggtaaaacacgaggctaaaaaacagcaaaatggaaaacgcagtaattagggacatgatttctctaatctcttattcactgacattctcttatccctaagcctcttggctaactcagcttgcctactttgaggctaggcatacacactagataaaggaaaaaacaatgagattagtctgttttagagagttttagattataagaaacaactagtgaaaatttagccggtgagaatatggttttttttagcctctggcttctaatttatttctttgattcgacaattacaacttcttaaaatctggattaaaaaactgaattatttaagagaattttgaattcaaggagaagctacatctgcccaaaaactctcacaaacatgccattaacatcatgaaaaatctactccaaaatcctctatacaatttccatttgatatcagaaatctattaacttattaaaagaatagaaaaaggagctccacgttcactctcacggcttagaaattctcatattaatcgaagaaaaagaaaaacagagtccatatagaaatacaatttagaaatagttcaaattcgaaattaaaaaaataagaatattggaagaggagactagagtccatatagaaatataaattataaataaccaaaattctgaattaaaaaataatattataagaagagtatagagtccatatagaaatacaattaagaaataacaaaaattcagaattaaaaataaggaatattagaagtagattatagagtccatatagaaatacaattaagaaataacataaatccagaattaaaaataaaaaatattagaagtagagtatagagtccatataggaatttaaaactaactaaaactcggaataaacataataaaattaaaagaatagtttacaaataactaaaaattgatattaaaataattaataactaatactatataaaatacaatatgaatattatacattagtagtttcgtaaagttagtataaaatttaaaattatattgtcattttaatatatttgaataatacattgagaaaacatatatgctattatatgagagaaaatataatgatgctagccgcgcaatctacgcgggccaccatgctagtttcaaaatagaaaataatatgtaatcttatgcttcaaagtgctctatagaatattcttctctaataggttggaatcctataaaactcctatctttctcatacaaaccgaaacgggcataattttttacttgctccgatctaaaatgttgttgcaaattagcctccaaaaaacatgttatacatttcggtaagggaccacctatacatttatcgacaaattttctactaaaaatttgacagatgtaattatagtacaatcgtagtgtaattacactgtaaattgtatgtaattacactgtaactacagtgtaacttgtatgtaagtttcatgtaattttgaatcgttagatctattacaagatttgttctggtgaggaagaaaaaaatcatagcacacacatatgtgaaaggatttgttcccacgacctctattttactgaaataacatgttaccgagagattcttgaaagttacatataatttacattatagttacagtgtaattatatacaagttccagtgtaattacactacgattgtactgtaattacatctgacaaatattagggggagaaatttgatgacaaatatctagcaaaatcgtttcggtaaattcggcttcttcttttccacctttgatgatctcccagttaattgggtctcttttatggacctggaaaaagtacttgtctacttgtacgctataaaaagattggacctctacagccccacccaaacgggcccctgacgggctccatttagacatggcatgggcctgaaagactccagaacaactcaggtgcccttggggaccaacagtcacgatcaactgtagatttaagagcttgtagctccatctctgagctagagtttaattagacggttttagatttatctcaaaataaagtggagctaattaaagtgttctcacaaaacaaactaaataggtaaagctgagtttaggctgctcaataatttcactctagacctaactcttaaaagttaaatttaaaggttggaaccctactattgatggtgagagagagtatctctctgtttgcatgccttctttctataaagtcatataagtttttaacacgatctccaaagaaaaaattggcaattattttttataataatttagaataactataaaactagcatcatatgtaaatatttaaatatgaatatttatatcacatgcatgactctgcatatgtctttttatgatatttattagtcaaatttacaaatgtcgaccttttttttaattacgtacatgccttatatttatttttatatgtgggagagtagtacttattacaacggtaaataattgaactcactaaagttttattaaaagtgtaagaccgacacacaattatatacaccacgggtaagacttgtctaacgcacgttagaaggatatggtgcactgacatgtgagcccataatggtgggtcctacctgttagggacccacatcgctcttattttacataaaatgagctacatcctatacaccataatcatgcccaaaatatatccacgccacacgggtatatcctagtatgtgtgtgaacaagattggttggctagcatcgtgtggttcatgtgtaactgttgacatcaaaatttaaaacctgacatcctgttgttatcgggtggagttatccatctacaactccaccaccatacatcatctttttcggttttcattgtaatagtatgtttatcaggttttatttgtttcgcagtaatggttaaattgtatttcaaataccatgtattatattccaaataaggcgtttttaatccggtgaccgggggcggtgggagacagccatttgtggtagggtgtcatcgattcggcggtgttagctaatcgagagcgtagtcatcctcatgaaattggcttgcaaggtgagccatcactaatcttaacaggaaacaggggtacttgcagctttgaattggctgatgacacgctcctgcaatgcattgctggccttgtccttgtgtattaatcactagagccacatctccagattttttttaggagaaaagtgtcactgggccaaccttgcattcagacgtagtaccagccagtcattaaacgtaaatcatggccaaaaaccaaatgatttgctggaatacggcgtcttgatgaagagagactgcaacttcttatccaggcgacgcgataggaaaaacggatccgcctttatcggaggtctaaatgctgaggtgagaggacatgttcaatttctgaaccatccgattgaaatcctatggctgtgatcaagtgatacaaaaggaatgaaacactgcaaaattcgcagaggcagtacatccgaaaaagggtagccgaagtacccccaagatactgtttgtgttgcagtgaaccgatgcttgtcttctgggactatgcttcaaaaatcgtcaaccaaatatcgctccctagcagtttcgtcctcggaaactgacaaaaatgagtgaaattcagatagatttttatcaaaaaaataaatttagtttgattcttattttttaaaaaagaacttgggcgatttaccaagtggtttctggccacaaccagctcaaggcagctaataaccgcgataaccaagcggtaaccgtccattttccaaacctgtttgggacacaaaacgctgtagcgtctgcagctcgtgcggcgtttaacaccaaacaagttgagagaattcagggggcaaaaggtgggagtcaagccgggttagcttcaactgcaacagaggcttgtccgatgctacctgacctaatctgcatccgatgccggcaagacgaagaaactccggcctaggggtggtcgcagacacctgtgccaactaaacagaaagcaacgcgtaccggccagatccaaccaattctaggcacatttaagtgctgctttgctttgtttttgtttcgttttggccccagtgatgttgcaattagattcttgaccagttcagaaagtccaactttaggtgttcaaacatgtaatacagtcttaattaattgcccgtctaactagtgctgcagtgtacctgtcccatctttttttttatggcagcaaggccccagaccttattttctgtggagacaggaaacattagtttgggtatgtatgtattgctcggttgctcctcatcagatgggcaatagtacactccaacattagaattctttcatattttctgaatggtcacagggggagcacctccatctgaataatgttcattaaaaatcttcatgttaaactgtcatttacacacaacaaaaaagaattgtaggaaagtaatgttctacagatttcggataacaaaataagctatacacaccagagaaggaagagaagtagttagccaacagattttggaccatccattgcgtgtgttgtaagttcagtctctgactttcagtttcagagtataaaccaagcattcttaggaaaaaggagtaataaaacagaacaaggttaggaatgcacaaaaaccacctacttccttttcctttctcttgtacagtacatttcgccaaatgtttggccacccgtggggcatggatcaatataatctaaatacaaacaaacaaacaaaccttccaacaatcacctaatgcttcatacggggcaccaaaatgaaaaatagagcagtggaaatctcgagaaatgagaacggaagaaaatagtcgtcaacaaagaaccaggaaagctacacaaggttttcatctggggaattcacaacttgcctattccgtcatctatctattgggtagttgttaactgcaatgatccatctttctgaagttttaggctgaggctagtgaaccgttctcttgaatattgtcttgaggctttcctccaatctgttccggccttcatcattgccgcaaactcatcatagcttatcttgccatcctgaaagtacagaacaatgctattaatactttcagagtcatgtgtgctatgaatcattatgtcaaaacattttgtgcacaccaccaaattaattaaactatttgaagaagaaaaaactagcagtctatcaatttcttaaaactagtcaatgaagagccacaaaccttatcagtgtctacatcacggatgatggcattgataacctcttcatgatttgctcccaggtcatcagccaatgattcacggagctcatcgatttcaatatatccactctggttccgatcaaagtatgcaaatgccttgtgcagatgctcatcgttgccaatctttctcaggtgaacagatagagcaacaaactccccgtagtctaaagatccatttccatcgacatccgcctggcataaccatggataaatagtaaatatacgaaacccagtagtcattcacaacaatagtttgggaaaaatgcattcgagagcaaataatcttttctagttcaacaagatataaagatagtttcccatttttttcccaaaatttggaggggtgtttggggagagaggaagaagggtggcttagggtaactcacagcatccattagtatttggacatctgcatcagccatttggtgcccaagtttatgcaggccaagcttcagctcatcaaaattaatcatattatctttgttgagatccatcttctcaaacatgtcctttataccagcaacctcttctactgaaagatgctcagctatgacctgtagtaaaacaaaatgtgagaatccagagcaaacaagactactattgaaaagccatagttaggtttgagggtcaggtcaggctgaggagtataccctaagtgcatgcttcttgaacttgttcatcacagagaattgttgaagtctggccttaacagtttcgcctaaatttacatttggagccttcttaatgttctgtaaccaaggatgatctggaagaaatacaagataaggttgtcagccaaaaacaaccaagttaaatgatataagggataacatcttcagaaaatcattaagctttatcatttctttactcatccttttgcaaggtctgtgatatcttggattagaagttaacaagttatagatctttgtaactcagaaccaccacattttcaagcttgaaaatttttggtattgttaaagaacaaaagaaataccaatggttggaaagtttctgtatcagtcaagaacagaaggaaaaaaatacaatatattaaaccagtgtgcaaattgattattaccaagcacttgttgagcatttagccgccgcctagggtctggattgagcattcccttgacaagatcctttgcattatctgagacccttggccatgggtctctcttgaagtcaatgacagaacggataattgcctgagcaacaccctgttcagtttctgcattataacatggaaacaaaagaaggatcaggaatagcattcaacattacaacattgccaggtctacaacagacacagacaaaagtaaagattgacagtttctaatgtcgcagactgcattagtgcagaaatgtgatcagaagaggtcaacttctatacactaaatacgtagtatttaatttagtttatacatttggttatcagaattgaagaattcatgtacaaaactaacctgcccaaaatggagggactccacaaagaagaatgtaaaggatcactcctgcactccaaacatcaacctcagggccataatttctctttagcacctcaggagccatgtaataagggcttccgacaatctcagtgaaccgttcacctgcacataatcaataatcacttaattagcccatcggaaaaatatatacacgcacgtatacaatgtgaatagacaacctaaggtaagcccttctagaggcactgtgaagtcatcatttgacaactgagaactgactgacaaattaaaacagcacgcttgagatataggaaataaggacattgcgactgttagactgtacctggggtgaaaaaaacagacaggccaaaatcaattgccttcagagctgcagtttccttcttgtttgcaaacaagaaattctctggtttgaggtcccggtgcatcactccatgcttatggcacatctgatgttttacagacagacaaaaatacacgttattcatcacactatggaagaaaaaagaagttgcaacaatctagttaccaattcaaagaggcaggcatggataactaactaaaaccgaaactgatcagagtctaattaatcagacaaatagacaacagaatcatctggcatgtagcaaaagaaaacgattcccacattattggagaaacaaaagcagataaaaacatgaacttttcagttgttgtcatctagtaacaattctaccataaatctccaccagtgaactcgatttcttttcattatactgtgagactacctcatcgataacgacgacaagaaatcaaacaggatcatttcagaaaatacagtagaaagcaacgaaggaatagagaaatcaccgaagctaccaatctcacctgcacgacctcgacgatggtgcgggtgaccagcgcggcggcgcgctcggtgtagtggccccgggcgacgatccggtcgaagagctccccgccctcgcagagctccatgacgaggtggacggcattgtcgtcctcgtaggtgtcccggagcgtgacgatgttggggtgcttggggaggtggcgcatgatgtccacctcccggcgcacgtcctcgatgtccacggcggtgcggagcttttcttggagatggacttgcacgcgtaggcgtcccccgtctcccgctccgtgcagaggtaggtgaccccgaactcgccgcgcccgagctccccgcccagctcgtaccgcgcggcgatgtcccgccccgtcggctcgcgcagcaccaccagcctgtgccccgacggcgccgacgaccggttgtactcgatcgagaacgggttcggcttcttccccttcttctgctgctgctgctgctgcttcggctccttctgcttctgcttctgctcctgctgctgtttcttcctcccgcggccgctgccctccggcgtcacgcagcagttgcccatctcgcttcagccaagatccgcgcgacgcaagaaccccccgcgaatcaaagatctgcggcgagtgggaggccaagaaatggcggcgtgacgcgttgggggagggaggagaaggaggcgagaggggggaggaggaggaggagggggttaaattgggaggtggggtggattcggtggggagacggggtcagccgtggcggcggctggggggcgtgtgggaatccgccagtggtaaagccaacgacgaggccgcggaggaggggaggaggaaggtaggagaagacgggggtgctggtcaaagatctccctctctcactcggctctctcggctctcctttttgcatcctttgccctcttctcttctccctagtttttttctttttctttacttttttttccttttcctctcatttttttaagggacatttaacttattgcaacttttaagctgtagcaattaattatttgtcactcgttttatatgacatgtgaaccgtcgtgtctctatgacatttgggtccagtgataaataatttaacaccacttgtaagtggcaaatatttaattaattctttttttaagctcttccttttcctctcgtgtttattttcccctctgttccccttgcttgtgctatggtgtgtgtaccaatggttttatgttaaagtagttgtttagggcattggtaatgtgtgtgttgattattgttttttattaataaagattattaaaatgtatgtaagaaaagcttttaagaaattattaatgacatttttgcgtaccaaagctttgggatgagtctatattataccttttataactgtcggatttatctaaaaacaccactcaactataaaaatggacactttatgtcactctactatgaaattagacaatttacacttacgccactcaagtattaagatatgagaaaataccctctaagagtaatacaattcggttttggaggtgattttttaaaaacattttgacatccaaataattttttttcttatttgtatcgcacccaattagtaagatatgtaaaaaaatcaatataaataaaaacatgtattttgtttttctcttatcatgaaaccaccatcaaaatcaagttgtattgtccttgggagaggtattttgccctttttattagttaggagtgtacaatatccggttgcatagtttttaaacaaacccgataactgagtgatgtaatataggcttatccctacattttaatatattttcatgcattaattggttaagattttgatgtttacctaaaaagtcttaaattgataactgtttaagaagggactatgttgattgtgttgcttctctcgttttcctctttatctcgtctgatgatcttgttttctggtttccccccatccccccccccccccccccccacatctgatatttttgtttttttgtggtcctggtgtggcgttgtttatgaggaaaatgactttgaacaaagttttcatgaagtgattgaataggactaaaagataaggagagggttaggtgggtgattaaagtgacattaagcagcatttgtccaggtttgctgcctaatcataagggggcaacttgacgctttgatgggtacgggaaggtagtttaatcagattgtggaaaaatctagctgatggttaatgctaatcggtttagctattggtactaagatggtgtaatttcaacgataaatcaagaaaaagttggtcgtactcttgttgtaacaccaggatattctttttcacttcctgatagaattgtgaatttatttttcgaaatagaccctcgttgtaaattgtaaccacttgtgttctgacaactcctgttacagaaaacaaatctagcgtcacagttttactgatatggtggttagtcgtgaattatccgaatatacatttccttctgctttgcaacatcagtgtatcagtattcagtcaaggttttgaggggcgactaattctcgcctaatttgggattggttctttctttttggctactgcatgcctgctgtatcaactcctgcttgtcaaatacatctatatgtcaacttccaaaaagaaagcatccttgtgttcagctaaaatttcttctgaaacatttgcagattcaacagaaagtcaatcgaagccaattcaacacaaagtccatgggcaatgttacacacgagggaattgacagctgaaatgtgaaagtgcgtaattcctcagttgttcaaccgcctcctttttttttgcgcaactgcatgcgttgcgtacgttttcacaagctgaatttgttctttagcttgtcgagaagaacgtccactcaaaagttttagcttcaactgtggaactagtattagtatttgttctttaactgtagagtagttgctatcctgaacattttgtagagtttaaaaattttggtcaaatctttgtactacttccgccggttccacagtacttaatgtgtcagggttatggatatcacatacctaatagtagtcgactaaatctcggcaggacccaacacataccatgtcttatacggaaacaacctccggatataggaggagttccacataagaaaagatgaatagagtttctacatggaaacgataaggactactcggattgtatccatattggtctctctgttctatttggacaaggggacacctatgggtataaatacaagaccccctaggaggagagaggacacggaacaatagatcaagacacaagatcaacatacaagccaacatgcgccaagataagacgccggatatcgacttcagagataagcatagctagtcccctacgatgtctacgaatactgttaggagagacatcgcgttgtctctgatctcgccgggcacgaactcgatgaggaagactaccctattttcgactacgggatggtttcatggccgccatatcgacaacagttagataggctaccccaaatattgcactggtgtgattatggtgaataagagcaacgaccggcttcggccaacatgatgtagggctattacctgacaattcaagggtccgaacctgtataaaaatcctcatctctgtctcttttacctaagtctcgcatatatcctggtaccaacgatccccatactatgcaaataccggaatcgtgacattaaacgtcgacataatgttttggataaaattaagatcaaaattttataactttaaacttcacacatatttaactttaagacactataacatataaagtactataataaaagtaaaaatatataccatccctccataaaaaaattcaaacatagctataaatttgaacacacatgtgtttctttctatctagaattaggtttctttaaaacagagagagtatacctattatatatatatatatatatatatatatatcataatagaaaaatatagttcaagatatattttaaagaccgtgttattgtttaaaacgttaagaattatatagctagagaggatatgtactgtacgacggaattctggtggtgttcttttctcctgaagatgaagataaagattaagttttttacgtaaaacaaggtggtattaatgtatgatttattgaggtttaattattacaaacttaaaaaacatattaatatgatattttagaggaactttcatatagaaagttttcgcacgaaacataccgtttagcagtttgaaaagcatgccatgaaaatcttaatcttcatccaactcttatcggagagaagaacttgggcatgtttagatcccttggtaaaattttatatcatgtcacatcgaatatttggacacatgtatggagtattaaatataaacgaaaaaaataactaattacacagattgcgtgtaaattatgagacgaatcttttgagcctaatgcgtcatgatttgacaatgtagtgctatagtaaacatttactaatgacagattaattaggctaaataaattcatctcgcggtttacatatggattctgtaatttgttttgttattagactacgttcaatattttaaatgtgtgtccgtatatctgatgtgacacgccaaaattttatacccgtggatctaaacaaagcataagtttgaacccattttcctatttgaagcagacgtggccactcgttcatctttttcatgttccacgcggtgggttctgtggctgttgcccgtgttccttaactgtcacaggctcacagctcacatcgtcatggtttttcatccactactcgtagagatccacttctcatgaattcatggccgggggtcgctgtctgcacgaaccgggcatttatgtttccgtgttgtctcgccttgcatccggtggatgctaaaagcgccccagccgaagagcgtgccaagagaacagcaagggaagggacacggtcaggtgttcacaccctctgcggtggtgttatttatttatttatttattttgttaagatacatattttacctttattttgttagcaatttttttcaatcggtttaacagtatgtttttttccagataattttctatataaaaactgttttaaatatcaaacaaatctatttttcaagtttacaataattataactaatcatatgttaattgttttttcattttacgtgatcttactacaacatcattgtttcacctattcttatacttatttgtatcgcttattgtaaataaaaaataatctatagcatgtcttaacggtaaaaggcaaatgttataaaatactatttataagtgtgttaatcttcgtcttcatctgaccaagttcaaatgggacctgtgtctcgcggtttcgtggtactagttaagatcctacacggagcattcggtgcatatatagtgacttggtagtcatatcatgtgggtgagatttctccgtggaattacgtgatctaccacaggactttaagtgagtagttgtgtgtgtggggtatgagattgcgttgcaccgtccatgagctcaaggctgcaccataggtcaagagtttgaattctgttcctacctgatgtgaaatagaaggataaaaagagcaggtttgacattttctcaaagaaattgtcaggttttcgatcacttggaaaataccataaaattaatggctaggattactcgagattcgtggatacaataactttatcccctcatattcttccccgcaagctcgtccgctcgttctcatttcatttgacgccttacagattgaagcgcttgccgtcgtctcccctgcccgactgcaacgcccctccccggtctcaccgactaaccgaaacgcgtgaaagttattagtaaggcccaacgcaccagtcggcctcctccctttcctcctctctccttctcgtcctccctaagttgggtggcgacactattccccacccctgccttgcctcacctcctttgagctggatacatcgtcaaccccacccaccgctatccttcatccatgtgacttcagtgacaccccccgtccactgccgtcacccaaagccatccctctaaaccccacggaatcccctcccacctctgcccccaccccagcgctaaactctaacctcatagccatctcattattgtcatcgaagaagagcacatcatcgccgggaagtcaccatcacaagtgggtcgtattttttctccccaccctaccccagcacacaaatcaactcttgaagacaactccctatcggtcaggagcatgtgaggtctcaccttataactagcaatcgctttgtcaaattacatcttacattttacattttatatagaggaaaggcacatacctgactgtttttatatagaggaaaggcacatacatgactgtgtttcctaaattctgatcatttttatatcaactatagatagacaattttactccaattaatttgtcttgtccaatgaacatggacacttgttcaggttctatccaggttcattgttttagtgttttaggacatgtcacattctatccagtttttttttaaccgaggagtaatttaaacgtaacttgtgcagtgaagcaagcggtcagtgctgcaatcggctgagcagcaggtctcttccctgatagcacgaatttcaaagcatatcggatggcaaaaaaaataaaaaaaatctagccctatttacagtaggtacaatagcagactataagccatctataaataaatttcgaggagataaaagaaaagagtgaagagcagcgagcgagctacaaatttgtagccagctgtagcacggactccaagatgcaatgtgtatatgacaggtgagagtagatatctattaacttattaaaggaatagaaaaatgagcctctacgttcgctctcacggcctagaaattatcatattaatcggaaaaaaagaaaaatagagtccatatagaaatacaatttagaaatagttgaaattcggaattaaaaaataaagaatattggaagaggtgactacagtccatatagaaatacaatttagaaataactgaaattcggaattaaaaaaaaagaatattagaagaagagtatagagtccatatagaaatacaattaagaaataatagaaattcggaattaaaaataatgaatattagaagtagagtatagagtacatataggaatataaaactaactaaaattcataataaacataataaaattaaaagtagagtttagagtccgtataaaaatgcaatttacaaataaataaaattcaaaataaaaaaacatgggaagaagagtttaaaatcaatataggaatagtaactagaatttgaaatcaaaaattaaagaatattgaaagataagtttagagttaacttagaaatacaattaaaaataataaaaatttagaattaaaaataagtaatattggaagaagagcctagagtctatatagaaatacaattcacagataacaaaaattcggaattaaaaaaaagaaatattgaaagaaaagtctagagtccatataggaatataatttagaaataaataaaattttatattaaaaataattaataactaacacgtatataaaatacaatataaacattacacattaatagtttcgtaaagttagtacaaaattttaaattatgttataattttaatatattttaataataaattcagaaaacatatatgctattatatgagataaaatataattatattagctgcgcaatctacgcggccactatgctagttaatagtgtagtatatgtttataggtaactatcatataaattggccattaatttgtctatagataatttgaagctagtagcgagctatactattaaacttgcacttaggttgtgtttagatccaaggttgaaaatttttactgtgtcacatcggatatacggacatacattgtctaataacaaaataaattacagaattcatcaataaaccgcgagacgaatttattaagcctaattaatctatcattagcaaatatttactgcaacaccacattgtcaaattatagagcaattaggcttaaaagattcgtctcgcaaattagtcacaatttgtgtaattagttatttttagccaatatttaatatttaatgcagatgttctgtgacagggtggaaaattttagggtggatctaaaacagggttttattctcgacggtacaataccaaatccgtctattatattcgcgcgaatatgctcggccagtccacctgtcacgcgaggcatgagaagggcgaccgagccgggtggagctgagcgagtggtggtgctgctgcagccgccgccgccgccgcctgcaggcgtgctgaaaacaagtccatgccatggtggacgagaacactgtggacgtggtcagccatggatggtggcgatttggacagcctcgcgaccacgacatatactagtagtactcacatatatacgacgactagccaaaggtgattgctttaatcaaacaccggcgatgttcgcgttcctctggaagttggtgcagtttctctcctcctcctcctcttcttttttaatttttcgtccctaaagaacagaagaagtctcatgtctaaagtgatactcttcgagtcttgacggccagaattgtcagactgtgtgatccagaagcaagctaaagaaagggagtatacggtccagaaacacgttaataaagggaaaggaaaagggttgtctattcttgcttcagtctgactgtgcttgccgtgtccgtcgcattgccgtcgtggtcaaacaaacgccccaatggaagctgtaaacctcattcagtcaacaaataatgtgagatcagaactggctcacctgattcgggagatatgagttgatctcaggaaacagggaaataactattaagaaagtgttgcaatgccagaatactgttagtcacttcctagctaataggggtcggactgtgtctcgatctgagttttggccagacaacactttaacctcataacacaccttgtgtgtgaggattctttgattgattaatgaaatttccctttttccccggaaaaaaaaaacaaacgccccaatggaaacatctcccgttgctaacgcgtgaatagacatgtgttcccaactctcaagttttccaggtaggacctgctctctatggttcggggccatatatcgcctttgatcgataaccacgaaatctgtgaatttcaggcagattaattatttatccaaaataaataaaataaaatttagtatgattttttatgaatttagtgaaattattaaatggctttcgatgtgtaagcactatgacagtgtttctctccacttgtctgccactccgtctaaaaaaacataaccttagtgagttttttttttttcgaatggagtactttcattacttggtcatcgagcgggcaaaaatgcaaactactccaaattccaaaatgggagtggcagccgatacaaagacaagcggtggacttgtgggcctgtggcttgtgggtgatcagcccggatggcttgcttttctgttagtgggctgggaggtgaaggcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23917 - DNA, 643 bp, Oryza sativa
  unsure (1)..(643): unsure at all n locations
tccttgtactagatgcaaaatctgaaacgttaaattaccacatctcatgccaacagaataagtggtttgatagtgtcgatctagcttaagcgacacagaacctgtcatgctcatattcacattccactaacaagctggaaatcccatgaaaaatacaaagctggaaacccctaaataaataagctggaaagataatctgaataaacattactgtagcacatcgacacaaatgtatttgctgtgcccttgccaaacacacttaagaaactgatgaagtcaagctcatgtttcatttctgggggtgccagcctcttccgttgtggttgaatttggcccttcgatcgctgctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23918 - DNA, 1054 bp, Oryza sativa
tttttacatggatatcatacggtggatggtcaaagaatctaagccttttttccctgacaaaaattgtgactgatagataggaactgatccacctaaggttgcacctctccatccatgcactgcaactgatatgactggttggcattatctgtcttttgtttctgcttcacctgattcattgatgaggtttatgctccatatctaaaagctaatctcgagccaatggtatgtaaacatcaggggataaaattacactgttcgtaatcaggacaccagggcgggacaagaagggttacttcactgaagaatttgtcccgtatatggcacaatatcggaacgataactaattactctgtttgccttcgttttcagttttcaaatcgactgataaccttcctgcagaatcagggcattttagggcacatgacaagagatggcagattagagaggttgcaccgccggtctgccgaaaccgcaaaagcgagagcaaatcaactaatctctttttagcgcagctaatcagccaatgaagcacgcactagtatgctaatcgatcgattagtagcccactttgtcaagtgcaagtactgtttttcctgtaaaaagtactgttcgcaaagacttgacatgttttgtttggacattggagcaactgtatgggtctgaactctgaagaggattaattgttcagcacaattggtattttaagcttgaacatattttaaatctgcagttattctaataagtaaattacagctacggtgcacgaacttaggtgcaatagaaacaggtgtaacaacctatataaattgttcgcttcagacaacaatttgcttgcgtagtcacatgcaaaccaaagtcaaaatgatctatatacgcaatcaaaacatgcagccaaaatttactaccggatattctgatgttgtggttttagctttagacatgacaaaagttgatgcctagaaaagacactgtcaaaatatttatctccagttaaataggactataggttagaaatgcccctagctagccccaatgatcagactctcttcct

SEQ ID NO: 23919 - DNA, 772 bp, Oryza sativa
gccacttgtctctgttgtgtcggtgaactaatctccatcgccgtcgatcttaggccagccattttcagcctgcgacttgacaaacgcggccagtagcttgatatcatcttcgaccagccgaggtccgaaagtgcactgccctctcggggtgcatttttctccgaagcccttaacgcagcaaacatacaatcaagaaattaatgagtatctatctatactactcaaacatcatcatgatagcagctaagaattactcaccggcattcttcccttcccgtagtacgttatattgtatagctcgtcctccgtggcaactccatttctgcagcaaatttgcccttaattttgccttgatccaatccaacaatgggcagtaaatttcgagcagttaaaagttttcaagagcacacatacctctcaagatccttcatgtacagagtggcgccctgtacatgacaaatcagcaagctaataaaaaggttgaaaatttgtgtccggccatcgagtaatggtttcagaagcttaccggctgtaggatatttcctcccatatcatggcagccgatgcacgccttccggaacagcgctgcgccttcggattgagcaaaagctacaacaacaaaagggggggaaagaatgtgatgtgcgacgcgtacatttcagcaaatatggtaaattggcaattaatcatgctcggtgtacttgtgtagaatcattcagagttacttctgttatgttcctctactgcttcccccactaaaaacttcaagagg

SEQ ID NO: 23920 - DNA, 776 bp, Oryza sativa
cgccaaatgtttggccacccgtggggcatggatcaatataatctaaatacaaacaaacaaacaaaccttccaacaatcacctaatgcttcatacggggcaccaaaatgaaaaatagagcagtggaaatctcgagaaatgagaacggaagaaaatagtcgtcaacaaagaaccaggaaagctacacaaggttttcatctggggaattcacaacttgcctattccgtcatctatctattgggtagttgttaactgcaatgatccatctttctgaagttttaggctgaggctagtgaaccgttctcttgaatattgtcttgaggctttcctccaatctgttccggccttcatcattgccgcaaactcatcatagcttatcttgccatcctgaaagtacagaacaatgctattaatactttcagagtcatgtgtgctatgaatcattatgtcaaaacattttgtgcacaccaccaaattaattaaactatttgaagaagaaaaaactagcagtctatcaatttcttaaaactagtcaatgaagagccacaaaccttatcagtgtctacatcacggatgatggcattgataacctcttcatgatttgctcccaggtcatcagccaatgattcacggagctcatcgatttcaatatatccactctggttccgatcaaagtatgcaaatgccttgtgcagatgctcatcgttgccaatctttctcaggtgaacagatagagcaacaaactccccgtagtctaaagatccatttccatcgacat

SEQ ID NO: 23921 - DNA, 1115 bp, Oryza sativa
gatggcaacgaggcacccatgatggcttggtgttgttggtaggttgcaccctgcacgccgagaggattgataaatgcaggcatagtgtttgcgccattggcggcgtcgccggtgtcaatggccacggcgccatgtccgacaacgagatcaccggcatgctcatcgccctggtcgtcgccggccagcacatgagctccagcgcgagcacctggaccggggcgttcctcctccgcgaccccaagcacctggccgccgccgtcgacgagcagcggcggctcatcggtgacgaccgcgtcgactacgacgcgctgacgacggggatgagcacgctccaccgctgcatcaaggaggcgctccggatgcacccgccggcgccggcgctcgtccgcaccgtgcgcaggggcttcgccgtgtggaccagggaagggaaggagtacaggatgccggcagggcacagcgtcgtgtcgtatgccgcgttcaaccaccgcctcggctacgtgtaccgcgaccccgacgagtacgacccggagcggttcggcccggagaggaaggaggacagggtcgccggcaagttctccttcacggcgttcgggggcgggaggcacgcgtgcctcggcgagcactacgcgttcctgaagatgaaggtaatatggagctatttgctgaggaattttgagcttgagctggtctcgcctttccccgaggttgaactcaacaacataatgctagggccgcgaggggaagtgatggttagatacaagagacggaagctgacaagcacctagtgcattaagttgtaattacagtcaaaattatttgagagcagacgtactctttactactacctccgtctcaaataagtgcagccatggtattcgtatttaatatttgatcgttcgttttatctaaataaataaataaataaatataaaaaaatagtcacgcataaaatacaattcatgttttatcatctaagagtaacaacaataaaaaaatacttttaatccaaaatcataaatattttaaaaataagacgaatagtcaaacgttgaatatgaacaacataaaactacatttattttgaacaacataaaactatatttattttggaacgg

SEQ ID NO: 23922 - DNA, 1305 bp, Oryza sativa
aactcatacctcaagcatcagtgagaaagcaaatattgtcattaacaaaaccaaatcccagtccgatggacaactaaagctcgtgacatagtgcagaatgtatctgattacgtagagcacttaaggcataatgacgtgcgttgtcattgaattatgccagattccgtccttgaaagacatggtttttgtctttacaaactgaagccgcaattgaaatgcaggataaaaggcaagtacatttattacattttggcataatacataatgaaaagttttatatatatatgacggtacggcgatataatagaactgcaattttaagattcagaaagcaacatagttagggcctgattcaaatgcaccgtggttctttacaactcataagaacgtgcaagtgcaatattaggctactggtattaattattgaaaaaacaatggagaattccatgacctacaattgctagtgctcaattatctcgaatctagtaatatagaactcatgaacaaatgcacgccgtccatatctatactattcaaaaaatgaaaacttttattgagaatcttcaggtgttcgctcgggaacattggatggtacatttgatcaaaagatattaaaatacgctactagatccaaaacactaactaccttaatcattacattcctatcagcataacgaattacggcgcggaaagcaccaggagtgttcaagcactgaacccccaacccgttacaacaaaacgttcaaacctcccttgccacagagccccgatcttcgactacgcggggcaattacaacctcgacgcatctcaaactattcccaaaacagttcatcaccacccactgcgcacatccacgccgccgctcgcgaaccacgaccgcatcgacatcgcatcccccacgcaatgcaatggaaaataatttacatccgcaacgaaggctctctgatccagatcggagggggaggctcacctcgcagtgcagcggggttagcacggccggggaccgaccgggatctggcgccgccgcgccgacgacgacaaccgctaccccgaccgtacgagggacacctgggatgggaagacgatgcgccgacctggaccctggagctcgataacgacgagcggaaaaaggaaacccaaaaaaaaaaaaaaagcggcgcggcttcgaaccagaccacgacacggccgcgcgtcgagcaggcaggcggcggcggcgcgacagcagagagagagagacggcggggtagtataccgcggatacgcggtggtggtgaccgggacgagttgatgacggcggcggcgtc

SEQ ID NO: 23923 - DNA, 332 bp, Oryza sativa
cagaatatcatcattttttgctgaatctacaatctttcttctcagccttctaaattcagctcaagcacttcttcaacataggggtgcaatagtaccattagtaaatttgagaatttcaggccatatgattctagataagagcagtgagtgagactagtttggatgcatatgcaggcagaacgaagggcagatacgctctcaggcaaaggagaattttccttaaccaaacgcgcaaaggtttctatttcatattcagcccactgaataatccggttcaaattcatggggcttccccaaatagcgaactagattctttggatacctttgagata

SEQ ID NO: 23924 - DNA, 667 bp, Oryza sativa
ttcctgcagccctgtatttacccaaaaaataactaactagaaaaaaaatgaatgaatccatcccaagttaaatgttatttgttaaattgcccccggtttttcttagtctcgtcctctgaattgtacatggtgaagccgcgatgaaccattcaaattacagcctggacatgatcatatgtcttccttgcgtgacctcatgcttggttttgttttctatgttctccaaaactgcggtagccgccgatgttacgagctctgcaagatctctgtagaggcagatcaccattacaaatgcgtcagttgcgatcaaacgagaagctaaccgagcttagctactaagtatgagaatataatggcgccaaatggctgcagcattttaaacctacctgtgtcgtaggtgaggccgactgtgttcttgacctcgcgtagcgcgaatttgaagcgttcaatgtcgcggggatggtgagcgacggactcgacgacggcctgcgggaggacgagatccgagggtttgatgttgtaaaacaccgggatgatctttttccgtgactcgacgaggagggcgagctcgcggaggcaatactcggagtcgcagtagtgcggcgagaagatggccaccgcgacgccgcactggctgatggcctcgctgatccgctcgtcgaggcga

SEQ ID NO: 23925 - DNA, 753 bp, Oryza sativa
ttcgtcctaaaataaaagtatctttgaataatgctaagtcaactattttcaaatttaactattaatagcaaaaaaattaaaaagatcaatcatgtaaaattgatgttactagatttattatttcacaaactatcataatatgtaactctttttatctactgttactatccttggctttattatatccacaactaattacctaccccgagaaggtaaccatgttttttactcgaccctctccttaatacctgtgtcaaagactaaaacttgctgcgttttaagataaacggagtaggatttttttttttttgcatacctccacttcgtaaaccatgtgacttacataactcctcagcttggtcggcttcattgtatcaccaaagaaccggaactgctcttactgcgtggcataacccgcatccagggctggtcctggggttttggggcccagggcaaaaacttatatggaggtccttattgacatgagtgtggctactggcgagctacgatttgctgtgtccacttgccgtttccatttacgcgaccgagaagttgccgcgagcgcaatagcagcgagtagcgtgatgtgatcaaggcggcgcgacgcgactggcgtgatgtgatcaggcgaagcgacgggagtcagatgaatatcgcttcggcttcgctgaaacatgcctggcgatagactaaaattcattttctgaattgggttattcagctgtctaacttaatataagcctatggtctatg

SEQ ID NO: 23926 - DNA, 583 bp, Oryza sativa
cgctgtcgccgcgctgaccccttccaccaccaccacccgcctcgccttccgccggcagcggcagcggcagcgccagcacgcggcggcggctagcggccggcccgctcctccaagacatggccgcccgcttcggccccctcctcctcgtactccccctctcctccgcgctgctcgtcctctccgccgccacggcgccccgtggccgtcccagccaaggtatgggagggttgtggattgttcacgatcgtgtccgtgctagagatttgttgttgttgttgctgctgcttcgctgaccaccttgttgcagtggatgtggggaggcagctgagggaggagttgtgggagagaaaccaagggcacgagatgctcaggtcgtggcgcgacggtgacccgtgctcgccgtttccatgggaagggttctcttgccgatggaaggacggcaacctcttcgttgtcaagctgtgagttccctgaatccctcgttctcactctcacgatcacggccatccattggtgctattcattcggctttgatgagaatttatttggtcgttcctttgcatttgttatatatgcaagtatg

SEQ ID NO: 23927 - DNA, 2428 bp, Oryza sativa
agatcatatgactatgagactgttaagaagtaattttcaaaaagagagagagagagagagagactgttaagatgtgttgatacttgatgggcttttgaagtcggtccatacaaacaaggaataagtctattttgccaccctcaacacatgctcttggttaaatctcatccctcaaccgcaaaaccgggtataacccgtcctctaacttctaaaaccgctacaaatcagactcttaggatggttttggaggcggtttcgtcctacgtggtagttgacttgctgaatcatcaagcgggacccacttgtcagcggtctccacctcatctctcctcctctttctctttcatctttctcttctctcaccttctatcgacacagaggcatcgcgcagcaacaacgcattggggaggagtcgtcggctggccgcgttgcgccgcacgcgggggagcagcctggctcgagcacgcaaaggaggcgggagggcgtcggggcatcgtctgagaggggggaagaggggggtcgtggaggatgaggcagccaactacgcatggggaggtggtcatcagccggccgtgcgcaaggaagagctcgtccaccggccgcccgcagggaggatctcgtcggcctaccaagcgcggggaggggcacttcagcatggtggccacacagggaaattcgtcgatcttccacgtcggcccggctcgagcgcgcagaggaggtgggtgggcgccggggcattgtccaagagggggaaggagatggtcgtggaggacgaggcagaggccgcacaggcaaacccctccacgtcgacagcagcgacggtcggcgaggaggggaggcgtgaccctcgtgctccatcccgccgccgcctccgtcaacgccggtcggcgttatgcacctgagaggagagaaaagttatagagagaggagaaagggtaactaacgtgtgggccctgaacgtgcagagatgtagcatagagggggggtgaataggctttcctgaaattttctcaacaacgcaagcggttaaattgacagggccggaaacctcctggtgatgaacaccggaacttcctggcagtgatgagtagcctgaaacttccggagttcttgagccaggaactttcgggcaacagacaaaaacgaaatatgagaagtataacaggtcctaactagtgaaaatcaggcacagggttgcacaagatgaaaatcacaagataccagcagattcaaacactgatcaagcacaagagagacataggcgatttttttttccaaagttcagatcacacggatcctactctccgttgaggtgctccaaagagccaggtctcgattaaccccttgcctcacttatgcaaagatcctagaagaggtccacagccttcaactcaacacttctaggtcgtttctagaattgagtgaccaccaagatccaactcataattccttctagaaaaggccacaagtgcaagttgctctacctaggacaacctctgaaaactcagcacaagaaacttcactcacttacctcgtttccttgcggaggtgaggaaaaccttcacaaactttctcgggacatccacaagatctttggaagctcatgggcgacgcctaaccgtctaggagaagatctccaagagtaataagcccaagtgacagcccacaaggtatccaaagtgctcaatcaaacctaatcttcaagccatctccaaaacactcctacactctcgtctaatctctcaatctcacaagataggctctagatttgagtggaggaagcaaaggaagcttgggagtggctagaaaaccctagaacatgaatgaacagaagtggaatggccaaaaggtgacctggggacgaaattcatatatataacggctaggtgatatcatctagccgttactcacaagtttgaactagaaacctgccaggaggttccggacaaaagtgccaggaacttccgggcagcacttaggaaattttttgcaaataaacggtgcccaaaagttccggccagaacctccgggtagccctctctgtcccggggagaaaatcatttttcaaaaatgattccaaaaaatcttttgactcataaatatgactaagagcacttggtataccctagaaccacacttgaaaccccttttaatagtacggtttttcttaaactcaatttcgaaagtgaaaaacctagtctaaccaccttcgatgatttttgcacttaggaacatttgaattggggggggggtctccttgcattcttagccatcccaactcgctttgggactaaactcctgtgaataaacttgataaacacgttagtcccctttaaccaccttgtcattaatcaccaaaacccactagggggtttaagtgcatgttcaatctccccctttttggtgattgatgacaacatggttaaag

SEQ ID NO: 23928 - DNA, 1071 bp, Oryza sativa
cctaagtgttcaaatcgttgggatatatagttaacccttccgttaagatgtcccgaacaaacaaatgctcgttcggtaatgaatatgccgagttagagagtacgataactacaaatggcacacaggtggaatcaactggttaaacatctcaatttccaaatgcctctagttcttgagttgagtgtttccagtaagcaaatctgctgtcaaaaagtgacaatgggtagtcaggtcaacacaattgtacatgcctgtagcaccaacactgcagccctgttgaaaagaatatatatctacaatgccaccattttatccccccaactaatttttggccaaaattcaacaatatactactagccatattgtcgcccattaaactcatgaatttcttctatatatgtattctaacccaaaatgaagctcttcgtcagaacttcaacccgctacaaactataaaacatcaaggcaatgaaaaccgtaccggttaaggattctctcaacaagaaagttgggttcaggaaccagcgaaaaagtaatgctgttccagaggtggaaagtagaagagtcatttacaatcctagaaaacaaagcatcatgttgggttctttcatccgtgctatctgtttttgagaagtacctgcagtacatggatatcataatgagagtgcatattgcaaatttgtagccacacatctaaagagtcaacaattacttgaacaacaaaaatatgtgaaaggttgacttttaagttacttgaacaacaaatatatgtaataggttgagttttaagagggctggggtgcatctggtttatctctagtactgtaaaagcggtgtagttgtcctccccaacaatcgcacctcccccacataaaaaaaaccaccccacccaaaaaactagtgttcccatgcgaaaattgacccatcagaaaaaccggatacaaaaaaccgaacccggtaaaaccattcagccatcttcctgagttccttcagatcaatggcatgacactaataggttgaacttggctagtgaatagagttcagtttttcttttaaaaatgctcatgcgct

SEQ ID NO: 23929 - DNA, 500 bp, Oryza sativa
accacgaactgctacgtaccgcgcgtttatctcgtgctagatacagagcattgacccttctgccggtctgcccccccggccccgtgcacgcgtgcgccgccccggtcagcgtccatctctgagactctgacgacgacgacgccgccggcgacggcaccggcgccaccgatccatccatccatccgtgcatcctactgtatacttacctgtctctcgctgccctgcactgcatacgtccgcgcctagctcgatccccgcaggatttctctgtaggtgacagacgccggtttgtctggacaccccctcgcggcgcgccggtgcgtgcgtcggtgcgtgcgtgcgggccgtctgcttgacgttttgaccattattcctctctgtcgatcgtgtggtcagtgcgcatgatctaagattaactgaggaaggactcatcttgtgcgttgacagcgttgtccgaagcccccggacagaacgggtctaagtttgcactgttattttgg

SEQ ID NO: 23930 - DNA, 548 bp, Oryza sativa
tgaggctcaagatgtcttcaagcgcttcgccaagcaagcccaaaacctctatgatctcaccatcaagagggtacgaagtgacaatggaggagaattcagaacacacaagtggaggaattccttgatgaagtggggaatcaagcacgagttctccgccccttatgatcctcctaaaaatggcattgttgagaggaagaaccgaactcttattgaagccgcaagagcaatgcttgataagtacaagacttcggatatcttttgggcggaggccgtgagcaccgcatgccatgccatcaattgcctgtacctccacaaaattctaaagaaaacttcatatgagctcttgagtggtaagaaccaaatgtttcctattttcgtgtctttgggtagatgctttattttgagtaagaggcctcgttcatctaagttctcacctaagggggacgagggattcttacttggctatgagtcaaatgcacatgcctaccgtgtcttcaataaaaccttcggtattgttgaagttataagggatgtgacatttgacgaat

SEQ ID NO: 23931 - DNA, 71 bp, Oryza sativa
gaaagttggggcaaggcacagcagtgtatgggtgcttgcggggatcacggcggcgggcgttctcgccgggg

SEQ ID NO: 23932 - DNA, 1319 bp, Oryza sativa
tcctcattttcttttccgtgcataagtatccaggaactaaaaaatgaagtccccatggtttggcttatttcctaataatccaaaacggtttattaggaaataaaaatgaatttgtaggtgaaatttttataaatgtgttcttggtgacttaaaagacaatgttaaaaaagaaactacgttgaaaatatctcaaaattaagcttgaaaatccaaaatttagctttttctttggctgattaggctatccaataggagcctgaacatggtaaatcttcattcaactcttacatggcacataagtacaaaccttcaactggacagtacagccttgaacatactctacttgcaacatatgatttgcttatacttgtactctcaatagccttagaagcacatgtcgaggaggcaacagcagcaaagggcagcacagctgcaaaacaacagaacggttaagtatttcagttcttcagtctactttcgcatatcactactattataaaaattgaagatgtttttgccggtactttgtacgtcgtccgtatatgagtcggtttttaatttcatttgcttttagaaatacatatatgtatttgagtctgtttttaagttcgttcgtttttaaaaatacagaaagctcctaattgtagcttatgattttgtaaaataaatatccaaacgaatttccagagtgaatttcaccttagctaaactgtacaacagtgataagattaaaatagcttttacccgttgcaacgcatggatattttttttctagttatgaaaaagagtaattgtctcattacgaaaaataggggtaaaaaagtctacttcataccccaattctagcaacctctttttaatcataaataaaccctataacttaggtgttgagttaggttttctataaacgtaggaagatactatgggcttgttcattttataatcgcttttaaccttattaaattttagtaagataacaaactaaatatgatgtcaccaatattatcatactactaaaatttagtagttctagaactttcctatcataaaaacgctagtactaaattttgaaaagacatcaaacgctactaaaattcgataacaccaaagcttgtcaaaagttgatattgccacagtttaataaggttaattttggtaacaaagtgcacagcttatgttgtccctgctattaggttatgatcgattggagtaaacagaaaatggtaggcggtaggctcagccactgcctcacacaagacattattatcagtgacaccgagcttaattaccatccttccaggaaggccttgtcaccgcgg

SEQ ID NO: 23933 - DNA, 1160 bp, Oryza sativa
tttgaagctgatccaaagaagctagatagccaagcgacgacgaagggcccgcccgaccaatgcctagctagggtggctgcgaattgaacctgtgattgccaattgggcgagagacaaaactgggccgagtcacacaagcagctaggatggagcatgcatggaggaaagaagacgcggtcgtccaagatgtagcgatagtagacactagacacttagagcaagtttatagtatagacactggctctaaatcatctatagttaatgttatagccaatttatacaatagttgctgactataatattaatacctggtctcacctgtcatacacatatttctcttggagtccgcgctgcagctggctacaaatctgtagcccactgctcttctctcttcttttatctctttaaaatatgtttatagctggcttatagtctgctcttacagtgtgttctttccttcaagttcccaacccttctccctcgttttccgcgcgcacgcttttcaaactgctaaacgatgtgttttttgcaaaaagtttttatacaaaagttgcttaaaaaatcaaattaatccatttttgaaaaaaaaaagctaatacttaattaatcatgcaataatgcgtgctccgttttgcgtgccagggaggaggggttctcccgaacgcagctggcagggttgtaactgcaaaatctgcaacttagtactccctcattccctaaatatttgtcgccgttgacgtttttaaatatatatttgaccgttcgtcttattcgaaaacttttatggaatatgtaaaactatatatatgcataaaagtatatttaataataaatcaaatgataggaaaggaattaataattacttagattttttaataagacgaacgatcaaacgtatttaaagaaattcgacggcatcaaatatttttggatggagggagtaagcactaaacagggtccttttcgcaagagttccgaatcgcatgggccgtattatgggcaggagagttagctgggctgctgggctttaattgggcatagtgagtcggacgtaatcacgtaataggctggaccgatggaacctcaagtgaaagcatttcatgctggctcgtggttagtaaaaggaataagttcatctaaggtcccttaacttatgaacg

SEQ ID NO: 23934 - DNA, 590 bp, Oryza sativa
agctgtctgtagcagaatttcgaacactgaaatggctaggaattacctaggttctacttctatgagcatcatttgtattttgtaagatttaaaaattgttaaattaagtcaaactggattatataccaggcccctctacttgatcagatttcactccatgtgtcaataaaacaagactccagaaacatttttgctagtttcattactaatgagtccaatattagtagtatgtgatacatcaaacactaaatagtaatcctggattctatatgataccaatcaaatcatttcaggttttgggtcaaaagcataaactcatttctttgttaattagtgttagatagtaaaattagcacctatgattaatcaaatgctacccttaacaagagtcacagaatgagaactacaggaacatacccttccttcacaaattcctggaagaactccagctccagtgtctccgacagcatgacgacacaagcttcagggtgttgccgcagtaggctctccagcccacgctggtgccgtacgccatacgcccactgtgggctgttccacaccatgaacaccttcacggagcacttcccatg

SEQ ID NO: 23935 - DNA, 535 bp, Oryza sativa
tttggtttcatgatctctcaagaagtggtggcgaatatctatgtgcttggttcttgagtgttgaacgggattgttggtattttgatggtactctcattatcacataggagtgggatcttggtgaagttgtagccaaaatcttttagggtttgtttcatccaaaggagttgggcacaacaagaaccggcggcgacatattcggcttcggcggtggatagggcaatggaattttgcttcttggaggaccaagaaacaagggaccgcccaaggaattgacaagtcccggttgtgctttttctatcaaccttacactcggcataatccgaatcggaatagcccaaaagctcaaagtcacaacccttaggataccacaagccaatattaggagtatgaactaaatatcttacaattctcttgacggcaatcaaatggcactctttaggctccgcttgaaagtgagcacacatgcaaacactaagcatgatatcgggacccacattgagcgatataccttttggagcgatataccttttgg

SEQ ID NO: 23936 - DNA, 370 bp, Oryza sativa
cctgcagccgcgtataaatgatacatcacaacaaatttaaatgaggaaagccacttcgtctaatccatacctcgcaaagctcccatggaaaaactcttcctttcggcatgaagtcgcgcacgttttacactccatgatcccgccggagtacccaggcacgatgttctcgcgaaagagacattatgcttagccgcaggaaaggcaagcgctgaccgtgtccagcagataagccttgacagagaaccattctgcttaaatacagcccttgccgaatcaccgaattacctggacagacatgtgagcgaatcggatcactggatcgcaaagagcgaaacatttgggttagatttgcgcccagagattaaaaaac

SEQ ID NO: 23937 - DNA, 2092 bp, Oryza sativa
cgataatgtatgtctcgttttacctttgcgaggagaagaccatcaggcagccggttggtgaagacaaggtcgccaccagcaatgggggcagagtacaccagccatgtacgcaaagaagccagccagcggcgacgacagcagccgacatacatgcataaccattaccgatcaaaccattattagtaatctgtgaaataatctaatttgcgaaagaatttaaaacgataaacctggcttgtaatccaagatttttaatgcatgtatgtcatcagcggtgtatggcttgcttgatgaatcagagactccagcaaaaaggtcgctgcgtgcatgtatctgtctaggtagatcatgcacctgcatgtatggcttggacagaagtggcttgatcgatgcccttgtgcgacaattgctccaatcagctgggttggagtccatatcgattccgaaattgaatctcgccaacaaattttgatgtcgacgaggaaagacgccgatgcttcagagctttgcatgcatgttttctgctgatgcttgatctgttgcttgacagcacatggcgacagatttgatctcattgcataaaatagaattgacaggaacaactacttatggaggctcataatagctgttggcttcaaatcttttgctgatcaagaacaaaactcggtgactgacgtccggtcttgccgatcaaagaaaagactcggcggcgacggtgattggatcaatcgccgagattattttcccggctagatggaatctgagtggaagaagaaaagtttaggaaattggtcgcgggcgaggaagttgcagctcccgaagtgaagacaaagccggcgactcgtaaagttgattccatcgcgctttttgatagataactcgacgcaacccctacttggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatcggacgatcaggttgtctcatgccccctaaagggcctcctgcccaccttatatagggtggagggcaggattacaagatagaaaccttaacaacacgggatcggtttcctaaatctactttacaatcttatcaaaccaggactttaggccgttccataatatacagggaaacgtaatacccaagtcatgatctgttacatattccatagatataagctatcccctaagactagtcggataaccatgtcgtgtgggtatggggtacccataatctccacagtagcccctgagaccttcacagccgaaaagataaccttctctcgaactagattactccaaagccgagtgcttcaattatcttcgccatggtctcccgagtacttttaccaaatctgaagactgtggagggctgaaaaatatagtcaggtgcatcgaatagatgcacctaataggtgttgcccccgactatgtggttaattgaaccaaccaaacatatagtcaaggaataaataatctaaccaaccgagtggttttgataattgtaatcaaccaagtgacttgatatcaatgtatagcatatgcggtgtgaatccccgaataatatgatccaagtgatataccgactgcttggcaaaatatgatgcgtacaacctaaagttgacaacatctttgaaagttcacatagcaaaacaactataaagaagcttgaatgctgtgaataaagaaattttcaaagtattgggcatacgccatgcgcacactgctttaacagatgtgcttaagtccataaaagacacattgtttcaccacacctggaaatatatggcacatgtggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcag

SEQ ID NO: 23938 - DNA, 73039 bp, Oryza sativa
  unsure (1)..(73039): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttatctagttttatcaaatagagaacttgaagaaacttgaaatgtatgaattgaggaaattcttcacacattgtacagccctctagatggagctccgtcaagttctcaagaacactaagatctgtcatccatgttggaaaattagtgcctttataggaaactaccttaagcatatggagaccatgatgaggtttaagagcatcaagaaccttctcagggtaatctggttcttcagcatggtattcgccactccattcaagagataagtgtgtaagtttctctttccttccaagattggctgcttttgcttgttcttgagatacattttctaggccacgtaactctagttcgccagaaaggtttaagctatgcacttccctaagggtactgcaactagcgctagcacccacaataaaatatgttaatgtctgtaaggaagttaactgtccaaggtctggaggcatgcacttcaattttgagcatccatttgtataaaggtgtcgtaggcttgtcatatacttcatatcttttgggagtctaacaagattatagcaatcagaaaggtttaatgtctgtagattgtacattgtgcttatgtctgcaggaagttcatggatattactgttgtctgagagatttagatatcttagatgttgtaggtgtcttggcctgattggtaattcttcccttcttgggagctctaatgctcttagctgtagagaattgtacttaaataaatgtgatgttgagacattaccataataccctcgaaacaataaagttcggagagctggagcttcatttcccataaagtcatctggaagagcaatgctggtgtatggtatgagaacgtgatataaaggatgttctcgcatcagatttttcaaattagacgaaccaattatactgagacattctttccccataacagattgagaaatgtcatgcataagatcatgtatcttgcacgttgttctgtcacggagctgactcctatacacattctcctcccgctgagaaattttattcacatcttgaaaaaatgacctccaaactagttccttgaaaatattctgggctactgtttccagatggtcttcctcctgcagtggtatgaagtcatgtgccaaccataattggatcaatgtctccacatcaatctcataatcttttgggaatatagcacagaaagcaaagcactgcttcatgtgtgatggcagatcatcatagctcagccgaagtataggaaaaattttatcctccccttcattgcaaatgttgcttttagttaatacatcattccattcttgcatagtagtcctggtacttaacatagaaccaaaggcttttgcacctaaaggcgagccatgacatctgtgcacaatcttacaaagaattccaaaatgttcatcattgtttggcagagttaatgctctcctcaggattatttccttcatgtaaatttctcctagattttcaagattatgcacttcaacttcacccgtgaccataattctagcaacttctgcatctcgagttgttgttagtactgcactacccataccacccttcttaaggcaggtctttagctttccccacttatcataatcccgttcccatacgtcatccaacacaatgagatacttctttccacctacttctttctgcaggtcctgcaaagccttttcacgatctctctctgtgctcatacatatgttgtttgcaatagtgacaacatcaaacacatccgacacacaacaccacctgcggagcgggaaatgcttctcaatttcagggtcattgtaaatgagttgcgcaaaggtagtcttgcccagcccacccattccaacaataggaaggacagtgaggtccgtgttattagctttatcaagcaatatcctgataatcttcttcttctcctcatctctagatctgataacaatatccttgtcaaaatcaaccatgatggaatcagttttcctccactgcttgggtgtttcctgctggtgtacgagtccgaaggagttcatctccgagacaagttccttgattttctccacgatctttcgcagtttcttgcccatcctatatcggaagacaataggattacgagaagggaagaggcttacagagtccatgccaagcatagtgtggttgcggtgccctttcttcttggcctcacgccagagcgactcgtacttgaactcgtcgaagacgtcaattgcctcgtaggacaccttcttgagtgatttgagccaagcgcaaactagaccggatcgatgatttttcttctcctccgcatcttggatgacatcgaggatggctggaagcaagcgctccagagtctcacgctggtcctccatgccatccatcaccttgtacatgtctacaagaaagctggaagccttctccagcaccttggagagcagtggcccaaccaaatattcagccatcgttgctctctcaactctcaggagcaggagcacacggcaagaacccaaggcaagggcaacggcggctgttgctgatatgtagttctattggagagtgattaatggggtattaattccaggctgaacaaaggcaaagacaattgcaaagaattgcagtgcgctgcgcactgcatttcagtgttgactgacgcgtcttgctttccactaatttccaagagtcagttttgcttttatctctcattttcacgcacgccgatgttgactgacgcgcgccttagcagagtggtgagtggtgactgaccttgtggagacgcgaggggacctggtactctggcagccggccggtgagggcagcaagatttcgctcactcttgcttgcttttgccgaagaggtgttgacaaccgttgcttgcttttgccggccgagacggcgtacgtgttgtcctcgcagccattccgtcgaacaccagccgggcactgactgccatagcaagcccctacctctcctgccaccctgcactggacgctgtaggagcggagcggccggcgtccttgcaagcgaacggcggtgggcaggacagaagaagaaggcggccggaactcttcaaaggctcgccggcggcgtggcgcatggcaggcagacggagagcaaatgagcaattgcgcgccattcggttccctcctgtatattcgtcagaaatgacgatcgatttttgttcgcgattggattcgaaggcccaattggattttgagcgcttcatgggccgtcgcaaaacatgcaagcctggcccaacttggtacagtaatagttaatcatagtttacaacttcaatcgctctgcttttgcttaatttcgtcagaccttgtagataaaataaattattcaatgagatgagcatgtaattttcctatcttgaaaaaaagcatttgcagttcaactaatgaaatccctgaaatgtactgtatcaattcattcggcgatcattttattctcttctctcttttttttcttctatatttgaggtatcatcaagcaagcagatctgctgttttgatacagattaaatcctacagctgatgagctgacagcaatccaaaaaatatttttgtgggtaaaagtttttatatatgtgtccttagagatttaaataagctattatgaaaagaaacctccaaaaattcaattttggcagctgcctaggaacagatcaatgtgcgcaccgaaacacttgcaaaaagcgaccagcggcatgtccatgagcaaacatgttgataatcgagcgaaattcgacagagggacaaacaaatttctgttggacaaaaactcactacgcttcttctgacgacggcaaaattaactaagtgaccgctttgcaaatccctaaggaaaggaactgatccagagaataatcgccctggaacaagccttgtgaattggcaaaacagtatgcaggccaaaagttttaggaggattggaaattttcaagagctttaagattaagatggccttggataaaatggaaagatgaccaaagaccgtggacctcgatggatctacattgcaacaaaacagatatacaccttttccaagcttgcacgaaaatcacaattggcaatggcgagaagacaacattttggaaagacaattggctaaatggcctttgtctaaaacaacaattgccaaaccttttcacgttggcatggcgaaaaatcagaaatgtacaaactgagccatacagtttcaggagttagccaaatacgaactgattcagggccgccggaatttctgcattttcatttccagcgactacattcttctgacactgagtcactgactgtactgacagcaggtcggagctactgcccgttgtggcttatacacggaactggacataacaatttacaacataagtgcaaagcagaagattaccacgaactgcatccactgtcagagaaacatcgaaacgatgagcaatacagcgtgccagtgcttgtgcattacaataagtatgggggtgtctattatgtttagataagataaacacacaatactaaaacatagatacaggagtactaattcagtcaagatttcaagttggaatttgttctgcttcactagaacagaacatacaaaaccaagacaaaatagaacaacgttgtagtggagattccccatcaagaagatattgttgattacactcagagccacccattgattgttggtatgaatggtaccaatcctgcagggaagccaagcataatcatcagaaaaaaaaaggaatcttaaatcacaataaacaacctctcatcttgcacaacttgttggattccagtagaaaacgatcagtttcacttttttttttgttgaaaagagggcaaaagctttgccttgtatatattgatagagcagggtgatcagtttcacatacctctgtggtctcctgacatcactaaattcaggaaatcaatgatgtgcttcggctcatatcagccaggaatggcatatttccatgattacgggtctattactgtagggctttgaatccctggtggaaaacaatgtcagaatttcttgatggaaattaaccatgccataggaaaaacagcaaaactgtaaaaaaaaacgattcagaattggctacaactaccagactgaaattttgtacacactaaaattctgcaagacattcaagacataatttgatacttagggatgtgtttgtacggaattaatctattcttccaactattcaggttgttaatcaagtttcttgttttgttcattcactagtggaacagcggtagtaaatgaatttaagcttggcagtgccacttctggaaaaatattttacgttgcaaatttattcagataatggaattctgaaacatcctaaggccatgcaagtaaagcaaggaaatgaatgaagagccttataatctaaacacaaaatgagttaggatatcagaagaaggatctcaccgtcggaaaccagcacactcatcgcagtcatctcgtcaatgcagtttccagttgaagccaatgtttgtgctttttacctgcttccaacacgagtaaaccatgatctcaagattctcaagcaagtatcatacgctgcaaatgttctgatatcagagggtagaaaaacttttagggtcatattgatctattcaccaaatgggtaattttaccatccttgaaaaagtatcgggatgtaccacactttctagtataaaatttggaaacaccatgcttgatttcttcacttcatttctgccagagtaccagactgccattcatgcagacaacaattgttgaaaatatatgcaaaaacagtgcgaaagggcatgtagcctagtggttgcagtgacctgagtagcaccccaaggtcctgagttcaaatctccataggagcacatatatccagttggatgtagagtccgggtaaatatacccttctctaaaaaaaaaatgcaaaaacagcacactaccaccaaaccgcatttcattgacacggatgcctgagtagcatcgagatagtgagcacttcagcaaaacccagtaagtaactatgccatacaataataactctgtagtgaagattcctgttaagaagccaaattattgattatactcgccagtccttcagagaaaccacgccacaaacatcagaagaaagaagctcgaactaaagccaactttcatcttgcacaactgttggattcaagtctgagatgaaaacaatcagttccacgaacctgtcaggaacccattgagctacacatgggctgactcaattgctaatccatgccaaggcccaaacaaacaaaggagatgaatacaaaagggagcagcaggagaacttcaagcaacgaacagattcatcggcggcttcggccacggcggcggcggcggcggcttggttcggttgaacctcgtcgatctctatctttttcttactctctcgtgttcctcttcactgccacttctagaagcttcctctacttcttctcactcaattcctcttctattttctgagattgtatttgatagctttatccaaataatcttgtgtgcgaaagctagttttttcagttgcatttttttaacttagccattgcattttgtaatagcattggattcctggttgcatgcgctggctgaagattagcaaactcggttagtgttagttatcgtttttccgttttttcggtagtagaagagatcgagcagggatcggatcgtgggatggcacggtcagtcgttgatccggcaagatcgcgcatgtaacagactcttttgtggaggtgaataaaaggaagaaaaaccccagaaaagctgcgaagtttttcagcaccaaaactctgtttttgctctgtttttctatgttgtcgtattttcgtcagatactgttcatcgttctgaactactcagacaagctaggatagccacaatctcgcgtgtgttcagagtgttctagctaacaattggtatcagagcagtactggaacgatccggcgatgtcatacacaccgcctggccgtcgtggtggcggtggcggcggggggagcggcaacggccgcggcggcgcaagcggcagcggcggggggaatggagcagacggcgcattacttccgctcgtgtctcaggggagagacgcatcgcacaccgctcgcctcccagtcctctcgaggacaaactacccggattgggcgctcctgatgcgcgtcaacctgcaggcgcaggggctgtggacggcgatcgatcccggctacgcggagtttcgtgaagatcgggcggctctctcggcaatccttcaggcggtgccgcgtgagatgttgcgcgggctggcaaagcatgacacggcgaaggcggcgtgggacgccatcaagaccatgcgggtcggcgttgaccgtgtgcgtgaggcgaaggagaagggcttccgtcgtcaatttgagtcgatgcgattcaaggagagggagacgccggaggagtttgcgatgcggctcactgccgtcgtcgcggacattcgcgacatgggtggagtcatggaagatgaacacgtcaacaagaagctgctgcgcgttgttcccaagaagtataagccggtggctatctctctcgagcagctgctcgatgtgaagaccatggcgctggaggagctagttgggcggctgtcaacagtggattcttacagcgatgatgaggagggaagcgatggcggaaaattgtacctcacggaggaacaatggcaggcacgtgtgaagcagcgggagcaggagggctccggcaacagcggcaataagggccgcggcgcgcccggcacgcagaatcaccgaggcaagcccggtgggtcgccaaagggcaaagaggcggccactggtgcgaacagcagccgcgacatctcgagggtaaagtgcttcaattgtgatgaatttggtcactatgcaaggcagtgccgcaagccacgacgccaacgccggggagaggcgaacctggtgcaagccgccgaggaagaaccgacgttgcttatggcacatgtcgtaggggtgtcacttgctggcgaggcgacactcggacgaacacctggtggacaggaggtacacctcacggagaagaaggtgatcctggaccacgaggatggtggtgaggaggaggtgacaagagattggtttctggataccggcgccaccaaccacatgactggagtgcgttcggcgttcgccgagctcgacaccggcgttgttgggacggtgaagtttggcgacggctctgtgattgaaatccaggggcgcgggaccgtggtgttccgatgcaagaatagtgatcatcggtctctcgacacggtgtactacatcccgaagctgcgcaagaacatcatcagtgtcggccgtctcgacgcgcgcggctacgacgcacatatctggggcggggtctgcacactccgtgatcccgatggtcttctcctcgcaaaggtaaaacgagacataaattatctctatatactcaagctgcatattgcaaatccagtctgcatggcggcgagcggtggcgacatggcatggcggtggcatgcgcgtttcggacacttgaacttccagtcgctccggaggctggcccaggggaacatggtccgcgggcttccgatcattgatcacactgatcaactgtgcgacggttgtctcgcgggcaagcaacgacgactcccgttcccggaggaggccaagtttagagcacaggaggcgctcgaactggtgcacggcgacttgtgtgggccgatcacgcctgcgaccccaggcggcaggaagtatttcctgctcctcgtcgacgatatgagccggcatatgtggatacggctcctctccggcaagcatgaagcggcgacggcgatcaagcagttccaagtcggcgttgagctggagtccgggcgaaagctgcgggctctgaggacagatcgtgggggggaatttacctccgtggagttcatggactactgcgccgatcatgggatgaggcgagagctcactgctccttactcccctcagcagaacggagtcgtggagcggcggaatcagaccgtggttgcggcggcgcgctccatgcttaaggcggctgggatgccggcgtgcttctggggggaggcggttgtggcggcggtgtatgtgctgaaccggtcgccgacgaaggcattgaatggcgtgaccccccatgaggcgtggcatgggcgacgtccctcggtcgaacacttgagggtgtttggctgtgtaggctacgtcaagacggtgaagccgaacctgcgcaagctcgacgatcgaggtacgaggatggtgtttattggctatgaacaggggtcgaaggcgtatcgcatgtatgaccctgtggcgcggcgcgtttgcgtgtcgcgtgatgtcgtcttcgacgaggcggcgacatgggcgtggcgtgatcctgagacagaggcgactgaagaggaggaattcacggtggatttctttgtgaatcccgtggactctgttgttgccgacttgggcgaacaggctagcacgcctgtgcagggaggcacgtacccggcgtcgacggccactccgccctcaccaccggaagtgccggcgggggtggagttttgctcaccaccaaactctgtcacgccagggacaaatgaaggccctatcaggtatcgccgagtgcaggatatcctatctgctactgaacctgtccttgattttgattatagcgaccaatgcttgctggcaagtgaggaaccaatgagtcttgcagaagctgaacaacagttgtgttggaggcaggcaatgcaagaggagctaaagtccattgaagacaatcagacttggagctttgctgagctccctgttggacataaagcaattgggttaaagtgggtctataaggtgaaaaaggatccatcaggagttgtggtgaaacacaaagcaaggttggtagcaaagggatatgtgcaacaacaaggaattgattttgaggaagtgtttgccccagtggctagaatggaaactgtgaggctcctgattgcagtagctgcaaacaaaggatgggagattcatcacatggatgtgaagtctgctttcctgaatggtgatttggaagaggaagtttatgttgtgcagccacctggttttattgagaaaggaaaagaaggccaggtgttgaggctcaagaaagctttgtatgggctaaagcaggctccccgagcatggaatgcaaaactgcacaacactttgatttctctgaatttcatcaagtctgaaactgagagtgcagtgtatgtgagaggaacaggaagctcaaggttgatagtgggagtgtatgtggatgatctgattatcagtggggctcaagcaagtgaaattgattttttcaaggaggagatgaagaagaaatttcgcatgagtgacttaggtctgctgagttactatctgggaatggaggttgtccaaaaggatgatggagtgtttctgtcacaaactgcttatgcagcaaaaatcctagaaaagacaggaatggaaggctgcaattctactcaagttcccatggaagctaggttgaaactgaagagggagagtggaggggaaggagttgattcaaccatgtatagaagcactgtgggaagtctcaggtatttggtgaacacaaggccagatcttgcttactctgtcgggtatgtgagcagatttatggagaaaccaacttctgaacattgggcagcagtgaagcatattctgagatacattgcaggtactcttgatgttggctgctggtttgggagaagggaaaagggtgaactcagattgattgggttcagtgacagtgatatggctggggatttggatgataggaagagcaccacaggtgtactgtatatgctgggagacagtttgatcagctggcaatctcagaaacaaaaggtggtagctttgtcgtcatgtgaagctgagtatattgctgctactactggtgcttgtcaagggatttggctcaataggctattggcagaattacttggagaggaccctggccaaactgtgatgaaagttgataacaaatcagcaatcaatctctgcaagaatccggtactccatgatcgaagtaagcacattgacactcgatttcattttatcagggagtgtgtggagaagaagcaaatcgctgtggagtatgtgcgaacagaagatcagcttgcagatatactgactaagcctgttggacgagttcggtttcttgaactccggaagaagatgggtttggagcaggcacatcaagattaggggggaaattgatagctttatccaaataatcttgtgtgcgaaagctagttttttcagttgcatttttttaacttagccattgcattttgtaatagcattggattcctggttgcatgcgctggctgaagattagcaaactcggttagtgttagttatcgtttttccgttttttcggtagtagaagagatcgagcagggatcggatcgtgggatggcacggtcagtcgttgatccggcaagatcgcgcatgtaacagactcttttgtggaggtgaataaaaggaagaaaaaccccagaaaagctgcgaagtttttcagcaccaaaactctgtttttgctctgtttttctatgttgtcgtattttcgtcagatactgttcatcgttctgaactactcagacaagctaggatagccacaatctcgcgtgtgttcagagtgttctagctaacagtattgaactctattgttcttgagaattctgagtttggaggaagagggttgttaacaatctggtatcagagctgttcggttcgctggggattcttgtcatggaggtgttggggaggcagccatgcaagagggaggaggaattcggttggggaattgttcatccgagtagcgcccaccaactgttcgatgaaatgtcgagcccattcgaagtgtacgaggaagatactatccttgtcatgaaggaggagaaagtatccagggatgaagcactaaggttgttacttgaggaatggatggatgccaagcgtaaattagaggagaagctcaaccgggtcttggagaagtttgaagagatggaagctcacaatggcgcagaagatgcaactgtcatcatcaaggcagccacaaccgacctcagggaggcatcatctccaacacccaagacatcgctatctccagtgtgcttcaatgaaaacagcatgcatgcggcaacgagctcaagccacaacatcgagctgactgccttgacggttgccaagtgcttgaaggggtgctctaatcatggagttggagctggtagcttgatgcccacaaggtgcccgacgaattgctcaagtcccggcgtcatacccgaccacaccatggctacggtggttgcatgtgccaccacttctatggcgttcatggagttggttgttggagaggaggcaacctgtgacacctataccgggaccactaattgtcctgaggtgacacacaccaagtgttcgacattgggccttgacgtcaagggtgacaccgaccaagtcatggtcgcattcctggcccagccttgtgtgttccttctcaacatggacaacacaggtaccaaactagtaaacatggtagaggtgactagtctacagacttgggcacctccctgtcgagtcatatgcaagggttccctggttaagaagcatccagcaacttggttagagtttgagtggaaacaacatgatgtgcaacagatacaaccatggccaccgccacagtggctagaaacttggttattccttagttgtttttcagatgtagcgccacatgattcagtgagcccattcatcattgacataataccttatgcactagatgatagggaagaaatgctcaggagatcaattgagctgaggccctgtacacatccacagtatttggggaaggggaaatattgggcaggaacagctatgtcctatggaggcaatcacctgttagcagtcaaaaggttattggcaaggttcaaggaagatttctctatggttcctagttggatgagctggaattatgtgagaagaatattgtggtctccgggctgttctctgctttctgctagagaactttggaagtgtttacagttattttgtggtaaaggagaattgttggatggtgagagttttatgcagcgaaggagatcgaacatgacatcctatgaggtttgctgggaaaggaaatttatatcaaaaacatatagtgattcttctcagaattggttcgagttgtatacttcgctctcatcggaattatggcataagcccactggctataaactgatgcaatcagaagctacttctggtgcaacatatttaattagtgcggattggactataacagagagctgcaaattatcatacaaaataacacttgaagatggtgaagtagatgtgtactggttgaatactaaggaccaagaattctcgtatgaacaattgatattccacaaagaggagcttgctacagtttgggtttatcaaagtactagttttatcaaaagtaagggcagtggcagggttgtcaccattgcagcaagtacctcatttaccaactctataccagtgccactagctagtcatgtttggaaggaattttcttggacactacattattggaatgatgggtctgtgtggaaattatggttctgttatatggtctttctgatcagtgtcaaacaagctgcggtgcctatggatatcttggatggaaacttggaagaatctgatccagcaagattaaagatgtggcctgatcatccaaaatatgttcagaggccgtgtgtaaatcaaagggatgaattgcgtcttagtgcacctgatctacaaatatcatgggatcctggtggtttatgtttactcaagtttctagctatctcttctcttggacaagtcacatttcagtcagtcaaattctcatttcaagacagttcttctctctttcacatgcgaagtgccaggatttgcttgagctgttcttttgagacgcaagttttctgttggcaagctgaaaacaaattggacattgatgaagcttttggaacgatgcaagaatactggagaaatcaaagtggaggtttgccatttctgcaatttacttgtcatcgacttgtggacaagtcgaatttcaaggagaggagattgtcaggaacccattgagctacacatgggctgactcaattgctaatccatgccaaggcccaaacaaacaaaggagatgaatacaaaaggcagtagcaggagaacttcaagcaacgaacagattcatcgacggcttcggccacggcggcggcggcggcggcttggttcggttgaacctcgtcgatctctatctttttcttactctctcgtgttcctcttcactgccacttctagaagcttcctctacttcttctcactcaattcctcttctattttctgagattgtattgaactctattgttcttgagaattctgagtttggaggaagagggttgttaacagaacctttatggtcggctggcattgctggctcactgacagccaggaattgcatatttccatgatttggggtcccttagcgtaggatgtttaggctctgcaataggaaaataataccttagtttcacaatcgaaattaactgtacccaggggaaaaaaaaggaaattctgtcctattcaattttaaacagaggggctggtgattgaattttcgagtgcgtacactgcaacatatagatctgtaatatgtagggaaaagcaaaaacgaaaaagaagaaaaaagcaatggagaggtaccttcatcaggatctcttgcacgagcatctcacaggtctcttctcacaaggctatccaaccgtggccgaatgtgtttatatagcggcttcgtattcaaagctgggcaatatcggattgtgatactcgaaagagatgagtaactccccagaccacatggtaaggatgctagacgtttgcagctcacaagattgagggtttctactgatggcagatctcccaaacgattcagtgactccagtttattgcagctgtcaatggatatatactcgagtgcatgtatacagctgccgttagacggaatgaagctcgggacatgaataaatgtttagcctcttgagagatgatggtaggttctcaagtgctaccattttaggacatacccagacatctagtctttctaggcatggcagaggatggtctgctgctgatggcgattgctctggcaggcttgtgcacgcacgataattgcaatgctttgatgatgtaaatgtgttgtgatgatctacctgtacactctcggacactatatcccccttcccccatatgaactcaagtttagagcaaggtgtgcttctatgctccttagaaaaaagttgcacgaaaaccaaagctcatcaatggctgagattaaaagcgaattaacagtgtaatcatcattagtgagggggtatttttgtccatataatttggagcccagtctaactccaccgtaaccacgcgcaccgcccgcttttcactcgcgtcgccgccactgctccgccctcttcctcccccgcaccgccgcctagacccagcacccatggatacgtgcggcgcgggggaaccagagtaggcggtcggccggcgccgttgtggggaacgggtgatgccgatgccgatggagcactgccgcctcgctccatctaatccggttagccccgcccctgatgacctcccggccgtcgccactatttgcgcaacaagattcgccttgagcgcgaggagccgaggactacggtaacgtggacgtcgagcacgccgccgtgccagcagctgtcaagcggccctagcaacagctgaagcagcagctttttcggcgccatgatttacccctcatccaaggccaagttgccattccagcttgtgccttttggcttgtttgatctctgtctgcactgcaatcgccagtttgctgcaagtttgatgtgatcatgtgaattgtgatcgtggatatattggtggtgactggtgagctgtataaatgaatgggggaggcagaatggcacgcagatgcttgtttatgagtatgttcccaatagaagcgcctatacacatttacatggcgattcctcatgtgttctcataacattcttttcatggaagaagaggacggagaggcggcactgcttgcaggaggaagccgggtggcgctagactgagcggcgccggggccgggaagcggtgaggcgaggggaaaaaaaggcggagcgccggggccgggaagtgacgaggcgaggggaagaagagggcggcgctgcttaccggacggcgtggcgatggaagcgctggcatgcttccgcggctgaggagcggcgctgcccgaggagagagcgtcacggtcgcggagtaaccggcctagtggtggggatcgcttcaaagttaatcctatggacaaaaatacccctcgctaataaggattaagtgttaatcatgttttaatctcagccaccggtgaactttgattttcgtgcgcttttttatttaggagcatagaagcacatctctgattataaacatatgtgagagatggggggagaacgaagagctctctcaagctatcacaattggaaatttcaagtgaggttagacgtggcaggagctgatcccttgcacagcaaggtggctctcctttcaccagcgtgggacgccctattagcttatcacatccctcaatgcccaatgtcttcaaggatactaagcacaggaactcttcctctggccagtagatgagcacaccacagaaccagatttccaaacacacaagttgtctaaggcatttccaaaacatgattattggttgtgatgggctcgtggggaagaaaaagttgcagtgctttaagtccagttctgagagagatgattcgtgaatctgatcaagctgcactcttccttctttgtcatccacgtccagtattagcttggatttttttagataatggaagcttttattaaactcagtcaattacatcaaggtgatacaattatcctgagaacacttccggcctctgcataactaagatgcacaccgccgaacaaacaaaacgacactcgaaaggaaaaaagaatgacatggagtattgaggaccatcaatctaacgactaaattgccactcatgaacaactccttggccatctcctccaaaagcacagagttttaaggaccaccaattctaagactagatcaccacccatatccctgggtaaaaaactccttgaccaccttctccaaatgttgacatgccgcaactaccatatcccgcgaatcaggcttctgtaggatagcccatatacgaagccaatggataagagaatatataacctgcaaatgtgaagatatgacttttttatcaaaaaccacattattcctgtatagccaaagcgaccaacaagtagcagctgctcctaacagaacatgtgatttcaaattattatgaattccatcaagccagctcccaaacatatgcgctacacaatgtggtggaggaagtccagatgctgcttggatgatggaccaaacagaaagggcaaaacggcattcgaagaaaagatgtctaattgtctcgtcattgcaacaaaaacaacaattcttattgccttgccatttcctttttatcaaattgtccttcgttaacaccactccacggcttggataatgaggacatgtaactggcttggataatgaggacatgtaactggattgaagtaaaaacaaggacagttcggccttgttttcatttagactgaaaatcttgagctttggtgcttcgggtagactcctcagttttggacagttcctgatgtcagccttttcaagcagaggaaatgttgattcgttttccactagtctctctaagccctctaaatcatataacttgattttctttaatgctggaaatggtgtgaaagccatttcacagcatagtgtttgcagttttggacatttctctatttcaaccttctcaagcagaggaaacactggttcattttcttgtcttcctcctgttgctacccatctctctaaagcttccaaatcgtgcaacttaatcttctttaatgaaggaaatgttacggatgccatgtcagggattagtgttagaaactttggacagctcttgataacaacgttctgaagaagatgaaatgtttgttcttttccttgtctaacttccttgcaacatagggtttgcaatttatcaagtctgatcaaacagagaacttgaagagacttaaattgaatgaattgaggaaattcttcgcacattgtacaaccctctaatttgagctccaccaagttttgcagtatacttagatctgtcatccatgctggaaaaatgagtgcttttataggaaattacgttgagcatcagcagcccatgatgtggtttaagagcatcaagaaccttcccattgcaatttggttcttcaacacagcattcactattccacacaagagataggcgtgcaagtttctctttgtttctaagattggctgcttttgcatcttcttgagatacattttctaagccacgtaactctagttcaccacagaggtttaagctgtgcagttctctaagggtgctgcaaccagagctagcaccaaccacaaaatatgttagtgtccggatggaagttaattgcccaagctctggaggcatgcacttcaatcttaagcatccatttgtatagaggtgacgtagacttgtcatatacttcatatcctttgggagaccaacaagaattttgcaatcagaaaggatcaaagtctgcagattgtacagtgtgcatatatcttcaggaagtactttgacatgatagtttctggagatatcgagatatcttaggtgcagaaggtgccttggcctgattggtaatgattctgtattgagatatctcagccttagtgctcgtagagaactgctcttggataaaagtgatgttgagatgtgaatatagtctctgtcaaacaataaagtccggagtgttgaagattgttttctcataaagtcatctaagagaatagtattgtcatcgtctaatgagtagaagtgatacctaggatgctctaatgacttacttctataatcagatctgccaactatgctgacacattcttctcccatagcagattgagcaatgtcatgcataagatcatgtatcttgcatgtagtttgtagaggaaatttctgcacatcttgaaaaaatgacctccaaactagctcgttgaagatatgtttggccaccatttctatattgtcatcctcttgtaatggtatcaagtcatgtgctaaccataagttaatcaaagtctccatatcaatctcaaaatcttttgggaatatagcacagaaggcaaaacaccgctttatatgtaacggtaggtcatcatagctcagacgaagtataggaaaaattatgtcctccccctcattgcaaatgttgctcttggctaatatatccttccattcttgcagagtagtcctgttaaataacaccgagccaaaggattgggcagctaaaggagagccatcgcatctctgcacaatcttacgaagaacttcaaaatgctcgtcacttttttttgacaaactaaatgctttactctggattatttccatcaaataagcttctccgagcttttcaagattatgcactggaacttctccaataaccataattctagcaacttctgcatttcgagttgttgttagtactacactacccatgccacccttcttaaagcaggtctttagctttccccacttatcagaatctcgattccatacatgatccaacacaatgagatacttctttccacctacttctttctgcaagtcctgcaaagccttctcacgatctctctctgtgctcatacatatgctgtttgcaatggtgacaacatcaaacacatctgacacacaacaccacctacgaagcgggaaatacttctcaatttcagggtcattgtaaatgagttgtgcaaatgtagtctttcctagcccacccattccgacaataggaagaactatgaggtccttgcctcttgcttcatcaagcaacatcttgataatcttcttctgctcctcatctctagatcggctaataatacccttctcagtatcaaccatgatggaatcagtttgcctccactgctttggtgtttcctgctgctgttttatgagtccagagtagtccatctctgatatacaatcttttgcaatttcttacccatcctataacgaaacacaattgggttacgatgagggaagaggcttacaatgcctttgccaagggtagcgtcgtgccccttcttcttggcttcacgtcggagcgcctcatacttgaactcgtcaaagacatcgattgcctcgtaggacaccttcttgagttcatcgagccaagcgcttagttcgggtttcttacttctcttctcctccgtatcttggatgacgctaaggataagtggaagcatgcgctccagagccttacgctgctgctccatgccttccatcaccttgtactggtatacaaggtagctggaagctttgttcgtcaccgcggagagcagtggcctaaccaaaaactcagccatcgttggttccctctaacactgtagacctgaagattgtggaatgaagaagatgaaggcaaatacaactaaaatgatatgcaggaagatgaagccagatctcctaacctcgtcgaccaagatgtttgtggatcggagcagcgcagtcgccggtgcggcacaggggaggcgctggatgagtcacgaaggttgggtggtgttctccttctctcggtatgtagctcgcattggactgacagacgatggaggatggtggattgctgctgcacactgagagacgacttatggttgtgtggctgggtagtgctggagaaagagatgatatgtgagagatcactttgctgggttgttttaggcaaggaaaaaggtactaatgcacaattgaaatgatatggttgtgtgcactgcattaattgtgtcttcatctggttggtgaggatgacatctcgataactaatttttggtcaccaaggttttcacatgcatgcgtcctggtatttttgcttcattcatgtgccatctactttttgcacattgtttgtgacagtcagttattttacgctgggggtgaaattgtggtgaatggttttcagttgctgaaatgtttttttctttatggacctctattactttttcagctatttgtttatttaaaatttaaataaactaggcgattgtcccctgtaaatcgtgcggtcctagattttaggcccgatttagtcctcaaaattttttcccaaatacatcatatcgaatctttggacatatgtatggagcattaaatatagataaaaataaaaactatttacgcagttaggggagaattgcgagacgaatcttttaagcctaattagtccatgaatagccataagtgctatagtaacccacatgtactaatggcggattaattaggctcaaaagattcatcttgcggtttccaggcgagttataaaattagttttttcattcatgtccgaaaactccttccgacatcagtcatacgtccgatgtgacacccaaaaattttttttcacgaactaaacaagggctgagtttagatccaaagtttttttccaacttccaacttttccatcacatcaaaactttcctacacacataaacttccaatttttccgtcacatcgtcccaatttcaaccaaacttccaattttggtgtgaactaaacacacccaaggccttaaaagtaaaactagtctatatacaacacttcaattataagagcttgtttagttggtgaaatgataatttttggatgttacatcggatgtttgaccgaatgttggaaggggttttcggacaagaatgaaaaaactaatttcaccgctcgcctggaaaccgcgtgacgaatcttttgagactaattaattcatcattagcacatgtgggttactgtagcacttatggctaatcatggactaattaggctcaaaagattcgtctcgcgatttccgtcataactgtgcaattagtttttttcatctatatttaatgctctatgcatgtgtccaaatattcaatgtgatgtttttgagaaaaaaaatttgggaactaaaccgggcctaaacttgaatgtttgattggagacagcaatgtaaatgtcagtcgtgtccattaattggagtagagtgatggcagagtttagggcaagcaccattcaaccagtactcagaatactctctccgtcccataaaaaatcaacctaggtgagaatgggacatcatctaaaataacgaatctggataggaggttgattttttatgggacgaagggagtgttaggatacgataggcaaataaacgatgaagaacaatagatcaatcacagaagacacgaggttttaacatggaaaaccctcctaagatatgatagaaaaaaaaaacacgagcgccagccagcaaaactgcactatatcagatgaggttacaaaacgcccaacggctgcttcgctctggcccaagcctctagcgatgggcctccacttcgctcagtccgaaattggcctttatatatatgtgtgtgcaaatgaatttggatcacaaataaacagggagtacttgccaacttaggccatttacagtgcaaggacgtgacgtgtggcaatgtagagccacgtaggcaaatcgcttgcgtggaggagagaggggagtggggaccattcccaacctagcttcgcgtgaccaagtttggccacacgaacctcagcaacttttgtcaaaaaaaaaaagcacctccacgagaaataagaaagcgagagagggagagaaaggaggctcgccggagtaggcgcacttggggcgtggggctcggcggaggcttgccgaagtaggggtgcttggggagctcgccgtcactgcgtggggctcagggaagccaccgctgcgtggggctcgccggagtagggccgctcgaggagcctcccgagatccaccgccgtctttcgggtggagctcccgaagctcgccaccccctcgcgcgccggtggcgttggcggggtccgcgtgcggctgcgcagctccagtgctgcgcctccaccgtcgacgacggtgtcgtctccgccgccgtcttccgccgcaccgctggacgccgccggagctgctgcttgttgccgcgtgggctgctccacctggttggaggaagagaggtggcgtcgcgcttgggccggcccgccgccgagctttgctgcgccggtcggagcacaccgccatggcctccctagagaagacacgagaggattaggtgggggtgggggaggggtgagattttttatattatctgtgggtcctattataaagtttctaaaccacactagcttgccacacttgaattgtggatgtagtgtcttttggagttcccagacctacgtggcagttgtggcatagcaatatgctaggacgcattgctactgcccttagagcaggtacaatagcagagtataagcaagctgcaaacatattttaagagataaatgaggagagagaagggcagcgggctacagatttgtagccagctgtagtacggactccaaggcagtgtgtgtatgacaggtgggaccagatattaatagcatagtatgtaactattgtatgaataagctattagattggctatagatgaattgtagctagtagttggctatactattaaacttgctcttagagtaccttgttgtatgtaaggtggcgcggcctccgatgctgaattattgcaaaccagaagttcaccagcaaagcgacatggagcgctgacccaccaagcccagcaaacagcagcatgcaaatggctgatgcacaggaatgcacgctgatggcagagaagttagaaatccgatggagctctggttcttaatctacttcctctatcccatataaagaagcaactcctaacattctaatataaaattaaaggagagaataaaagaccaaaatatcccatcgtcctattctaagatgctgaagccgatagtgattttaagccgatgatgactatagggcttaccgaattttgatgttaacaggtgtgcagatggctgatccgcgcacccacttataaatcaagataaacaagtttgcagctttagcttataagttaattttatggattagctccttacacccttaaatacagtagagccgatgtgagtctggatcctgcaagtggaagggaaggcggggcgagtcgccgggcgttgtgtttggctggccgtacgtccccttcgactgagcttggcaggctgcctggctgtcctgcccggttggggtggttgtctttgcatgactggccggctgggtccccggccttcttagctggttgagcacttgagctacggctagggttgggcccactaaaaacaatcactaactgcctgccaacttggagccatgctgtgatccaacttgttgtacagaacctcatgcattattgcaggtggtggcctcctgcattattgcagacggaacacatcatcacgacatctcactcaatttctagtgatattttttcagtcatttatttccagaccaccaagaacaaactaaagcacacatcgatcagtagccatggatatcgtggtgagcgtctcacatggggcactgggaccactgctgggcaagctcaataccttgctcgtagacgagtgcgcacgcctgaaaggtgtccaccgtgagatacgctctcttagatcggagttgagcaacatgcatgcggcgctccacaagtacacatcactcgaggatcctgacatccaggtgaagacctggacaagcgagttgagggagcttgcctatgacatcgaggactgcatagacaagttcatgcaccaacttggtgccaacgacgaccagcaccacactagtaatggcgtcaaggacttcttcgggaagagtgcaaaacgtctcaaaactcttggctcaaggcataatattgctgccgagattgaagaactgaagatgcgagttatctcggtgagagatcaaaagaacaactacaagcttgatgatattttttgtagtagctctagcaacactaatgcttttgttgatccacggttggctgctctcttcgcggaagagaaccatcttgtcggtatagatagtccaagggatgaacttgtcaattggttggatgcagacagcaggttgataaagcatcgcaaggttgataaagcaggtcaattgtggggtttggaggtcttggaaagacaactctagcaaatgaggtatatcgtagggttaaaatccattttgattgccctgcttttacgtcggtatcacaaaagcctgatatgaagaaaatcttcaaggatattatataccatatgcctacaaaagatgcattcctcaaagatattgacacatggaatgaaaagaaatttattgaaaagctaagagaactacttgtggataagaggtaattctctagctcctttttcttttccacttcgagaaattctttatacctacattcgtgatataatagagtggttttttcctacacaaacttatattgtttataaacttcaactaggtatcttgttataattgatgatgtctggtctatttcggcatggaaagctatcagtgttgttttcccggagaatggttctagtataattatagttactacacgcatttccgatgttggacggtcatgctgcttaaatggaattgaccgcaattttgagatggaacctctaagtgaaattcactctagaagactattttgccagagaattttcagcacagatgaggatggctgcccagatattttacaagaagtttcaacagatatcttgaagaaatgtgggggtattccattagcaattattagtatatctggtttgttatcaaacagaccaattatcaaggaagagtgggagaaagtgaaagaatcgattggttttgtattggacaagaaccaaaatctagaaggaatgaaaagcatactctcccttagctacaatgaccttccaaactattttaaggcatgtttgatatatttgtgcatatttccagaggattatattattgaaacaaacatgctattacggcgatggatagctgaaggctttgtctctgaggattgtggaatgaacttggaagatgttgcagagagctacttttgtgagctggtcaacagaagcctggtccaacctgtggacattcgctttgacagtaaggcccgtgcatgccgcgtccatgatataatgcttgaacttatcacttcaaaggcgacagaagaaaactttattacattgttacgtggccaaacaaggaaaacaaatttgcatggctacgttcgtcgattatccatccaggacactgataatgatttgtcaagtctgttagtaaacaaagatttaagccatgttcgatctctaacctgctttggtgggaacatgaatcttttgccacagcttgcccgatttgaggctatacgagtgttggagtttgaaggctctatgaatttggagcagtatgatttggaaaatacagacaagctattccaactcaagtacttaagccttcgtggttcagacatatcacacataccaagacaaattgcaaagctccaaaatttgctgacattggacataagtgaaacattcgtagaagagctgcccaccgaattatgcctgttgaaaaagttactacatctattcggaaattccttgaagctaccagatgggattgggaatatgaggaatctacaggtgctgacaggcattaatataagtaatagctcagcaagtacagtgcccgagcttggtgaactaaccagtttgagggacctcaaaataagtttgtctgataaactcagcaagtgcaagacaaaagaagagatgttactcgcctcactttgtaaactaagcagctacaaactccaatcgttgcatattatatataacagttccgatgatctcttagaacgttggttccctatcccttgtttcctccgattgtttcgcatgagcactaatcactttctcccacaacttccaaagtggattaaaccgagtctcaccaaaatggcatacctgaacatcaatttacgtgagataaaggaggaagatatggaaacacttggagacctgccagccttactctgtctagaaatatggctagaacctaacccaaaaaaacagcttacagtccaaagcacaggattcccatgtctcaaggagtttctccttgtttgcggcgatcacgatggtggagcgtacctaacatttgggaaaggggctatgccaaagctggagaagcttgagattccatttcacgtattaatggcaaaatcccatggtttctattttggcatcaacaatctcctgcgtctgaaagaagttttttgaaaattcaccgggggggagagcttccccacctgaatatattacttcgaaccatcttatatagaagagatacatgagagtttccaagcacaggagcccttgaggataacatgagagaaagcactgagagatatagagaagagaatacaaaagattaagagacagaaggagaagctttgacattttccacctacaagatcaccaggccaagatcaaaatcacttacgctaggccctatctcaaccacatccgcttcacacgcaaattttgaaacaccataagacaatagagccagggggccatttctgccacaagcatgtcaactcgagttccggcgatcaaaaggctgtgattgtccaggaccacccgcattagccataaaaaaacacgacttcatcatgttgctgcttgcatcaatgcctgccggcgccctttagggaaaggaagccccaaaggagggagggccactgaagattacggtcatgggccatccgcatcaagacgtcttcaatatggatttaacaaagtgctagcaagttcaacagcctccaacgcccttcgggggaaagaagcccctaaggggggagggctgctaaacaatgtggccaagacaaccaggtaaaagggtatagcggagcaaggaggtagacagaagagataatgaagaggtggagatctcacaggtaggaggaacatcaacagcactggcagagagatgcaaagatctgaggccatcacagccaatggagaagcacaatcaagaagagatagacccaaactatcaaacaaggagcaggttaatattgaggggattcaggtaagggagtcggcaccaacaaactcctagataacagatcaggccaaattggtcgtggcaggcttaactccaaccatggggcacgacagaaaaggcacaaagcggacaacagaagaaaaggggagaaggagtggatggaataggggagaaggatgggaaagcagggggactggttgcagggtttctccaaaaatgatgccttcaagaaggtgacgacgtcggaaaggacgccaccatcacataaacaggagactggaaagggttttcacccagcaaggaggaacaagggtgttacgacgacacctctagggaggggcatgatgtccgaggatgttcatcgccgtcagtccggcgatgagtcggacagagcttttcacccaacaccctaaaaccatcctcactaccagctagcacacaccgcgcaacccaacagccatgcgcggtggaactggtcccaggtcgtcggccgctaactagcccggcaggtcccaccgccgccaacctgcacaaccgacagcaccccacaaaccgcaagtcccactcccgacagatctagacgaaacccttgaacgggaaaaatggccacaacagccttccctaattccaccaccagcacaatcagggaaggggggcatcagcggcttgaaaacccagattcggaatgagaacattgaagaacaacaaatgaggagggaggctaggagaaagacgggagggtgggaaggaggtagaggagggtgggggcgccgccagcggcaaaggggggcggtgccgccgtcggcgaggtggtcggtggtggggtctcgggggtttggggctatcgcctcccgggccgcccgagcgagcgacacgggagtcctaggtccaggtaccgcttgcgtctgaaagaagtgaacgtaataatctaccgttaggggactgtacgttctgataccgagtctgcggtggctgcaatcaagagagaagcaagtgcaaatcccaaccatcctagacttgccatcttcggagcagatgcagaagaggtccaagaggataatagcgaagagagtgattataactggggttcagaggatgacgatgctactgacacctgatattgttgccagccatgatctttctggcaacccatgaaagaggtaaatagaattctctctaagtagcaagctagttgtggttgttacttttactatcttattttgtttcactcgatctgtaagaaatttgtgcactccatttctttcaggtttgcttcaattgcatgtcgtcaagtttgaaactggagtccacgttaagtccgtgcaaagtgggaagcataaattatatgtgtgcttcacattattgttgttgtcgacattttgtcttatcaaaacatgatcctgcatgttgtactttctaaataatgtagcaacttcgggctgcttggattgttataattttatttgaattttttatggattctagagtattaacatggtcagctttttttttcatccttgaaaagatatgacaatgtacgattttataccgtgaaaattgatcatctgcctgacagttcagtagcagttgatcgcgtttcaaaggcatatgtaaggcaaatgaacatttaccactcagctaagggccaaatgatcttaaagattacctattatcggtcaaatttagaaattctttgattgctattgtaaatctttagaagtctaatgtgacaacgagacttaggccctcttcgattaggcttagatttattggcttagacttttaagttaacttattggcttatatgatttataagccggtggatttaatgtcctaagtttaatagtggagtcatacatctacctcacataagccaaaatagcttctccaacttagcttttggcttaatagtgttagagtggcttatagctttagaaaagccaaacgaaaaggccgcttatttgtttaggcttagactttttgacttacaagttggtttataagccgaaacaaaagggccttacccaccacatttgattcaacgcggagctgcagggggaaggggaccaattgcaaggcctcgtctatagtctctgtggggctcaccagccaagcggttgaacgccctcctccagtgcaactcatctatttgtacaattgtgaatgtcacacagaaagatgatgacagtcgagagtaagacggtatagttgtgttaaatagtcctacattggttgtgaaagagcaaatgacttaatatataaatggaagagcccataaccttattggctagtttttggggtgggaaatgccctttatgattctacacgttgtcctcgcaaccattcggtcgaacaccgaaaatgcagtttttttttccttctcataatctctatacaacttttgcatcaaatgatttctcatacgatcactcaagctaatttacataaatgaaaatgagccgagtaataggagacacgaccaatgcaactcgcccagtatgcagccaattaatgtgaatgtatttgtggaacatcatgttaattagctttagcttcatggctggccactggtcagcggagcagaggaaatcagagcatcgcaggtgcaagatgaattacgctgagcaaagcagagcacttcaggtgactttctggtgctccaaatatttttattttttgggatagaggataaatgtgaggacaatagaggtgttattgaagataaaatggcagctgtcagacggattctgtactaaattgaaatataaaacacataagttcaataattgtactccctcggtctaaattgtagcaacccatgaagctcaataatttaaatcaaaccgagacttaaccaatttaggtaatgatccaatggaaatgcaattacccaaggcttcttttgaccaaacaatattcagaaacaatattacagcctcacgttcaccaatgtatccagtgatgttgcgagggtagggaaggtcatactgctgacgatgtgaaactcattctgttgggacggaataagcgtatcttccaaaaaaatcccacaacggttgatagggtggccaccctaattcttcaagatattgatcaaagactcttggctttccaacctccttgatgctttttttcgtttttgtgtttttgttgttttcttgtctgtaaataacttttatttcgtctaatatattccggcagtccttctgccgtcgttcccctaaaaaaaaaaaagaatcagggtcatacaagacagccagaaaaaaagggaaacagaaaattgtaccagataactacatgaatactaatactacagactgcagagtgtagacatggtttatttcttcagaagacacttcatatgagcaagaaaaaccacaagtagagcatcacctactgtgtacattaaggtcagatttttgtagagcgtgagatcttcaagctgcttgatccaatttacattacccaagataagtggagatcatgtttagaaagataactaatatattatattctcagtcacttatgcaccaatcgtgtatctggaagtcgtccagccagacgcaccaatcgtacttcacctgtagaaagcagcagcaaccaaatttgacgtttcagctactaaaacctataaattgagaatgcacgagtcaatctcacaaaccttccaggtaaatctcctataatcaggtcaggacatcaatcatcctggttgtaccaatatccaccacatccaggaatagcatatttccaagaccatggatccctcaataatggccctaaatgtataacagagagtcagaattcctcgatgttaatctgtgataaataagagagagagaattcctctatataaacaaacttcaaacatgtaaatcaggtgagcacttactaaaagaattaatagactagagggtaacctgcaaatggaagtttcaactttcaaggttatgagaacaggtgactacaatccgaaagtgaagattataataagtcgtgcattttcatatatatgggcaaaaggaagaaactagtatcaaaaccacatgcatgcatgccatatatgtagaactaagactggaaagctttaaaacaataacagagtaggtgtagtagtgattaaaatttgagtttctcaacaggcaaaaagtacagcaaggtagtactactatcaagggaaggttgatcgaaagggaccttcttcaggatttcttgaatgaacatctgataactctctgatctcaagactatcaatccgctgcccgaggcgttcatacagaggcttcacatttatagctgggcagtatttaatcgtaatatcttgaagaagtgggtaacgaccatggcaccctgctactgattgcaagcgtctgcatccctcaagacggaggattcgtagtgacggaagatctcccaaacaatccaatgactccagtttattacagtgatcaataattaagcgcttgagtgcatccagctgtcctgagacggaacaaagcttctcacagccaaatattagtagcttcttgagggaatgattcagcgcgtctagttgaacagaatgaaggttgtcacactgaccaattcccagcgacttgactgtcggtggtagatggttaagtgttaccaatctatgacacctacctatggttagactctctaaacatggcagagaattatttcttagtgatggagattgctgatctggaacaattgtggaagcaaggtcattgcagtgttccgacctgcgttccacctgtattacactctctgactctgtcttatcctctctccacattagctgaagatttctgcaatcatgaatagaaatagatgtgagagatggtggaagtctaaagatctcttccaagcttttacattgccttattgatagtgacgttagatacggtaacaactgatcgcttggaactcgagttgactccccactcacatgtctgtggcctattaggttattacatttttcaatggccaaattcttcaaggaaaccaagcatatgaactcttcctctggccagtacacaagcacatcacaagattcaattttcaaatccacaagttgtccaaaccatttccatatcccaactgttggacgggatgggcctaaggggaagaagaaggcgcagccacataactccatttccgaaagaggtgcttcataattctgatcaagctccagtcctgcatttccgtcactgacagacagtgttagctttgataatgaagaaaatctagacctcagaattaataaggatagctctgccttttcttcaactagcttcaatatccgaagctttggtgcttttggaagggatttcaacattggacagttcattatactagcactctcaagcaggggaaatgtcacttcttctccttccgtcgccgaccatctctccaacctctccaaacgatgtaactgaagttctcttagtgctggaaaaaaattggatgttgtgtagctgcataggcttgcaaggttgtctaaacttgtgagacaaagaacttttaggacattcaaatgacagaattgaggaaattcctcgcacattgaacaaccaactagatagagctcggccaagttctgcagcacactgagatctgtcatccaagttggaaaaccattgcctttgtaaaatgctattcttaacatcaggagcccatcatgaggttttagagcatctagtaccttcttttggcgatctggttcatcaacaaggtggtcattactccattcaagagacaagtgtgtgagtttcactttattttcaatattgactgtgcttgcttgtgcctctgatacattttctagaccacacaactctaattcaccacaaaggtttaaattctgcaattctctgacagtactgcaaccagagatagcaccaaccacaaaatatgttagtgtctgtaaagaagttagatgtccaaggtctggaggcatgtactccaggtttttgcatccattagtatagaggtgccgtaggcttgtcatgtacttcatatcctttgggagccggcgaagtctaatgcaatgagaaacattcaatgtctgtagatggtacagtatggatatgtcctctggaagttctttgatgtcgcagttttctgagagattaagataccttaggtgctttaactttatcggtctaattggaagttctttgatttcatatagctgcagtccacgtagagaaatgcacttcgataaatgatgtatcgatccataagtattccatgttggatacaataatgtccggagagttgtagattgtttcctcagaaaatcatcgaaatgatctccagttctatgccttgacacgagcaagtggtaagtcgacggatttgacaacaactctttgcgataggacctatccgtaatagttacgcattctttccccataacatatagagcaatgtcatgcataagatcatgtatcttgcatgtggtggtgtatcggagttgcaccctgtctccattattactgcacacaagaggagtttgtttgacatcttgaaagaatgacctccaagctagttccttgaaaatttcttcccctgatgtcgtttcaaaatgatatttctcctctagtggaatgaagtcatgtgccatccatagttgaatcaaattctccacattaatctcataatttttggggaatatggcacagaaagcaaaacattgcttcatgtgcgatggtaggtcggcatagctaagctttagtataggtaaaattccagtcttctcgttgcaaatgtcacttttggctattatattcttccattctaggatgctggtcttggtactcaacatagaaccaaaggcttttgcagctaaaggagaaccttgacatctgtccacaaacttctgaacaatttcagatagctcatcactgccagccaaactgaatgctctagtctgtattatttccttcgtatattcttcgccaagtttctcaagattataggcttcaactacaccagtgatcataattctagctacttgtgaatcacgagtagttgttagtattgcactacccttgccacccagcttaaggcaggtcttcaatttttcccacttatcagcttcccggttccatacatcatccaagacaattaggtacctcttcccacttattgcctcctgcagatcctgcaatgccttttcatgatccttctctgtgctattgcagatgctatttgcaatatttccaacatcaaaatcatctgacacacaacaccacctccagagttcgaaatggttcttgatctcaggctcattgtaaatgagctgaacaaaggtggtttttcccagcccagccattccaacaattggaaggaccaacagatccctattgctgctagcatgattatgcaatatcttcacaatcttctttttctcctcatctctggatcttcttataatatccttctcagagtcagccattatagaatctgtttgacgccattgattggatggtggagcttgctgccggtgtatgaacccaaaggagttcatctctgagacaaggacctcaatgctccccacaatcttttgtagcttcttacccatcttattacgaaacatgatagggttataagaaggaaagaggcttacaacgtccatgccgagcatgttgaactgccccttcttccttgcgtcgcgccggagggcttcgtacttgaattcatcaaagacatcatttgcctcataggccaccttcttgagtgctctgagccaagcgcttactccaggtcgaaaagctcccttctcctccgcatcttcaatgacatccaggatggcaggcagcttgcgctccaggatctcgcgctgctgctccatgccttccataaccttgtactggtctagaaggtagctggaaaccttctccttcaccatggaaactagtggtccgataacaacctcagccattgttgcgctcacaactgacaagaacacaaggaaacactgcagcagtgaagactttggggtgcactagaaaaatatggacgagcgcttcagaggaaatagatgggagtgtgcttgttgtgatgtgtccccaatgatcagccacttaaaatatggttcacaggtaactataacactacagtactctagataccttattagcatctaaataaccatgtgagagcacctgctgtcatccatttgaacttaagaaacatccagtagaactaaagtcattagttactacttacacctgaaaaaaaaggaaattttgaagacatatcttttatattataaagatagctctaaaagaaaacaccatgttcgatgtgaaggcctagaaattacaacattacttggagaaaaaaataaaatataaaacattacatcatgatataaccaaattataacggtgtagaatgataggaacagttgtataaatttacaattatatctatggaaacacaatataagagttatatattaagcccaattctacttttagtatttatattgtatatagaatataattgcatatatatagaaacaggaggtaagagttgtatacttgtatatcaagtcatattcaacaattagcttgatatgatgcatagtaaatatatgttagaggtggtgtcttgtaaaacatgaattattggtcaattgaaaacaagagggaataaaattccacctactaatcatgtgagagcatctatgctcatccatttgctcttaagaaactacctagttgtcaaattgacctgtcgagatgcatgtcaaggcccatagaacaaaggtatttgaagactttgctagttttgcagaaaaaaaaagcgagcgattatttttgaagagagcgattattgctctcttcgaaacaaatttttgtttataggtaaatgaaggccccgggcatttgtatttgtatgcagatttgttatttcagccaagagggggaacccacccaattttattttaggccaattttattttaggacaagaaataaaaaagaatgcagccaatgtatgaaaaataggactaacgaatgtcagtacagacacacagcatctgacctcagtgagaagctagcacggcgatgcagtcggctggcaccgtggaacactctggcgacacatcttgtcggcgtcaataaccctccggcgatgccttcccgtcacgttgtttctgttattcctgatcggatccaatgtgtcgtccttgtacccatttcgtcgagcaccatgtgggcaccggcgtgtaagccgcctcgtctcccgcctcttgcttgaattcttggcagcgacagagggaggagagaggcgagggtgccgacggcgcaaagcatgggaggttgacggacggcgaggctggcgagtgggtaggcggctgctgatgcagcgatccggcgcccgctggattggtggggcgagacgaaaaatgcagcggtggcgccattagtttgcaggtttcagcgagcaattgccgatgcgatgcttaatttgatttttttttttttggaaaaagtacaccgaaggtccctcaacttgtcgtcggataaaaaatatcactgaaccgcaaaaccagatatacgaggtcccttaattatacaaaaccggccaagagttccttcagtggttttgacaaccgttttagtctacgtggcggctgagtaagcgtgggacccacgcgggccccacatgtcagcgtaatccacgtcatcccctccctctttctcctcttctatctctcacacacactttctcctctctaggcagccggccggcgagtggggaaggaggttgccggggcgaggcgggagaagaagtccggcgatgcggcaacgacgacggaggtggggccaggagcgaaggcggcgagggggtcaccaccgccgccacccctggggcgcgcgcgaagccagcggcgagcaccgactcctcgtcaatgggccagaacacatcgagcgactcgcgcggcagttcgtcgccagtggtgctcactaccttagccgcgccgggaacgtgaagccgccggagctcacgacgcggcggccaacaatgtccagcgtcgggaaagcggcgaacagcgtcgcgccactgccgccgccgctgttcggcgccgccgcgaaggtactgttcgcgagaggaggaggacgaaacatgctgctccctggagatatcttcatcttgatgggctgtgtgtcattgacggcgccgcctcctccctctccccggcgtcggcgtcggcttggcggtggcggcgaggcgggaggaccgtgtcggcgtcagcgctgggagccggagcggcaggaggcagggacaggcgcgacggcggcggtgcgccaggaccaagcgccgctgctactgccgtgctccccccgtcctcctcgcgctcccccctggctaccgccgcagccgccctccccttcttcccccgggcgccggccgccgtcgcgccgcagccgccctccccttctccccccgggcgccggccgccgtcgcgccgctgccgccctccccttctcactgtggaggacgtggattacgcccgtggaggagaaagtgtgtgtgagagagagaagaggagaaagagggaggggatggcgtggattacgctgatatgtggggcccacgtgggtcccacgcttacttagccaccacgtagttcaaaaccgggttcaaaaactactgaaggaccttgggtgaccgggtttgtatagttaagggacctcacatatctggttttgcggttcgagaacattttttatccccatgacaagttgagggaccttccgtgtactttttccttttttttatttgtttccgattggattcggaggcccaattggattctgtactgtacagtacatggcccattgccaaacatgtaatgctggcccaattattcctgcacttgctgttccctcctttggcgcagtaaaagttagccaaagaaaagaagtgagtgtagctcaactggttagattgcttgtaatagcagttcacacaggtttaaattttatatttgatatgtgtgctcgtatttacagctaattattttttaagtggcaggtgacgtttccgttgatagcgaggcgtccgtgacaactctgtaaatctcaagatatattggtacagtctttcaaaaatgctcataaggataaggggtgtgcgatgcatgtgtgcatgtgttgtgggcactgtgtttgtaatgtgtttctataaaaaaaagttagcgaaagatttatttgcacctgtctgcttttgcctaattatgtcctaagaactttattgaataaatagttcaacgagatgaatatggaaaacttgcctatcttgaacaagacaacttaatcaaactgagcccactaacagaatcgattatccctaaaaaaaaagaagtaaagaagaatcgattagatacatcaacttgcagtttaaataacaaaatgagtaaattgcacctacgataaaaaaaatccctgaactgtattgtatcaattcatccagcaatcatttttttcttcttttcttttttctagatttgaggtatcaagcaagcaggggatctgctgttctgttagagattaacacaacggatcgaagcgtcgtaaaggttgaacaacgttggggagagagaaaatgaatgtttggaagaggcaaatatatacgaaccgatcaatgtgcacacagaaacactcacaaaaagcgaatagtgcatgttttgtatgagatgcgcaaacatgttggtaatcgagaggaatttgacataaaggcaaatataaatcttgctcatcttgatatgttggacaaaagctccctatgcttatttctgcacataacagtttttcaagtaaacttactgcggaaaaaatgcctccgtccctctcccctagccccgacactcacccgcggcggcgacgcccggcgccacgaagcttccacccagttgatccctcgctccacatttcttccccagtccttgaatgtttccccaccaaccaatcttctccagtcttcctcccttccattcaaagctccctctgtccacctgaggagggagaaatcttcgtagactcccccctagatccaggctgttctgaagctggagaagagatcccccatggatctaacctccatctgcccgtttctgcaacggatggggatcgaggtaaggagaccggatctatctcaaaatcaatttcaaatctgcattcatcccagcatatccccaagcagatctccaagcagatttcaaatccccccgccggcccaatgtcttctcggcctctttactccgccgtacttcgacaagatggacatccaccagtagctcggcgcctaccgattgcaaatcacctcaatccctcaattcttggccgcccaccgcctcctccgtcttcaagagtgttgagcagtgggaaagttgttgatttgacgagacgccattaccaccccccctctttcccgaagctgtgctacttccaagactgagaaagagcagccatggcaagaagttaagcaaaggttctagtggaggaaaggatcctcattcaattctcctaacaaccaagagatcatggctgcaagaaagatccgattcctcaagcacacagaaggtaaatgcttccgctgcctccaacccggtcataaagttgcagactgcagggatcctcttcgttgttggttttgcagaagatttggtcacctctcctcagcctgcagagaacgccgctataaattgcaacaacaagtgcagtttcatccgccatcctagcaaccatctccaccaccagcgccaccactgctttcctccacagtgttccctcctctcaacaaccatctgaacacttcctctgctcctcccaccatggcctcggtcccaagtgacttggcctctcgccctgacctgggtagctgcatggtggcggcgacaagtgaaatggaacgtctgaagcagctcttcacggcaagatcggtggtggcctggtctgatgaaggccagaaggtggagatcggcacatttgctgatgacatccgttcggccttccgtatccatcgctccgacattcagatcacgaagttctatccagaagacttcttcctcacttttgttaaccatagcgatcgtgaggaagtgctgcaagagccaaggctggtaactcgaagtgggagagtgtatcacttcaagccatggaatgaaaggcgcaatgctgaagtaattgatgttcgcttccatgcccgagtctgcattgaaggtatcccaatgcatgcaagatcagaagaagtggcgacaaagatcattggctgcaagagttcagtccactacatagaagagtactcccgtcgccggaactacaaccgtacctttgatctttggatttggagctcagacttgagcagctccatcctgaaggcttcaagtttctctatcacaaggccagacagtgaagcaagagccactgatgttccttttcctgagttggagccgccccggatgccgggcattcttccgcagttgtttctcctcttccccaacctctctcacctgatctgttgcccgtgtcacaggatcagagggctttgctcttgcttgaaagacacctggatcctatgttctatgaggccacgatgggaggttccatctactcccctgatacttccctgcctcgtactgcctctcctgtgtttgttctttcagctgctgcagactcacaggcgacaccagttgaggtgacccggcatgatgtggaggagttcctggcggaggtgaccacacccatccagcagccactccttcctgcgccaggaaccaagccacgccgcccatgctgcaacaaggtgattactccaatacaaaggcaacgtgaaagactggccgtgaaagccagacgcaatacaaagcttgatttaattgcgcaagaaatacttgcaaagaaatttggcgttcttgatgataataagcgtctagatgaccaaattaagaaactttacttgcagcactacaagaaactgctctccccagcagacatgaagacaatcacgacactggtggagaatggaggctgcaaaggcattcggctgcgtgccaagaaggcggcatcggtggtgccgatatgaagccccaaccgtgacagaagactgccggccaactgttgatgatgttaagtagatggcttttgatgtttgtaatgcaaatgtgcacctctttgtgtttctgccaagtttcttggctgtgtttcagagatggccatttgcatcacaagtcctcccctgcagatggagtctcccccagtagtaatgacttttattcatgtcgcagttgaactgtttcatcctcaattggaatgtcagaggcttgaacagccaagttagaaaaaaaagtgttaagctgttggtagagcagatgaatgctacaatagtttgtctccaagaaacaaagatgaatcaaatctctgatgtggatgttttgcatactctgggttctcgtttcaaaaacgaatttgcttttctccctgctgatggaaccagaggaggaatcctcctagcctgcaacgataactatttcagcctctctaatgttctccggaagcagtacagtctcacagccacagtgactatgaaaaatgatggcatcgcatggacgataactgtggtctatggacctcagcaagatgcccagaaaattgagttcatcactgagctacaggaaataaagcaactggttatgtcaccttggctgctaataggagatttcaatctaatctataaaacctcagacaagaacaacagcaggctaaatagaagtatgatgcagaggttcaaaggaactttagacagattggaggtaaaggaactgcctctttcaggaaggaaattcacttggacacaagagtgtgataacccaacccaatcaaaaattgaccgtgctttttgctgtcctgattgggatgttcttttcgactcagcacaaatgtatgccctctcttcttcctgttcagaccacgcccccttattcataacaggctgtgtggaaagagagcaaaataactccttccgtttcgagtccttttggctaaagttcccaaactttcttcagataacagaggagtcctggaacagacctttacagaccaccaatccttttgcacgaattaatttaaagctaagaaggcttgcaagagatctcagaagatggaaatcaaccaaaataggagacacgagattgcagctggcaattgcgaatgaagtaatctttcaattagatgttgctcaagaggatagagttttgtcggatgaagaacagtgttttcgaaaatttttgaaagtaagagtgcttggcctggcagctatggagaaaattcgcttaagacaaagagccaggatcacatggctaaaacatggggatgtcaattcaaagttcttccaaatcaaggcgaacggtagaaagagaaaaaaccacatcctgctcctccaaacaccgattggtattgctttcacaaaaaaccagaaagaagaagtgaagcgatacttcactcaaaacctaggttcttttggccctagaaatcaacgactaaactgggctgccctcaacataccttctttagatctctcagatcttgatgagcctttcactgaagaagaacttaaatatgtcatttctgatctaccctcggaaaaagcccctggcccggatggtttcattggggcttttttcaagctgggatataattaaaatagatatgctgcaggcagtaactttctttggagatttgggatactcaaggctacaggacctaaactcagcacatatttgtctcattcccaaaaagactgatgcttcgaaagtggaagattttcgaccgataagcctaattcatagctttgcaaagataattgccaaactgctagccaacaggcttgcacctaagctaggagatttggtctcccaaagtcaaagtgcgtttattaggaaaagagcaattcacgacaatgtcctgttcgtccaaaacatgatcaaagcatgccatagagcaaaaaagccaactcttttccttaaagttgacatttcgaaagcctttgacacagttaattggccatatctgctagaggtcctacaaaacttcggttttggtcagaaatggtgtaattggatttctaacttgttgggtacctcctcctcggcaattctcctgaatggcaccccagggcaggtaatagaacatgcaagagggctccgtcagggagaccccctctcccccatgctttttattcttgcaatggaacctctacataaattgtttctaaaggcagaagagtctggacttctgtcaagtctccaaagacaaagacgtttcagatgttctctttacgcggatgatgttgcccttttcataaagccaaatcgagacgagatgctagttcttcgtggtattctctctgtttttgcagaagccagtggtctttacacaaacatggaaaaaacagagatatacccgattagctgcaatgagatcaatcttgatgactgtctatccatcttcccaggcagagtttcaaacttcccatgtaaataccttggtctccctttgcacacaagaaaattaagaaaagtagaacttcagcctttggtggataaagtgggatcaaggatacctggttggcaaggtcgattcttcacttcggctggcagagaagtgttggtcaaaaatactttgtcctcaaccccaatttaccacttaacgattctacaacaaaataaatggccatacaagcgaattgacagatttagacgagcttttctttggaaaggaaaagaccctgaaaatgttagtgggggcagctgccttctcaactggtcctctgtttgcaaacccaaatctcttggaggacttggaaccctcaatttggagaaattcgcgcgggctctacgactccattggctttggtatgaatggaaagatgaacataagccatggattaacatggaaattccatgtgacgagatggatagaattctgttcagggcaagcacgcagatctctcttggaaatggaatgaaatgtaagttttggtcagacaactggctacagggaagggctcctaaagacttggcaccaaatattttcagattagcaaaaagaaaagcaaattgtgtagctctagagatgcaaaacaaccactggatcacttctttaaggatgatcacctcgattgaagagatcaatgaattagtcttcttgggaacccagctgcaagagatcaacctacactgtaactctctagataacataacctggaaatggactcaacatggagagtacacagcaaaaagcgcttatgaaattcagttccaaggctctgttgtaaacaaaaactttatgccactttggaaagctgaagctgaaccaaaacactgtttcttcggttggctgatcctacatcaaagaaccctcacagcggaaaaccttttattaaggcattggccatgtgattggatatgcagtctctgcacagaagcttttgaagatgcaaatcatttagcaaaggaatgcagtttcactatcttggtctggaaccaggtttgcttgtggctaaatttctcacaagttccaaatcaccttgtgcattagaacatctcagattggtgggaatctttagtagtttcatttcaaggaaacagaagaaagaagctaataggagcccttctaacaacctggtggcatgtgtggcttgaacgtaacagaagaatttttcagcaaaaacatcttagtgccacacaagtagcttttatggttaaagaaaatatagatcttatgcagatcttgcgccaaacctaaaggtttgtgccttgcgaaagttgtttcttctttgcctgtaatttttttttaaaaaaaaagtaccactgcttgtagtggtcacctttaagactttgtgtctgctcattcttctaatatatccggcagatctcatgccgtcatttgcttaaaaaaaaaagtaaacttactgctgtggtggcttctacagtgaactgcagataacaatttttgaaaatatatgcaacgtatagcagattactacaaactgtcaaccgcatgctttttcagagaagcatagaaagcaatacatcgtggcagagcttattctctacaataaatacaggggtgtatatattcagagtttcagacaataaaaacagacaacacttccgctagccacatgtatacgtacgggagtaataattcaaagaagatcccgagtttgaatttattctgccgaaattcgagctcctcaagctgtatcacttaagcaaaacttgcaaatccaaaaaaaaactattttttttaaaaaaaccctctgtagtggagattcaccatcaaaaaggcagacaattgatatagtcttctatgaatggtaaaaatcttggagggaagccaagtaaaattatcagaagaaagaagtttcaaccaaaaacaacctctcatcttacactacttgttggattagagtcgagatgatggcaatcagttccacaaacctctatgatctggctattaggtcaccagtgacgggctgtcactcacatttgacgaaagtaaccctctgccgggttctaattccgacccgtcacaggtgacggaatacttgtgacagactgcgaccagtgacctcatctgttacggcctcccgatggacccgtcaaaggtgaggccatccgtgacaagcacttcggcctgtcactggtgggttcttagaagtgagccgttttggcgtggtgtaggttttcacttgaagaagagagggccgcattaacgatgccctaagagggaagacgacactcactagtgtcgatgtcgccaccgccagaagactgggggtaaggctttcgcctcggtctctctcgacggttgattgcctccaaaaaacatgatgagggtgttgtgggttatcgctgcctagctcgccacccggcacaacagctctgactctgtcacaaaacaagacgaccccatactataggagcaaacaacactactactccacccacggcgaaccacactacttgaggggttattgttcccaagattgtcacccagtcaagcagttctaactcctcagctcacgaaagctcagtcatgaggtggaaccaacaaaaaccaccaccaccgtgaacacagggcacctgattgtggtcggccttgagaaagcaccaacgacgctgaaggctgctcaaccttcactgagtaaacacccagcttggccaaaagcgacacctccttaccattgggcttcccgcgatcgggatctgagagcagaccagtacaaagaaggggggattcagctcatctgacttcacccctcacgatggcagagatcagtcgaggtcatccagccgtccacattcgatcgaaccgtccgcccagggaactgcatgatatacacgagcagacgcgtcgtgaatctggccaaggctggcccaacaagttgtttcccagcgccgtccgtcactcctaccctttttacagtgaacagatgcgttttggtggccgcgctctcctttttggcgccaaacgaggccacggcgccggacgatcgtctgacaacgcactgcgatggcaaaccacggattccaccgttgatcaagcataggtgaagtaaggacctaatctgagtttttacacgcttgatgaactgcttgatcttttaggcaaggtgagcatttatgcatccattggttgtacctcccttgtttgttactgcacatgtgcagatgctcccattcaccactgccaacaggtgctgaacgcaggggatgacatgattggtgttgagcacttggaagaggattctgatggcatggctcttcttaaagcacggagctctgccggatcaatgatcgtcttcagcctttttttttaacttaatgcacacgcatgtggttagtgtgtacagtttaatatgtcatatacacttggtagtggatagcagagagcaagcatgttgggtggagattgatgtagaggagaagggccgctgtcgccaccgctacctcttccttcacgccggtcttctctgccgtcgccactggatttgggctattgtgtgtggctgccgcggtcctcctccacctccgcctccgctgggagagaggggggtcggaggaggagggaagcggccggaggggagggcaacggtggaggaggcgatgccgcaaccgctccatcgatgccggtaaccacctcacagcagactaacagagatgaggaggagggggagaagaatggggggaggcggatctagaggaggagggggagaataatggaggaggaggacaaggagtgtagtaccgagagagaggatgtcggatggataaggagtggagtatgggcgctggtttgatcggtttgcctcagctcgagtgctggttttcctacaataaactatagtgccgatttatatgcagatccggcacctataatataagtataggtccctttttttaaaaaaaactagcacctatactataggtgccggtttttatggtaataggtatccattttaaataaaccgacacctatgagccaatacctattaggtgttttgtagtaatggtcacactcacatatgtccaggatacctgatggtagtccgaggaattaggtgcccacactactacaaaataccagggaggcggcactattgactccaagtgattggtgctggtttcaaaatcagcacctttgaggtgttcgcgagccaaaaaaaaaaggctcgatacatcggctcgaatcgagctggtgcatcgagcgcatccaccccctgcgttgcccccaaaatctcaaatccacagcatcaacgaatcaaccaatatcatcacaatgaaccaaccaacatcatcacagaaattatagactataaactcccgaatcaaccaacatcaataacagacatcacacgacaaacattgaaagaacaatgaactccaccgctgctcaccatcgccatctaccagacccgccaccgctgccaccattgccccgaggatactccgccgccgggctaccaccgcctcccctcccacagtcggaccaccgggaagtaggggctgtcgcatccgggaagtaggggtctctgcctccatgccgtccacggccaccgcgcctcccctcccgccagatctggcggaggggagggcgtcgctgcccctcccacccctgccgagccggtgccgccgccgtcgctgccctttctcccgccgtacgccactattccagccgctgcgagcgagatagagaggggagagagagcgaataaaatgagaggggagagagagcggagagaacgagagagatcgagaggatacgagagagttcgaatgaccttatctcctcgatgctagtggtggggcctgttggctcggctcaattcgtaggtgccgtacctatctatctatctatctatctatctatccctctatacctctatacctatactaattgggcactttctacgagcttccacgttaaccggagaaatctaaccgttgatttaatcagttttattatcatggccgtacatacaaaatctaacgtggcgggctaatttgccttctaatttcatgggctctttcagcccatctattttttctctacaacagatcagcagtaatcgagagagatacagatcgacctcatctctctgatagaaattaacgatagagaggtgggagagaggactagcaaccacgggatgatacccaatgtgattggtgatgatttgcaatctcaaatcctctctaactcgggtactattttacctcaaccttgaacagattgatttttcattgatttggattgacactcatctgaaacgtcatcatccaacccaataaatttcaggagtccagatgccgatccaaaaaatcgagtacatatgccaccgttccccaattcacacaggtaatgtcgaacttgcatcttctatgcgatctcctcagccatctatttaaaactttcttgattttttatttgtttggacttttgagtgatgaattactggccgatagtttccctatttaatgagttgttcggtgttcgatgaacgtacatgttgcaacctatttaagaaattagcgatgactaattttgactgaaataatgaaatagctgttgatgagctgtgctaatgatccggtaatcagatcagtcgacagatcatagacccttatctatgacttttctctaaatctaaatacaaactagcaaatataatatttataattttccaatttactgtatgtatgtccgtatgcactacatatagtctgcagcttaccttttcttttaccaatgacatggttcaagctgttgacaatgcgaaggaagcatccaaagtcaaggtcaggataatcagactttgggatggcctaaatcccaacagacatgatagttattaataaaggtcggaataaatattcccctcgcaaataatattggtatttatgggtattcccagagagctctcacatttactataaacgttaactaaaagatctgtagttcattaggtcgatcgtattaccatgacttgatcaatcaagaatttgtgttaaaaccaatattagttgcgcacttcagggacgctcgcacattaggaagaaagatcttaacacccactagaacggataccctcatctcaatcaggcggtaagccccatctcaatcgggcacagcgtccgtcacaggctagaagtcactgatgtgaagagttatctcaatcgggcaaacggccgtcacgaatgaatatatctcaatcgggccctaagtaaagcccgtcaccgatagctttgatccagacgaccagtcaaactatagcccgtcacagatgacctatctctatcgggccacaactagcgcccgtcacagatgactactaacctttattgggcctaaactagagcccgtcacagatgattctcatctcaatcgggcctaaactatagcccgtcaaagatgactgatgacctcaatcagacctaaactagagcccgtcacagatgactgctgacctcaatcgggcctaagctaaagcccgtcacagatgatctcatctcaatcgggcatttagttatggctcgtcacagatgactataatccacaaaaaaaataaaatttgttttttggctagcctcaggcctttgctagccatgcccgctgcaaaaatgacagaaacaaacacagatatccaatatccccagctccccagcatcacccattcatacatatgcattcacatacacagacatcaacatatttcacacaaccacacattcacagccatatcatatttcacatccattcacatatttcacatccattcaaatatttatcatatttcacctgcaaaaccgagttaattggatcaaatatttatttagcaagtcttaacataaacatatgaaatatatacataaatataagcatcacagttacatcaccacagttgcataataagtgttcatcattgcctaaacatagaagttcaacattgttcatcgttttagtttaagcctaaacattcctttggggttaattatttcgcggaggatgaagctggctatctcctcgcgaacctcctcaaagctggtagtcagagacttggttattgtgccctacatagtcataattccagattagttgatcgatcatatataagtactaaaatgtagttagtctatcacaattgagaccaccgacctcaaactcagccaaagtcttcaccttttctctatacagaagtcgcatgttgtggcacacatggaatccgcactggtcacctatttgttgcttcaccgggaagtcttttttgtggatgagggtgtcatgtcctgtcttcctgaggcctcctctttgcacgtattgggcccacgcttcatctatcgctagttgaattggggtccattcatatgcgttcttatcaattctggagttcaggtaatgacatgtactccatttaggtgttatgaccagaaggatccaatgggcactgcggcattaatatagtgaaagttaattaagtactcaaggaatgtgtcatgctgttgtgtatatttagttaacacacttactattgattataggcacacataatgtactccttgtctcggcgggaccacaaggtgtcgtagatgtagttgaccattccttgacggtcattctggagatttgtgacagtgaccacttgtggatcaaggaaggcaacttccggtgcatgcttctgacaccattgccaacttaacctacacacaggatcaacgatcttgtaagcaagttaaaccgattgttattaacagaatgagttgggcgacaatacttacaaggagtagcacttaaggaggcttgtgtccaccactcggagcctgtagaggtcgaaaagatcgttgaagtcgaccacgatataatttgttggatcaaggaatggctttccatcgtgctgtccaaggatatcggtagctttacttggcttcctggcgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagctttcttggagctagaagcgaggcctgcacctttcctccccttcctctcccctttgcttcgggtttatcgagagtaattctctgaggggaggagtgtgccttcctgctcttcttcatcggtgggggttcatgaatcgccttgctgtcggcctccgttcggtcctccccaaaatccgtgtcatactgcaactgcaaatcgtaagattgtgcatgacgatcttgagcaggaggggctgaaggagcagaggcgggtctctttggtggacgaccgcctggtgcagtggttggcctcgctgtaaccctgatctcaatgaggtccttgggccattggatgaaggtaccacgggcatttcctagtgagaggacctcgtcgttcgatggatacttcagagggaacagcttgtatccgggcttcaccgagtcgacttgaacttttgcacagtcggccctgagttgcgctccatgcactcttgtctctggggtcggcttgtacgcaagtccctcggctgctagaacagtgaaggtcggcattaccctaactgtgagggtgcagctcgttggttcctgcgatagattaatcaatttttttagaatattatatatcatatggattcgttacgtctttcatgtattgagtaagttcacggttaccgttatgtggtcgacggcgctgtcgaccaatgttggattttccgccaactcagttgatgcgcaactgctacgtttttcggtgggacttcctaactctttgtgcgcagcagcagcggcggcctgggggatctgttgctcttctcggatctcttgcctaatcttggccctcatcgactcgagcttttcgtcgaattcagatgtcagctcagctcgtatcgactcccggatcttggcttcaaggcgtgcatctttctccgccttgttggaagtccgcttcttgtactgccacgcgtagtctggaaatccataattccagggaacagaagacccaacgccccgtgtccgtccacggtgttccttgttgcccaacgctttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgattagacacttactatagcttcgtatactcgttgatcttctgcatttggcatgaagattgtgccatcatcatgtttctggtacctagccctggcccagttcctagcccgagggtgtgggatatcgccaaacacgagcggtgtgcacgattcctccgcttcttcatcctcacgctgccattcctcttccttaccggcatatccggcggtaccaagccggtgcggatgctggttcctggtctggagcaagcgatatgcctcgcttctagctctggactcgggggtcgacttcttcgcatggaattctgactagacctgttccgtgatccaaggaaatttttctcttggatctggatttgccgggttgtagacgaactcgccgactagcttagtcttgaagttcttccaagcagtgcccataaccttgaaagcagcccgcctgagacggtcctcatgctctgcaggataatcaaagctctccttgaacgttagccaagcaatgtccttctctgtggccggcatgagcttgaagtcgtcttgcagaatactgaatttctgcctccctatgaccccgcagatagacctaaattggctcaatattttccttggagatgtcggcaaccctacggcgtccaccgctgttatgcggaaccgttccttaggaattttgttccttgtcctaggagtacgttcccttgaggacccactagttgtcgttgacattggttcgccttgctaagacattgtctacttttttccaaaaaaacaaaaaaaacacaattgagtgctacaatctattacaatgaattgaatgtcacttataaaaataaatgaaacatataaataaactaaattgcgcatatcacaatgatagaatgaattgaatggcacatataaataaattaaacatatcatcaaatcctaaaatcataaattcacctcataccatctattcatccacatatcatgcatctatcactaaattgattaatgcaccacattccatctattcatcatcatgtcatcaatcaaaaaaatcattcgtttaccatatatcatcaatccctaaaatcatctatcagtaaaatcatctatcactaaattcattaatgaaccacattccatctattcatcatcatgtcatcaatcactaaaatcattcgttcaccacatatcatcaatccctaaaatcatctatcactaaaatcatctatcactaaattcattaatgcaccacattccatctattcatcatcaagtcatcaatcactaaaatcatctatcactaaattcatcccaacatccacatttcatcccaacatccacattttcattatcaaccacatgcaagtagcagagggaggcgcgttggaggactcacatgaggtcggtcgggggggctcggtggtggcggcggcgggctcggtggagggcgtcgccggtcggtggaggcggcggctggctcggtgcaggcggcgggctcggcgaaggaggagttcacggcggcggcgccggtcggtgtagatgccggtcggggaggtcggcatcgggccgacgtcgccggcctcggtgggggctgctgttcgtgtcggtgaagaggcaggcggcgacgacgaggaaggccgacgccggtcggtgtagagactcggtggcggcggcggcgggctcggtggaggcggcgggctcggtggcggtggcggcgggctcggtggaggcggcgggctcggtggcggtggcggcgggctcagtggaggcggcgggctcggcggcggtggtggcggtctcggtggcggtggcggcgagggaggacgacggcggcgaaggaggagttggcggcggcgctagggttctaaggaggcgggaaactgtagcgggacttagaaaaattttcgattcgatctgagaaaccctagttatattagagtgatgagtcatctcaatcgggctttgccgtagagcccgtcacagatgactcatcggtgacgggctccatactaatgcccgattgagatgacattcaggcccgtcacggatgactcatctgtgacgggccctaagataatgcccgatagagatagattaatctctatcgggcttgaactaaggcctgtcaccgatgactatttttccatttcccagataagtctttatatttgtgagtacaaaatatatagctactgtataataattcattttattagtcataacacatttttggatagtaaatgatttcaaatcgaaatatggtcaacaacaaaattgatcttctcatcaagatctacaacttttattttggtcatttatctatataactttgtttctaacaacttgaaattgattttgacaatatgacaaatgtaaacaacatttgtaaatattacatgactttaaatgggaaagccataaacagctaacttgtacagctaatcaagatctacaacttttattttggtcacttcttcatccgacaaagtgatagtaccaatgtttacaaaattgacatatctgtgttgatatttataaaccagatgagagaaatgtgatttttgtgaataatataactatcactttgtcggatgaagaagtaaccaaaataaaagttgtagattttgatgagaggatcaactttgttgttgaccatatttccatttgaaatcatttagtatttactcatgtcaccgaaaggattcatgccatccgtacaaagacatatcctcacgtttctagggtcggcagcaaagtctttgtgttttcgatctatattcctccattcaatcgaatccgctgggtgtctaagcataccatcattccttctttccatggcgtgccaacgtactaacttcgcttcgttcgggttggcaaagattctcttgaaacgatcaatgataggtagataccacacaacctttgccggaccacccctctttgacttatttcctttgtgagcacttttctttcgcttgtatcgagaagcattgcagacaggacaagcatccaagtccgcatattgcttgtggtacaatatgcatatgcagttgttgggacaagcgtgaattctacggacctctaaccccagtggacacagaacctgctttgctccgtatgtcatctcgggcaatgtgttctcaacaggaagcatagccttcaaaattcctaaaagatctgtgaaactcttgtctgtccatccactacttgccttaagcttcattaggtccaaggtaactgacaacttagtgtgttttgctttgcatccagcgtacaaaggcgtctcggaatcacttaccaacctgctgaatttcattccatctctctcattctgggctgggtcctcaacgtcacgtaacatgtcttgcagcagatcgtgatccacatcaaccatttcaccgcccaatggagaaggtataaacatgtcatgctcattttcatcttcctgattatgcgcaccacttctgtttgctgctgctccacttcctgattcttgctctccatgcttcacccaacatgtatagccctccatgaatcctcgttgtatcagatgaccgtgtacgtcctctccgctatcaaacatattctcgttcttgcaatctgcacatggacaacacatgtaatcactgtttcttcttatccgatcctcctccgcggcgttcataaaatttattacgccctttcggtactccgtagaatgacgtttcaaatttttggcatacatccaacttcgatcaattgctacaaaaaaaacaaattagaggcacatattataagatcagtattgcaaaagtaagacatgatgaaattgctcaattaatgatttatattactgacttgattgatccattttgatcacttttgggaatttaatttctgttttccttggaaaaaggacaaaaaatcgccccctacagcctcccaccaaaatagtgaacagtgggatatagttacactaggtggtgggggtatttatactgtgcaacaaatatttgtaacggccctaaaacaatcaaccgtgacgggcatacaagtaatctctatcgggccttaataaaaggccgtcaaaaaatagtgtcatctgtgacgggcaataaacttatctcaatcgggcctctagttggagcccgtcacagatgaccctcatctgtgacgggcttcttttagggcccgattgagatatggaaccctcatctcaatcgggcctcaactatagcccgtcacatataagtgtcatccgtgacgggctttagttttatgccgatataccatggctgtgcgaccatatctcaattgggcaaaacttcggcccgattgagattacttccttgtgacggcccgcaaattccagtcttgttatgggccgtcacagatggaaggatatgtactagtgaccattgattaggtggtttacattgctatgatattcgatctatatgaattcgtgtagattaaaatatggcccggaaagtaacatggactctttagttttattttttttaaaattaataattctgaaatcagacatcataaaagacagggtttgctctcaatttagaaatttgttaatttaattgcattttttaaattcataattagcaagttgtaacttatgtgaactccaaaccatgtacaactaaaatgtattatttactatttttagaattattaaatcataaaagttataattgatacttcaaaaatgtattatttctaaatttacaaatgattaaatcacgaacaatctataaccgtgggtctggacagagtacaattttatatattatttaagaaattattaaatcatattttttttagagttgaaaatataaatcatgtactttacaagactccaacttgaaaacgtgtaacattcagcaaaatctgatgaccaacatattcataacttgattatatttttaatatttatattattaataactatagcccgtgcatcgcacgggttagcgtctagtacctataataaataggtgcaagtttttaatattaaaggtttcgttttaaataaaaacaacacaaaatacaatggatgtcggtttttatttagaatcgacacatataattacttcaaggtgccaattttttacgatttcaacccgcggaggtgggaaaaggcctataggtgccagttttagcacttatgacacctatttgatgttttgtagtagtgccatatgaggcgaggggaatggggcacatgtggatgacaaaaaagtacactaaccctaagcagtggcagttttcgcaatgtatcagttatccgttttttatcttgtccgtctccatgaaattagcactataatcagttgatgggtcaataggttggaaaacatagctgtttagcttataattgcaggtgcaaaacttgaaaatatattcctattattgactgtgtacataggagaccggaaagtacaaggtttacttggactgctatttgtatagcaagataattgttgtacatagtactcttattttactataaaatatcactatgtgttaccaaatcaactggtgcttcggcgcttccttgtagttgttgtagatccattcttgtcatgaaataaagctgtagcagaagatacatacttagtataaggtgatattcgtgattcccacgttgctatttcaaaatcaccacctgaaattgccaccgatctagctattacctctttgaacgatatacttggtttcttatagtttggaatatcatccctttctactcgaggtggctttacaagaatgcaggcgtgagtaggataagatgtcataaattcggtgctatctactggctgctctttctcaatgatatctttcggatgctcaccatatttcaaaaagttgttcttcaccatcctctcgaagcgtcgcaatattctaagccagaagtgaacattatggttccttctaagcatgtcagatatcatattggctgttatcaatgatccacccaatactactgcaagatcatttgcaactgagaccatctttggatggtccttttggtcggtcgctagcatcttgaaaaggtagctgtactcctcctgtgataaactatttagatgaactgcctttgctgttccgaaccttgcaagattttcaatcctacttatgattaccactttgcttcctccagctgtcatctgacttacagtagaatagaagtttacccaatcattttcatctatgtccgtaaaatattcacgaacaatcaatgtcctctccattttgaactttgcatgtgctattgatccgcagctgctatctccattgatgtacaaaatagaagaaaagtatgatctgatccgctcatcattgcagacatggctgatcaaggatttctttcctaccctgcaaccaccaatgattggaagaacaagacgagcaccctggttacctggattttgcaataaaaaattgataatttcctgcttctcgacatgatgagcaaacacacaattatcggtgtaaaggtaagcatcatagggtcggcgacacatgcattcacatctggctaggaatacaacaaactctttcactctacctccatctgaagtatttatgtgttttttgtgcagctctctaaaaagcttgcttcccatctcagaacagccacccttatatataattagctggaaatggttcagagcaaaaccagcagccattttatccacagctgttttcaagggatgagaaaagtgactgcaatttgccaagtttaaagttctctattcaatactattggtcgttgattgctttgaatatctgttccttaattttttaccatcacacactttcttgtatgaaatattaattaactggactatttgaagaaactagtatttttcttgctaacgtacatggctaggtgtgaaaatttctaaagactatgagggaccatttggaccatttatgaaaggaaagcaacaagttgattatgggaagctagaattcgtccacttgataaaccccgagctccacttgaaaatattttaccaaagtgtatgggatgtcatggtatagattgaaccgagaggagaggaagggagtcggactcggtggagatgatagcacgaggtggacactcggccttagtttggaaaggtcccccgtgaaaactagaaacaaatctgcccttcctttttttttctcttcttcctatccgaaacaaacccacggaaatgaaaggtagataagttggagtcccgaagacaagcacttaggtggtctagctgacacgcgtaactatacgataaagtagcaatggctaatgtttaatctaagcaaacccaataaaccctgaaggggtaccaagctatttaaggaggtgggtagatgactaaggggtccctagggtcctgctccacctagttggggcacgccctgcatggccccacttaggccgagatcccagatgaatttacgagttcataggctaaatataggtgacacaacaccttgtttctattattccagcctatgtagttggaatttggagctgagcttggatccgtttgaaagaggactgcaaaagctttccatcaagtactcacggacaaaaaacggagcacgtatgcatatttggtggccgtttgaaatcagcactttagcatgtggccgaattggatttcagaacttggtcagattgatcttgatgcaagcaaaggttatattaaaagtcaccatggtcacatcatcgtatgaaatattaattaaattgactatttgaagaaacgagtactttcttgctaacgcacatggctaggtgtgaaagtttctaaaaactatgagggaccatttatcaaaggaaagcaacaagttgattatgggaagctagaactcgtccacttgataaactttgagctgcactcaagaaatttttaccaaagcttatgagatttcatggtatagattgaaccgacaggagaggaatggagtcggacttggtcgagatgatagcacgaggtggacacttggccttagtttgggaaggtgccacgtcaaaactaaaaacaaacccgcgattggagaactgatctttcactagtggagagttgccctttttttttatttgcatggccctgttgctgcatggtttatatatatatatatatatatatgcaccatggtgcccgggcaccatggcatcaaatacacaaattcaatcaaaattttcaaattgtgagtatatacctagttataagtattcgattcatacctacacctcttaacaaaacaactcaaaatttaactttatttcacaatccaatattacatacctaactaattatatgtttggatgccatatacctagaattaatcaaaatctaacaaaaacatgtttaaactaagttcaaacttgttttgaactagttagaaaagtagttaatgttaatacctaaatatttaaaaaaatttcatactcatttgaattgagtatatactcaatttgaaccatggagctcgggcaccatggagcaccaaacaaatatatatatatatatatatatatatatatatatatatatatatatatatatatatatatatatatatatatatatatatacatatatatatatatatatatatatatatgagttggattttttgcacgcgagttcacatgtacccacaatctacaccctatatgtagcttgcacgaatcttagggcaaatatattaggtgctaacaaaatgtaacatgcatgatgtttacgttatactatattttttacaagtgtaaaatacgttgtttatgtaatttttgtatttcttgtatgcaaaacttgtttatgtaatttaccttgtttatataaattaccatgtttatgtagtttttgatggtaggatatatatcattttgtaagtatcatttttgcaagatgacaatttggtgatatagtagatatattgttttctcattttcactaaatatcatgttataaacaaaataagggttagagaaatacaatgcactagatatataaatgtcatacatatgattattattgaaaaaaattatttggtaaaaaatacaacatacatgttatacatattgtgaaccaacctaatcctaatcttttctccctatagtaatcattcatttggttaaggttaggtacattttgcagcacgaatcttggaacacatcaacggtgtagattgtaggtacatgtgaacccgagtgcaaatatgcattttcctatatatatatatatatatatatatatatagggatgcgctaaaccgcgcctggggtgcgcaataactaaactactcctctcacagcactcctccccacccaccaccccccctggtgcccaggaggctctcccgcacctttttctctccctcaccatttgtccttcagtaaataaattacttgcagttaatatcttcttattagtaaatgaattactaactaatatattgatttttgcattgtaatcccgcaccttttggcatgtccattccaactgcaacccgcacatttctcttgcacacgtagtaaataaattactctctgttaatatcatttattagtaaataaattactcggaatccaactcatttcttctctcagtaaatggattactcccaggttgtagcccttctcagttggttcattctctcagtaaatgaattactgtcgggttggtcttatttattctcttagtaaataaattacttaagataatacaacacttaattggatatcataccttctcgcagtaaataaattacttaaaataacgtattgatatcgtctcaagattttcttagtaaataaattactattacaccaatctcaacataacatattgacattgccaacaaattctcttagtaaccaagttactattacaccgatggttctcaacatatgtctctcagtaactaaattactattacatgcacgaatccaacaagcaagacaacgctagtgcctcatatcgatgttgagccgacaaagcactatagattccttaggtctccccatcgataggtatccatcacccacgaacatctagagaggcatcccacatgcacctggatatagacagaaacgattacatcatctaagagaagtctttaatttacactcataaatgactctaaatgagatatgattcgctgaagaagaaataaaatgcttcataaaaaattgagcagcaggaagagagaatatgtgcaaaatgcagcctccatctgaagaacataaatcgagtagaataaattttagaactgatgagtctatactgctttatttacaggaatacactccattagactgatcatagatttcagatgttcacatgcatgttaaattaagaaccaaaattctaattgacacattatcagttcgccaagataaatccagaaaaagtgtgcaaagtgtacgacatgaaacatttagagcgtccaagtcaaatgaaccaaggatcctatatcttcagagatcacccggatatcattgaggtcaagagaaaagttcaatttggcagtcagtaaagatctgtttctagggaacatattattatgcataaaaatgatactaatcaaatagactcgtcctaaatttttcacgataccaatgcccaaataagctaaaatgatatggaaattattcatggatgaaaactcccttggtgtccttgatccgcacctgcggaactagtgaaggacatgccatgtgcacatgagcaattagaacaacaatctcaatcctctgaatatgaaaaaaaaaagcatacttaggcaacaaaaattattgtgtgcccagtagcaaaacacctgcaccaagaacagggatttgtgccaatagactgaacaataaaggtctcaatgtacatcgttgtcagtataatcctcatctgcattgatgctgcatccggattctcactctgcccctgcgaaaaaaagacatatcttgtcttttcatgtctagttataaacactaaactaaaacctgggaaaattgcaaccataaagcatagaagattgaatcgagaagaaaaaccaccatgaatctgaacaacgtggggaaaaaaggcctgatcaccgatcatgcaaacatgaaaaaacaaaaacgaaaaaaagagaaagggaatagatcagattggcatggcagcaccaaagacactattcctttcatgggggatgcagacttcaatcacgcagacgagttcggggttgttgatggtgtcgcttgtgaaggaacgcagatggcgccggccctcctcctcctttgcccgcaccaacaacttatgcaaatccaatccaaatgttgctactacacctcctcagcgtcctccacgggcggcggacgagggcagcgggcgtgggcgatggtggcgatctggaggccgcctgcggacaaaggcggaacggcggccgccgacgaggacgaaggatgttggctcctccgtatagctcgccaacgtggagcagatcggcagcggtggaagggaagccggtggagaccatgggcggaagaaaggcaggcgcccttcgtcgtggagcttgcctccagatccaggcggcgtgatggcctctccccggtgctgccttttctcgaatcgccgccggcaacctcctcgttctagatctgaaaaaagcaaaagaaattaacaaaaaaaaatgagtgtattaaatcctatatatataggaggaagtttagtagtaaaagaattactactgtatgggaaaggggaggaggtcgggggtacaggggaggggtggggtgggtaggggtgggttgtgccatctgtagtatagtatgtctatatatatatatatacacatatatatacatacatatatatatacacatatatatatatatatataggttcctactaccaggagtagttactccctccttttaacgggtcaggttagtggaaccatcttgatccaataaccggtagttaggttgtttttttaatttaaacaattaactaaattgtttattagttgaaattatttcttttttgttagttgcatgcaaacgaacttctgcattggaatttctgctacgtgctggtcaacagaagatacatgttagctagctaaactgaatttctgctcgtttggtgcatgcatatatttcccatgtatttaggaacgttaacgtgatgaaaaggcagaaaatatgtgaacgttgacacatttaaaatgcacggtctgtgaaacagaaaaggaacagagcattagttgagaaggaagcagaacattgtttggaaatgcggcagaacatcacttggaaaaaaaaatcccaaaccgaaaatggagcagaatatcgtttggaaatggagcagaacatcgtttggaaaaaaaaatacattctactcttcctagacaaactccatcttctgctcgtcccggcagaaaatgtatctaaactgaaaatggcagaacatcaaatgaaaaaaaaaatccaaggaggaaaataaacctcaactaaaatttggcagaacgtcaactggaaaaattccccaaatatcaagggcagaacctccctgggtaatacgtgattagttacaaacaacaattgcggcatgtgctccgtgatggccgagtccatctgaacttgtaaataggcaatatagttttattagctagtaggaaggacgaaagcttaacaaaaaaaaaaaaggtgcagaatatgttctgctggtgtaactgaatcccatcctcttataggaagctctatggcaagaatacaggcagaaagtttctgcttgggtaactgaatcccgttctcttataggaagctccctggcaagaatacaggcagaaagtttctgctcgggtagaaacaggaacgggaaaggaagcagtatgtgagtatgtgactcagaaaaggagcagaacatcggttagaaaggaagcagaaaaataatttgaacagaagcacaacatcttctgctccttcaacaaaatcgtcactaagcagatgacgttaaaaaaggcagaaaattaaaaaggaatagaagaacatcaattggaaagaagcagaacattatttgtaaacggaacagaacatcaattagaaaggagcagaacattatttggaaacggaacagaacatcaatttgaaagggagcaaaatggtttctgccaatcatagtgtccatgttctgctcctccggcagatgaactaacatgcattcgaaactgtttgtatcccacgaaaatagcggtcggcattctaaacgggttggataacatggctaattaactccgaaatagcagaaatttgcactgccacgtagcaaaccgtacggtggataagctggaagtagttactcccagtagtagcttataatattcatatatatatatatatatatatatatatataggcaacatatcctatgcacacaggccctcacgtgtacacacgtgcacaccaactaaaaaatgtcaccaaaaaatttagaaaaaatcatacacatactttcaattgtattacacctagggttaaaatcttaacatcaaattcattatattttagccgtaacaaaaaaaaaacaaaaaatctgacaattttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacacggtgtgtacacgcgagggcctgtgtgtataggatacgctcccatatatatatatatatatatatatatatatatatatatatatatataaaccatgcatatatatgttccaatacatatacatgcataatatatatgtatttatacatatatgtatgcaaatgcatatgtatatatatattaaagcacttaacattttatgtgcatatatatgaccaaaacatatatttacactaaagtaaatgtgtacatatagaaaaatagacatgtattaattacaattcatcatgtcctagctagctacgacttcgacgtagtagtctttatctcagaagctaacgacctatgaattgtatttccgtcgtagtaaaattcatcctcaggatcaaggacttgttcgttgatgaatcccatgagttgttcttgaaccgccatgataaattccttgtgtgtgaggttatccctcatgcgaataacctatgaatgtatgaaattaattagtaaacaacaaatcgatacgtacgcaatgaaattttgaatttatttgtacgtacatcgagctctcttgtggtgatgatttggtctgcaaggcagtggcaatactcgcacacgtagtagccgcacaagttagttccctgttcttgctttgcgcactatatatacatgacaaacggcgagagatctaattaatatacacttgtatttgaattggagattcaatataaatgtagagcatgtgtactcataggaaatttaaacttccgcttaagtctttctctccaattgccgcggaccaaatgacggaactgataccaagccctaaatggagtttaaagctatgattcgtagtagtaattaattatatcaagattcgtaataacattggaacttatgacattacctgtctataagttaaaaaacctggtcaaacgtagactcttttttatccattgagtcatatacattgactacgcaggcctccaagtcgaagagtaaaaagacccagtggaatctgcaatgtgcgtcggatgtgacatatgaaacacttagcatgtacgtacgggaatgaaatttggtagcaagctggtcagaaagttcattaatcgcaaggacaaaaagataaggcaataaaggacaaccttgacgaatacctccctcgatgagctgaaaagtacccgtacgattgaccatttataacaacagaaaaattagcggagttgatgcaggaaaggacaagacgaacgaaattagcatgaaaccctttacgacaaagagcatccgctatgaatctccattcaatcctgtcaaaagctttagacaagtctatttttaaaagaaaagctttttgattaaaagaggtgagattaaaagagtgagcaatttcctgggcaagcacaatattattagagatgcgtctccccttgacaaaagcctgctgagtgtcacaaataaggttaggaagtttattctgaatgtaattagccaaggacttagcaatgattttataagaaacattacaaaggctaatgggtctaaaatcagcaggggacttaggattagaatttttaggaacaagaacaatattagtagcattcatacctgattgaagcttacctgtttcatagaaggagcctaccatggtagtaacatcgtcttttatccaattccaggcagctctataaaatgcaacattgagaccatctggccctggggaggcatctctttacatttgcttcagaatttccaggatgtcattttcagaagggatttcagggggaggaaaaattacatcattgtcattttgatccttagaaggagtggcatcatctgtattggagctttgaaagagattttcaaagtaagaagtgaagacagttgctatctcatcaggatcattgattattgaattattatggataacactagagattctgttctttctccttctcttctgggttgctttttgaaagaaagaagtgtttctgtcacctttctggacccaatgcttcttacttctctgtttgtgataatcggccagcttctgcatggtaatatcatgctgttgcacaatccttttctcctcaaagtacaaatgttctctgtcgggggaactctgaattttcaacagatcttcttccaactgatccaattgctgctgaagaggtttcttctttttgctccaagaagttaaggatattgctaacaaaggttgttcttctctgaaaatgacagtttacagactgcagccaggctgaatgagcatgctgattaaaatctggttcaagcagccaccaattttcaaacatgaaagatcttttaggcctcctgttcttcggattgagaatggcaatgatgggagcatgatcaccatacaacatgggcaagtgataaacagtggtatttggataattaaaacaccattccacatttgcaagacatctgtccaacctttccaaaaccagatccttaccctgttgcttattggaccaagtgtaagctggaccattataacccatatccataagccccagattattgacatgatgcttaaaaatattaatacgattctgattaggaggggccaaaccatacttttcattagcatgcatgatctcattaaggtctcccatacaaaaggtcggtctgtgactactatgtacaacaaaagaggagatttcactccacatggcactagtggccctgtgactagggatcaccataaatacaaagaagattgaaaataggaccagagttcttatagactccataagctaaaatataattaacactagactgaactatagtaagatccatgtcttcatcccacatcagccacaaaccaccagaagcttgatcagcaggaaccacatgactattagctacatgaaaatgatggatcagatcagaagcagtaactttagagctttttgtttctgaaataaagattaccttagcattagtagagtatattaggcgttggaggtgttgcattttcctactgccgaggtgacccccccatacctcggcagttccagcttaaaagactcatggcgcccttgatgccttatgggctggcgccattgcccatccatcattctttccacttccatctccaccatttccagcactgggatcaacaagctgaatctctgaaacattgcattccctaggatctatagccagtatcagtctggagctagctccagcatcacttgcaccacccccttgagtatctccagcagcttgatcaacaaagatatcatgatgcgcctccaaagcactccaagtatgcttcctgctatgaatattgttaatgctttgaggggatcttggagcatctctttgaaagacatcagaatgagcagcagcaagaggtctccaagaagtggaggtcaccattcaaccaccataacctcctctctgatcccatcttgtaactctctgcccacctcttctacttggaaccctgattggtgctgaatgatggttagttggaggagctcttcttgattcaatccctccatgttcttcacctcccacaatcgagaaggaagaggcagctgaagtagttggggagcaatggcgtttggtagattcatgggctgcttcatgaaaccctctcttcttacttaaatgttgtgaggctgtctcataaatcttggtagctcttgtgcttcttctgtgttgcacttcgttggtgccaatagcagggtccatcagaggcatttttggatatggaggaatccaacaaaaattcaattgtggaaaaattcaggcaacatttttcttctcctcaattcaagaacattcaagaacagcagaagcagcaagagagaggaagtgggaccagccagtcattaatgcccaagctagattggaaaaaagcgagtgagaaagctttgactttagctggctgcagcactgttcaagggcccccaagtcaagctgttcacactaccacagcaagcaaacaatgtgagaaaaaagacaaagaacctaatatgcaaagtacaccagaagttggtaccgaagagatgttggtacatggaagtacagtgaaaaagaagctggtttctagtactatagaggatcatgtcagctgcaactcaaagaatgtcaatactgttggtaaggtgcatcagatggaaccaatccagtctgttcctttggttcaccgagtttcacctagtgcaagtgcccatcagaacagatttttgacttagtgatatatatgaatacaagtatgcatcatttgatccttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggcgcccttcttatgccttgcgtgacaggtggacttgccgagcatattcgcgcgaatttaataacggatttggtattgtaccggcgagaataaaaccctgttttagatccaccctaaaattttccaccctgtcacagaacatttgcattaaatattaaatattggctaaaaataactaattacacaaattgtgactaatttgcgagacgaatcttttaagcctaattgctctataatttgacaatgtggtgttgcaagtaaatatttgctaatgaaagattaattagg

SEQ ID NO: 23939 - DNA, 1146 bp, Oryza sativa
tattatgccgccgctgttgggcctttatacaatttcaccgccggcttgcttccgtcgccgccgactggtgcctccgcctacacggctggcctattatgccgccgctgttgggcgtctacgacttcaccgccggcctgcctccgtcgccgcgactggtgtcctcgcctatacggttggttggtcacaccaccgttcatgggcgtccacgtcttcgccgaccggctggccttcgccgccgccgactggtgtttctgcctacacggctagcctattatgccgctgctgttgggcgtctacgacttcaccgccggcctgcctccgtcgccgccgactggtgtcctcgcctatacggttggttggtcacaccaccgttcatgggcgtccacgtcttcgccgaccggctggccttcgccgccgccgactggtgtttttgcctatacggttggcagacttcgccgccgttaatgggcttcatcatctacaccactggcttggtgccactggcgccgactggtgtttttgtcaccatcgatggactgcttcgttcccacatcggctacttttgctgtcaccgagggaatattacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcagaataaatcaaaagcatagagatgagataaatttattttctgctcttaataattgcaaaagtacccgagtagtaaattctgattcgtgaaactttggtccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagagga

SEQ ID NO: 23940 - DNA, 1891 bp, Oryza sativa
ccgccgcccatcaccggcggtagcaagggcgccgtctctctcagggtacgtacgtatatacgtttgtgcgtgacagtctcgcttggagtcttggactgattgatctgatcaagttgattagtgtctcagctggatgactgggtgctgtgccgcatatacaagaagacgaacaaggccggtgcggggcagaggagcatggagtgcgaggactccgtggaggacgcggtggccgcgtacgcgccgtcgtcgcagcagcatgccacggctgctgctggcatggccggttcggacggcgccggaggagttgctgcagcgcacggcggcgactacagttcactgctccatcacgacagccacgaggacaccttcctcgtaaacggcctgctcaccgcggaggacgccgccggcctctcgaccggcgccagctctctcagccagctcgccgcggcggcgagggcggcggcgacaccgtgcgacgccaccaagcagcttcttgctccgtctccaaccccattcaactggttcgaggcattccttccacgggccaaggagtttcctagtgggctaagcaggagtagcagagacatcggcgacatgtcgctgtcatcgacggtggacaggagcctgtctgaggctggcgccgtggccattgacaccggcgacgccgccaatggcgcaaacactatgcctgcatttatcaatcctctcggcgtgcagggtgcaacctaccaacaacaccaagccatcatgggtgcctcgttgccatcggagtcagcagcagcagcagccgcctgcaatttccagcatccgttccaactctccagggtgaattgggattcctgaataaaaggtgccggcattatgcatacacatatatgcacatgcatacatgcatggcttttcaagtagtagcacaacattactagtaattaatcacactaatgtgtgtggcagtcgcattcagtgagcactgatcgagtagttgcatggacacaacactaatgcatgcactacatatatatggccgcattgctcatagggcaagtacctgtaccaactaggtaagtgacctacccagctaaaccatgttcagaataaggagaagaagccgcatgcaaacacgtaggtcatatggctttgccttcacatgcgtttgcatcatatatatcgcattcagaaagtagtgctgcagctaacacatagatatggtgttagcttcatgcgtttgtaccatattagcggatgcagaaagtagctagttgcactgttcatcattatcccatgagatatgaactttatatacctttggggccagcgctctacagactagtacagactacagagatcggcaaggctgcatgctggaaccagagacgctgacgccccactccaccaccgatcgatcgctggtatccgagggggaggttttgtccgtcccctcgtcccccgcactgttcgcgctcgctcgcccgctgctctgctcgtctcttccaccatcaaatgatcacatgctgtccatcaactcacccccgtcgtctcgtgtgcgtgcagctttcccccacggcctcctgctgctgccgacccgacccgacctagcgtccctcgccatcgcgcgatcgtgagaaaaatcgggtgttattgtgtagtagaaaaaaaaaccggtcccgtcctttgattccctctgcctgggcgccgcccgctacgggacgcgagagcagctaccagcaacccgacaaaccgcacaggcggcctccccctcccgcgcgcgccagcgtccaacgctaacggcgacccgcgctctctcacagtgtctctcccgctagcgttatcatcatcagctgcgggcttgctatgctatgcttgcttgttgcagtggttttgccacgcagaa

SEQ ID NO: 23941 - DNA, 702 bp, Oryza sativa
tcctagtatgtgtgtgaacaagattggttggctagcatcgtgtggttcatgtgtaactgttgacatcaaaatttaaaacctgacatcctgttgttatcgggtggagttatccatctacaactccaccaccatacatcatctttttcggttttcattgtaatagtatgtttatcaggttttatttgtttcgcagtaatggttaaattgtatttcaaataccatgtattatattccaaataaggcgtttttaatccggtgaccgggggcggacatcaggggaagaaattttcaaggaactagcttggaggtcattctttcaagatgtcaaacaaactcctcttgtgtgcagtaataatggagacagggtgcaactccgatacaccaccacatgcaagatacatgatcttatgcatgacattgctctatatgttatggggaaagaatgcgtaactattacggataggtcctatcgcaaagagttgttgtcaaatcgttcgacttaccacttgctcgtgtcaaggcatagaactggagatcatttcgatgattttctgaggaaacaatctacaactctccggacattattgtatccaacatggaatacttatggatcgatacatcatttatcgaagtgcatttctctacgtggactgcagctatatgaaatcaaagaacttccaattagaccgataaagttaaagc

SEQ ID NO: 23942 - DNA, 473 bp, Oryza sativa
atcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttgacaagatgttgatgaagatgacgatgtcggtgatccagtcaatagcgatgtagcagccgatgataacgatgagatcctctatcggcagttgcgtagtaggccaaccgtgaag

SEQ ID NO: 23943 - DNA, 413 bp, Oryza sativa
tgatgcctattagtagtgacagcgatgtagccagccgtgaagaagatagcatcagttggcgttataccaggccagccgtgcaggccgtgacaccagtcagcggctaatgtggcggccggtcggtgaagacgtagacgcccaacaacggcagcataataggccagccgtgcaggcggaaacaccagtcgacggcggttgaggcggccggtcggtgaagacgtagacgcccaacaatgacggcataataagtcagccgtgcaggcggaagcaccagtcggcggcggcgaaggcaagctggtcggtgaagacgtagacgcccaacagcggcggcataataggccagccgtgcaggcggaagcaccagtcggcggcgacggaggcaggccggtcggtgaagacgtggacgcccaaca

SEQ ID NO: 23944 - DNA, 988 bp, Oryza sativa
  unsure (1)..(988): unsure at all n locations
cggtgaatccgggcttgattggattgggtcggattcgatttttggatcacccccggagggcgggaggtaaaacccctcctcctcatttatggctttcctttcctttctccggtcgatccggccgaaatcggcgattgctcgccgcggaatcccgattgggtgtggggggatggcctgatctccttccgagaaccgggagctcggatgcgtcgagttggttttgtgctccttttgctttccctttttctggattcgggtttccatattggaaggtttcttgatctcgatttcgtggcgagagctggttgctgaatcttatatagctttccttcttcttcttctagcggttgctacagatgcgttgagctttggttaatctatccggcgagagataatgggcgagcttgctgatctcgttgtcgtgccgtcgcagccgccgctcgccggcggccggcgggacaggctggcggcgctgctggagctcgcggcggcggatgatgttgatgggctcaggggggcgctcgcggagggaggcgaggaggcggcggagttggctgatggggtcgggctgtggtatggtcggagcaaggcgtccgaggcgcgcacgccgctgatggtggcggcgacgtacggcatcgccggagtggtctcgctgctggtgggcctcggcggttgcgtcgacgtcaaccgtcgccctggagccgacngcgccccgcgctccactgcgccgcctccggtggctcgcgcaacgccgtcgctgttgtcaagctgcttttggccgctggcgccgatccggccacccccgattccgccggccgcttccgcgccggcgtcatcctagctcctccggcttcgccagatgcccttggcgatctcgaggtgctcctcgggcgccgccgagcactcgccgtggcgacctcggtggcttcaggttcgtcatcccctccgctctctccttaccagatgagggcaacaggtcgccctcgtc

SEQ ID NO: 23945 - DNA, 718 bp, Oryza sativa
caccttctccttcaaccttgtcttttgacttgggcttgggcttgacctcgggatctcttcatctccggagtgccacacttccgccatgtgtgcctccgccacatgagcacgctccggcttcttcttgcctcccttagccttagcttcatttgacttgggacaatcggcaatgaagtggccatattcgccacaattgaagcacgctctctttgattgcctctttcccttgtcatcatccttcctccctttgtcatagccactcttgcgaagaaagtgcttgaatctcttgacaataaaagccatttcttcatcttcactttcttcacaacttgactcttcttcttgttttgccttcaaagcaacttcttgattttttatcatggcggcattattcaccatttgtctcacttcacgagcttcctcttcttgcatctcatgagacacaattcttccaagaatgtcacttggggtgagtctcttgaagtgtttcctttcccgtatcattgataaaaaagagtgggatttcttggaccaaatgcacgcagaagtctcttgaccacaaagtgatttgtcatgtcctcactcccaagtcctttaatcttgttgacaagaatcatcatcctatcatacatttcttgtggtgtctccttgacatccatcacaaatcttccaagccttccttccaataattcaatcttggcctcacgaacggcgggtg

SEQ ID NO: 23946 - DNA, 1027 bp, Oryza sativa
attcatgtttgaactctgtaatctgaagttctgtaagtttacaatcgactgcagtttttccctttttggccaaaattgaatagtaatgaactgcgttgatcggtcttgtgtgaaatgagatgcattcattttcgcatcaaaccaggcagacagaaaaacatttacagaacctcatttgtactaggggaacacatccttgcacacaaatttcccctgtacactccgtgcagatcaactagcaagtatgtttccttgtactagatgcaaaatctgaaacgttaaattaccacatctcatgccaacagaataagtggtttgatagtgtcgatctagcttaagcgacacagaacctgtcatgctcatattcacattccactaacaagctggaaatcccatgaaaaatacaaagctggaaacccctaaataaataagctggaaagataatctaaataaacattactgtagcacatcgacacaaatgtatttgctgtgcccttgccaaacacacttaagaaactgatgaagtcaagctcatgtttcatttctgggggtgccagcctcttccgttgtggtgaatttggcccttcgatcgctgctctgaccgcttctgattgttcaagaccgtttattatataatttgctggtccaaacataagtagcacagtttagtttgcattgaaggtgaaggttttagtgcaaaataagatgcatatcatactaatgtatatggagtgctgacataacacaggacaaaagcaaataggatgttgcacgggctactaaagcttgcaatattaaggtgatgaacttaatgtctatagtttaaaatggtaaaggactgagtgcagatgattgagaccttgaatgagacaaacacaagcataagagataagctatgaaatcgtgacgctgatgacaagtccacagaaatgctcaaaactaagctaaataaattgaggtcccaattcatctcgctattttatcatctgctcccagttgttaccacagttcctagttttttgttgaa

SEQ ID NO: 23947 - DNA, 1234 bp, Oryza sativa
gcccctcccaatttccaataataacccctccatccgatatggcatttatttagcctagtgtttttcaaaaaaggtaaaagggttaagatattgagcactggacctttcaaacgactaatggtgagattaattagagccaatgactatatcctactcaaacagttatcatcgaagaaatatcgatagtataaacagagatttaaaaccttggtctaacccctctaataaccagcatcaaaaagtcacaaaaaagtcatacgaagaggagcggcaaagcataatccctctatttttaatagatgacgcattgacatttagatacatatttgaccatttgttttatttaaaattttatgcaaatgtatgacataaaaagtgcttaaatacttttagtgataaaataactcatagcaaaataaataataattacatatttttttcaaataaaacgaatagtcaaacatacctaaaagttaacgatatcatcaaatgaaaaacggaggtactgtatacgtacacacctcggtttcacgaaccatggtcaccgtgctgctcctgagcttggtcggcctaagcgcctcgaagcagacggcgatctgctccgacctcgtggccacgtcgacgtcgtacatgacccctctcccaaacatgggcaccgtcatcctgtacgtgccgccctggtggacctccgactccggccgcgagtagaagccgccctgcacctccggcccgacgaggaaggtcgccttcaccaccccgaggaagctcaccgtgaagacgctccccagcttcacgtacagctcgtcggccacagccatggggcccctggtgatcaccggaattatcagggaaacgccgctcaccaccggcgggagtggcagctccgcctccgccgccgccgccgccgctgcagccgcaccgccgtttctcttccccgtcatcttcgccaccacggcgatggtgctggccgccagaaggacggcggctatggcggagaaccagacggcagcggctgcggccatgtccataccaacacgtacgtatgtacaggcagagcctgtaataacaaggcgcggaggacgtaccggaaggaacgccaaaaattgtaagatttaaatcgtatatatatatatatcttttaaaaaacgaggcgacggacatgtacacggtacaatacaccacacgccaaggctcatcacgcatttcattacgtacgtgaccgttctaccacgga

SEQ ID NO: 23948 - DNA, 658 bp, Oryza sativa
ccctaagccggaatttcttcgtcttgccggcatcggatgcagattaggtcaggtagcatcggacaagcctctgttgcagttgaagctaacccggcttgactcccaccttttgcctggtagcactgaactaccatttcttttgtagttgttgccatgttggcatattcatgccatattatcctatttgtgatttctgacaacatcttgtggattcgggtcaattatatttgattatatttaatatattgcgttgctattttccagttgatagtctgatattgtgcacttgtatacccttctggaacttctggttttcggattcactggtcacattttaaggaccaatatgaactgtatattgtagacagtacaagtacaagccaatatatgaagtaaatacgcaccacattgtgtaaaatgttgattttattaggttttaataaaggtggtagttgaaatgggtctacagcttatcgaaaaaaaattgggtcaaataaatatcatcgtgaactcatgatacattgaagaaagcttgtattgctgctgctatctagttagatgttagccagaacatatatcggcagtgagacagtttttgtgtaggttgtacttgtctttgattctcagtaagtttgtaattcagagctttgaattctga

SEQ ID NO: 23949 - DNA, 214 bp, Oryza sativa
cccacaccgcgcgccgcgcgcaccccccttgcctgccttgccactgccagcccgcacctcatccatcgcctcctcctcgatccctctcgctcgctagcttagcatcctgcatgcatgcagcgcagcggccgaaaccgcccaaaattcccagcgcagatcgctcgcctgccttgcctgcccgtccgcctaaccgacaccgcaacaaaccacagcc

SEQ ID NO: 23950 - DNA, 724 bp, Oryza sativa
cggccgggttgccaggaagtttcgggccaatggccgtgcagaagacatgaccggaagttccgggcataatgccaggaggttccagccagatggtctttactatgattcatatgtaatttccaaaaattcagagggcaaagtggttgcttattttaatgtgaatacaatgatgagtaccgcacttgtgtgtgggtgccaaaggctttggtaactaacatcaagggacccaaacttagacaggtttgggttcctaaatcccaagcttgatttcttttgtaggcatactcctccggtggttcaagttgggttgtggacagtggttgcaccaatcatatgactggagagaggagtatgtttacaagtcttgataaggagaacggaactcgtgagaatattgtgtttggagatgatggtaaaggaaaggtaattggtctaggtaaaattgccatctccaataatcaatctctctctaatattcttcttgtcaattcattaagctacaatttattatctgtttctcaattatgtaagttgggttacaattgcttgtttaccgatgaggatgtgaccgtctttaaaagggatgactcctccgtaccattcaaaggcaagttaaagggtgatctctatcttgtcgattccaatgtgaatagagtgaatccggaaacttgtttgatggctaaatcctccatgggtggcctatggcatcgaaaactaccccatg

SEQ ID NO: 23951 - DNA, 759 bp, Oryza sativa
tgaattaatggggggtagctttgaatttccgattacgacggttcttgcatctagaactggtcttatccagcaatcagggactcatgacagtaatgttgcaataataattagtatcctacttagttaatttatttggaagaccaattaagcagaaatggacggaagaaattcaaaccttcaactcggcgacggcgagcaatttaggaataccaggaaagttttcatcagtttaattattttatatgcagatggatgaacttactctgaaacctgattttctgaaagggaaacagacaaaacagaagattaagaacgtacatatgtccagaaagcacacacattaaactactttgtgcatttgtcggtgtcgcttcgcaccgattagaccggagttcatcaatccgcaattatccgtgctcttactcctcctgcttatctagaaccaaaatccagaagcagcatttgtccgaaattcaaacccactcattacagtgtgtgaacctttagcatttggggtcatagttctattaaaccgtaccgtgtctcccgggtatatcgcagagatagaacattctattggtaatttggtatgcaaccagtcacagtaaaaaacaacggaagaaatgataataatcaaaggttacacgctgaattttcatgctaatcaacgtccaaaaggttgtgctttttctcagggaaaaaagttaccagtatacttttactcttcgactcgcggcccatggcctaaactgcttcgcg

SEQ ID NO: 23952 - DNA, 612 bp, Oryza sativa
  unsure (1)..(612): unsure at all n locations
gacggccagtgagcgcgcgtaatacgactcactatagggcgaattnnnnnnnnnnnnnnnnnnnnnnnnnnnnnnnnnnnnnnnnnnnnnnnnnnnnnnnnnnnnnnnntgaaggcgcgggtagccgccgtgctgcgtcgccacgggggaacgcgtcccgcgcagcatgaggtgcagactttcaacgacctcagcttcgacgatgccgagctgaccgtgacccgggccggcgcgccgatcagcctgaccgagcgcgaataccgcctggcccgctgcctgttcgccaacctgggacgaccgttatcgcgggaatatctctacgagcgcttctggccccacgaggaagtgttgtcctcgcggccgctggatacccacatctatcgcctgcgcaacaagcttggcctgaccgccgagcgcggttggcagttgctgaccatctacggctacggatatcggttggagagcgtggcgacggtcgactgagcggcgcggggtggcgagaccgaccttggcggtcggcgagggagaatgaaaaagccccgcggctgcggggcttcttttcggcgaggcgcgcttacttctggaacgcggccacggccttggtgatctcgg

SEQ ID NO: 23953 - DNA, 1163 bp, Oryza sativa
catatacatatatatatatatatatacctatatatatatatatacaatatatatatatatacatatatatacctatatacatatatatacatatatatatatatatatatatatatatacatatatatacctatatatatatatatacatatatatatatatacacatacatacatacatacatacatatatatatatatatacatatatatatatatatatatatatatatatatatatacacatacatacatacatacatatatatatatatacacatacatacatacatatatatatatatatatatatatacatatacatacatatatatatatatatatatatatatacatatatatatatatatatatatatatatacctatatatatatatatacatatacatatatatatatgtacatatatatacctatgtacactatatatacatatatatatatatatatatatatatgtatacatacatatatatgagttggattttttgcgcgcgagttcacatgtaccgacaatgtacaccctatatgcagcttgcacgaatcttagggcaaatatattaggtgctaacaaaatgtaacatgcatgatgtttacgttatactatattttttacaagtgtaaaatacgttgtttatgtaatttttgtatttcttgtatgcaaaacttgtttatgtaatttaccttgtttatataaattaccatgtttatgtagtttttgatggtaggatatatatcattttgtaagtatcatttttgcaagatgacaatttggtgatatagtagatatattgttttctcattttcactaaatatcatgttataaacaaaataagggttagagaaatacaatgcactagatatataaatgtcatacatatgattattattgaaaaaaattatttggtaaaaaatacaacatacatgttatacatattgtgaaccaacctaatcctaatcttttctccctatagtaatcattcatttggttaaggttaggtacattttgcagcacgaatcttggaacacatcaacggtgtagattgtaggtacatgtgaacccgagtgcaaatatgcattttcctatatatatatatatatatatatatatatatatatatatatatatatatatatatata

SEQ ID NO: 23954 - DNA, 19205 bp, Oryza sativa
tgtctgtccgtatttgtctagcggagtctttttgtttatctgcggaaactacaaaacaaccatttttgtcggtccttcctttgtttcatctgtatgaaatttgacttatgaagcatagcatattatggtattgcctatgaataaaatgtgccccgataatagtgtgtttgaaaaaaagcataactataatataatgtcattaaccaaagtctgtgattcagagaacaatactactatacatactgctatcatcctttggttgaaggatgaattgtatcaaatattgtcgtagtgttagcacgggcatattactagtgttactaattagataacatattattacgaatatagattaaatatggcaaaatataactgaagtagctaacatattattccagatgtagatgaggttgtgtctagttgtagtattaagttgctacatttttggacgaatttattatattttgggatgaagtgggatggagagtacaccaccgtccccaaataacttaagttctatgaacttggacaaacaattatatacattcgaagcaaggattggttttttgatgtagaagtaaaagtttgtggttggatcaaacatctagggccgggaactgtcctgcccctctcctctcaccgctgcatcagcattttggggcacataaatgagaggattggacttgtgaatgcctcagcatttccaaatgcaatccttttcgagccatcgtggctctcgaaaatactgatcctccgaggaaaagatttgaataatccagaaaccagtttgcacctcaccaacttgcatcaacttgcatgatgatagtgctgaatcttcattcatcagagtgtggctcggatctttctgtattgatgttagattgcaaattgtaaatatattactgaattcaagttaatagaagctattgggatcgtgtaggctacgatagcataaatcaaaattttctatcacgtaaaccaggaaccatgcaagtattagatcatagatcgttaccactcgacgcgctgtgcagtggaagaagacgctgagaagtcgaaggaactctcgcgaagtagcgcgcgtcgatgtagaggaagtagtagatcgcaccggctcgaccttctcctcctcgtgtgttctcctcgccgtactcccacggcgatcagcaccgcaaaccagcggcgcctctaccggtatccacatgtacagggacggaacgccacacgcagatgtgctagcacccgcgcgcggctagggttttgctcggggagggaagtgacggctagggttactcacgtgatgcaatacctccgccggtcacacccctcacgaatatataggatccatcactcgggcctccaagacccgtaggactcctattcggatccttatccgaattaagctcatattggatctctatccaatccccttattccggcccattaagcgtgcgaccctgtaggttcatatatactcggctgtaacccgaaaactccttttcggtccacgcgtcaacagcggcccctagcagaacgtattgacccaccgggcatacataaagatcatatcggctgaacctctagtgtatacttgtatgaacccctttgcctcatgatatcgattaagctcaaggctagatatgtgccatcctctaatagctcaatcattcactcgaacctgttgatagattatataacttgtgattgactcctcaatcacctttggcatggccatgcacttccataatctacaacatcgaggggcccagagatatctctccataggaggggcaaatcccatcttgattattcatatcccactacatgtttcatagcatacccgaaaactatttttataactacccaattacggagtaatgtttagtagtccctaagtaagctactacacatgttgagaaccatgataatctcaggtttaaggattcaacaccaacactcaatgagatcactgatgacacaacacatatggctcttgcagtatctcatgttgggtctatccaacaacatgttcaccaacatgtgtccacattattaatttggtatctctataccatgatccatgagacatgatcatcaattaatacatgtgctgatcatataaacatatttgttccacatatgatatttgatcagggatcctttagaaatagtaacaaacaacataaagagtatcatgaaagaatcacatattcattaaccaataatgagttatctatttcaaggaacaatgtcggataaatatgtaaacatagtatgtgatacaatcatctctatgattgtctttagggcatatcactaacagaaacttatagtatttttttttctaaaatccactgcaattcaagattgctgttatccttttgtggagcgagccccatcgtttctcctacatgtggttataagccataactcttattagtcataaaataatttgtgcgtgaaacttttctatgagcgacttaaaaatcaatttcagaaaataaactatgatgaagaaaacattaaaattaactccaaaattaagttttaaaatctaaaatttggttgtagccttgtaggtgataacttaaaaaacatcgaaatccttccctatgacctgataacttgaaaaatgctggcttcctagttcctactcatgcacagcacaaccacagcctgaccacgagaaagacagaaaggaccttttcaagttttcttcacttcttcgaagtagccacaaggctagaaacatgaacatgccgtcactgacacctctcactttcaagtgattgcaactggggaaaataataaaaaagaagtcaataaatccgtactacatttgactgtgcttttggtaccaataattctgaaaagggagaagagattaggaggattcatgggaaccagcagctgcacatgcagctaaggtttgactggtgtgagtgtgtgcatgaattcatgatccaaatggtttgaatattatttccggatccggttcaattcgtcatttgcttggctggtgtcgctcatacgtagcacgctactagctggctattcgtttcaacaaaggcttggcaatattcaaattaattacaaataatttgtgccaagatgagaatatatatatggactgctacattgacaaaatcagcattgctatatatgtaggagtatatagtactagtctttctcatcatgaatactggaaaggaatttgtaatttgaacgcaagttttggtgaagcatacgtgggaggacgcagtcatgatcaaacaaattaaacgagacaacgcatgtgctgccccttgcataccgcgcacatgccatactagttaaataaccacgagtctactcgcttgattcatgtatgcattatatctaaaacattttttatttaaaaaacattttacgttccattgtcattttaagggatttatttgttattttcattccttggctccggaggtagtgaaaagtcgacctgaaattactttcaataaacggtctttataactaaatattttgggtttatactccgtggtccatagctaatataagtgacaaacatactattcgatcccgtccataataattatcgttttacacataattgaggttaaactttttagaactttgactatgtttaaaaatatttgctttacaaaaatagcagttacattacatgtatagattaatcttaaaatataaatattctttatatatctcataataaaaaataatagtaaagtttttttatttaaagcgataattattatgaaactatagggagtaccattttcttccagcatggaacatacaccaatttatttttgagaaacagaaaacctacaccacggcatcccgtggagacgggatctcctctactactcctctccctccaaatcatccggatcccctcctcatacctcactctcctcccccaaatcacacggcactgtagccctccccgtcacctcctcctacctcactctcctcccccaaatcaggcggcactgcagccctccccatcgtcgtcgcccaccgctcgccagagctggcggccaccgccgcgggggaggtggcgacggtgaggagctcggcggcgggcgcggtgagcgagagggagagtgggagcgaggcgcagtggagccggaacggggtacggttgcggcaacatcctccatggccgtgcctcctcgacgccatccctcccccacgtcttctcctctttttgatgataccctctgataccccacaagtattaggcttgataccttggtcccaaggtctgatacctaggtaccacctggtatcttaggtaccgggtatcaggtatcggtcgatacctagtcggtaccaaaggtatcaggtaccaggtaccaggggagcatatgtccctcacctcgccgtgcctcctcgacgccatccttcgccgttgtggccctccctcccccacgtctcctcttttttgacgctaccctctgataccccacaagtatcaggcttgataccttagtaccaaggtctgatacctaggtaccacccgataccttgggtatcgggcatcaggtatcggtcgatacctagtcggtatcaaaggtaccaggtaccaaccgatacctaaggtaccaggtatcaagtaccaggtactaggggagtacacgtggacagaagaaaggaaaagagaaagtcacttaaaatatcccgttgcaacggtatcccgttgtgtagctgccctctttgagaaaagcatcaacagtgtggtggtggagcatgactccactcatcagggtttaaattctggtatccataaatattacgtatatataagtgagatcttaaaataaatttggcgatattaggtatataccgttgattttccgtcttttcaagcatgtgttacgggccgatcatattcatatgtgtgtaagtgtggtattgcgggtgtagagatgttgtgcgttcgtacgtctaccatcacagtgaagtcgcaagaacacagacagggaaaaccggaaaaggatagaggaggcagcgagccagccacaacctatttttgtcacgaggagaagaaagcccagccctccttgaccgttcccaaaagctgaccgttgccttcctcccctcgctgaccagtcaaaccacctcctccacttgtcacttccactcatcacctcgaacctcgagccgtgggccccacatgtcattggaacagcgtgtgtctcctcttgtcgcatttggaatagtcgtcgttggtttcttgccgccttgaccccaaccaccagcgtcgtatataaatcccccctgcacaggaaagctttcgtcacgaaacaaccttgcgttgagcttagctttagctgatcgaatcgagaagagacgtaaattaagcaagcgatcgatcgaactgatctcgtcggccgatcgattgatcggatttggttccatggagaggggttgcaacggcaatggcggcggcggcggcggcgtgaaggtgaccttcatcgagacgcagttcgtcacctccgacgccgcgggcttcaagtcgctcgtgcagcgcctcaccggcaacgacgcagccgtgccggcggcgccgccacagaggccgcggccgtgccgtgcagacgggtggaggggagccggcggcgcgagcgcgacggtggtgaagcgggaagccgtgccgccgccggtggcgccgtgggtggatgagatgatgatgctgtacgagacgtgcgacctcgccgagatgttgcgcgtcgacgtcgtcggcgcgagcggcggaggacggtgccacggcggcggcggatacggtggttttccatgctgatcgacggccggcgatgagctcagtccatcttcagttttggatgctctctgcatgttgttccattcttttttaactgagattatctgtatattgctccatgccttgttgtaccctgttttatatgtttggttgcgaccaggccatgtaattccggttctaatcatgaaactgaaaaaaaaaacaaattgatagagccgatgaatcaaaggattttggagtcacaacagggtttatactttccgaaaaggccgaaattttggtaatttcagtgggcaccaacatttcatcgatttcgaaactttttcacaaaattatggaaaagaataggaataactatagttagccatatgggccgctcggcacggcacggcctaagcctggtcaaacccagaccaagatttgtcaggcctatacatatcttacatatggttgaaaagtctatttcacatccctgaagttcgtgctgtgccgaggcataggcccaggcacagcccaacaaccatgtcgtgccggcacgggcccgacatcgatcaggccatgtcatgcttgggccaggccaaaatcccgtgccttggcccgggcctcgaccttatggccaactataggaataacaatatccatgcaatacggactagcgattagtgtagattaacaaatcctccaaacattttattgagaaaactctaaatactagtaaatacgaaagggagatgggtcctctccctcatcacctccagctataatgtggagcctggaggtgaaggcaggttttacctttccgtatttaatattaaaaccatccttgaccggtttattgtataccgacctaaaaccgataaaaactaatagctttcagtcaacatcgtaaaaataccaactaaaattgacactactggtttcgtgaaaatcgatcaatttttgtgaaaaccgctcggtggagaaggatcagacagaaactgagaccgaagtctgaagataacttttttatcaaatttttttcaagactaatgcttggtagcaggagcaggtggtcttctttcccgcatcctcttcgccacttatattgttcgactcttgctaacaagacaagaaaaaaatgtacttacaattataataaatgaaattgcacaaaggattatagtaatcggtagctgagccaagcacaggaaattctcttttccgtttctttaataagcgacggtctttgacttttcgacatatgtctgattattcattataagttgttttatcattaaaaacaattcaatcgtatttataacttatatatttatacaataattttaaataaggtaaacagttatacatacctataaaaattactccatccgtttcaggttttaagacgtttttactttggtcaaaagtcaaactgttttaaatttggttaaatttgtagaaaaaaatagtatcattttataaatttattattatatttacctataaatttagtcaaataactaaaacggaggagtaacgacattaattaccgttgctcttaccggatcggtgcgaagccgccgagaacgcagagaagaataggataaggatacagtgaacctcctcctcgcacgaggcagggagtgagccttgaccgttcccagaaaggttgaccgttgtccgtcactgaccaccaacccagtcactcactggatacgaccagtcaaaccttgtcgctaatgctaaagcttcaacccaccagtcacacatccagcgaaaaacccacaccctcacctccacgtgggccccacctaacctggaccccacatgtcattcggatagtgcaggcatctgtgccgtatgtattgcattcgcgccgccgccgccgcgcgctctgtataaaaaccccatcggcacgggaagatttcgtcaccagcaaccttgagttgagagagcttttcgtcgattcgaatcgaatcgagaagaaaaggggaaagggtcgcaactgatcgagctgatctcatcggtcgatcggattcgattccatggagaggggttgcaatggcaatggcggcgtgaaggtgaccttcatcgagacgcagttcgtcacctccgacgccgccgggttcaagtcgctcgtgcagcgcctcaccggcaacgacgcagccgttgcgaccgcgccgtcgctcgagaggccgcggccgtgccggcggggggtcgacgggtggaggggagccgaggcgacggtgggggtggggctgccggcggcgccggcgccgtggatggatgagattgagatgatgatgctgtacgagacttgcgacctcgccgatatgctgtgcgtcgatgtcgccgcgggcggaggagggtgccacggcggcggcggccggcgatgagctaagccgttagttttggatgctctctctctctctctctctctttcctgaaattctctgtatattgctccatgcctcgttgtaccctatgtttggttgcaatcaggccatgtaattcccgttcaatcatgaatatgaatattgtagccgatgagtcagaggattatggagctagatataaactgagatacgcgagattttctctattttagtgcagtggtaagaggtgtgtgatttcaacccttaagttccgtgatcaatcctaaatacactcataatttctttataaaaaatatttgaagggacgtctcttcctccaaatctcgtttttgaaattagaaagatctccaaatctcgttcttaaagtgataaaatgggatacaggtcattaagtagccaatcaagtttactaacgagccaactcacgagccgagccgagctatcttatcaagataatgaactcaaatgagtcgagccttaatgagcccagctgacttattgccttttgaaattctatgtatatttcttcgtttcatgtgtaggccacacaattttggagtcgcagacacgtgcacttctttcatttgagatttatagaaaatgagatttagctactcaggacaatctgtttttcacaattacatgaaaaacagacaggcgcatacaccaccacacacgcaccaccgcctcaatatcctcagatatgttcttgtcacctttgacaagaggttctgctcttcccttaaatcacatgcaagtgtttgcaatcgtaatgcagtgtgaagttcgtttacttcagaaatgtaaagaaaatttcttgcctgatatgttcccattattttcatcaagatgatgcaactaaggaaacactgaatctgaatggtgcggactgcaaagacttacatttagtagacagcaaaacttactaccagagtgcctatagaagcttcagaaggaaataataatgtttcctacagctgggtatgattgcgatgtcactgataatgaagttgaagttgagtcacccgactgatcacatctcacactgatcaatcttgctcttgaccagctggaaagctggattcacccaggctccgcagctgcactgcattcctgcccagtggaattgtcccaatcggctgttgcatttcctgcacgcgatcttccctgaaatatatccttccaccactgcaatgcataatacattttattagaagaaaatatatcagacgcacaacaccaaactagcagaaaatacgtttgtgagcagagtggttcattattagtcctaaaataatttgtgcgtgttctgagcgacttaaaaaccaatgttgataaataaactatgatgaagaaaaaacattaaaattaactctaaaatatatcagacacacacaacaccaaaaaagaaagaaaaaaaaacattacagcatccaaggtaggtaactaaccaggttgcatccacttcaagggctccacaaagaggcaggtacattcgggttccttctcatccacatgatactttttgcgcgtcgcgaagcacttctcaccacgaccaactttgtgggtaacaacatagccttcagtagcgacgagtgtgcgacatcttttgcagcggtaagtagtgcctggatcagtggtttctaggtcaccataagttaccccatctgtgtactggtttgtttctgcagggtttggattagccactggacttgtctccagctcagtttgtactgctggtttaatatcagtttccgcgactttgtcctggcttatttccgcaggcttttgatcctccatggatcctggcatctcatcaacctctggttctgactttttctgttcaactcccaattctagcgcctggatggtttccatctcctggttgatttgctcacccctgcattagtaacagttaagacacaagtggtgtttctacagtgcttggtaatgtgcaaacataaataaagtccaagctttgcaatgttgctgttgagatattcatttatgtgcaaacataaatagtgacttttcaattcaaaaagaaaataccgtttctataggttgcagtgaatagtaattactcataaatgaagaacacaactgtattcagtattggaaaggcaaacatgatcacaatgtgctcacttgttatggaccagcgctatgggagtagatacgggtggcgcacacgcgaagaagatgcagcacccagagtagcatagcccggttacaattagataaaagatatataattagtaccaattccctaattttggtgagtatcctagtttatctactgttgcctaaactatcaagattgcaccgtgattaaggattactattccattaagaaattcaggaaaggacaatctgccatcctatccagcagcaagatttcggcctgatattaaactcaatagctacaaggattataaactcaatgattggcgaaaaagtaaaacaaaatacgattaacgaagcagcacgaaaccaaatattagcagcagcagcagcagcaaaagattgacgtatataataataccttcacatcaggactaatagtagtaatccaaccaaattctggcccccagctaattaacacagaaacgattgcgggctgactattattatatacatatatacagaaaacaagggttcgtcccagagatgaagacgccaagaagatgaaatcggagcagggaaatccaggattcaaggtacataccctagatgttagatccgaccacccaagcggccgcaagcggagggctccttcgtcgacaccgcggcgcggcagcggcggcgacggctacggcgacggcggcggcggaatcgggagcgctgcgcctacgtctccacggcggtggttcttcttcttcagttccgcttcagcaggggacgaaatattagtgaaaacccaagtatatggacacgcagcaacgcaccttaactcctaatcggaagcagaaacggcccaagcccgtgcgatagttggccggcccattaacgtcggtgcaccttttactcagagtaagtctgtttttcctccctcatctctaactcaagggtataacgcttttcccatctttgaaaacccttctgaccatgttcacttaatcccaccaacaaggggattgagaggatgggaggggaataattccacacctattcaggtatggaattaatcccttttaatctcctccaatccctccttcacgctcggtggttttagaaagtggttttagaagcggtttctaccgatataacagtttgaccatgattgacccattgagtcagcagatgaaacccacgtggtaaagactttcttcgcttctcatcttcttccccgtctctcttccaggagcaaagagaaaagcgaggcatgatagagttattccttaattcgtttcatcctcggttggtcatgactcatgacgtggatccatagcaggataacattaccacatatgggcttgttggcctccatctcaatcagactaacatgatcatgggactcaacatatactggagctgaataaattatggacaagggcacatcagatgaattttaagaaaaaaacattggaacttcattgtgcagtctccactggaaagaaattccatggatttgacaagtgatatgcactagcatagtagcatacaagtacaagaacaatgtatcaggcaattatcaagaacatatactagcaacgttctataggctattttcactcagaatgttgccaactaaaagacggcactaacacatcggctcactcagccatatttcacaaggcctcatacatgccacaccccatattctcatgcgccctaccatttagtctacaacaccacgatcaaaactccagggaggctgctgcatcagtgaagcatcaattttgctcctgcaaggtacactgttactccaaattgaaagtccgaatgcaaacagcagcggttctgagttctgatccttgtgtttttccaccgtttactgtgaaccccttggaatatgaaaaggagtttctgatacactgaaaacaaaaagagagtttcagtgtggattgtagagtattttatcagtgaacgtaatagcaagagctggtatagtgtaaatatcagggaactaaattgtcgatacataattaaacaatggcgacagttagatgagactttcttttcttgctaacaaagaattataataaaccacattatagtttttaactcaatcttaaaatttgcacggagaggatggtcaagtaagcaattacctaacaaggatgaccatgattttcatgggctgaacttgtgaggtaaacaacagggaattctcagtttctcacatgttgcggacattgcgatggctggctatgcagtcttatctcacctacaaccagaagaaaatacacaatttgtcatagagcattctttgagacatcagttaaattttagagataatagtatatcacgttataattagaacaaataatctatattgtcaagtaccacccttgagttgtatataaaataaaatatccatccattttgagttgtatataaaataaactatccatccatttttaaagtttctactacatagggcatgcccacaatattttgtgggcatgtgttctctaataaggctgtaccatgtccattattatttcaacctaggattaaatccaaagtttaattcatagcattaggtttgactactcattgcattccacgtatgatcaaatcactcccttcattagtgcaatcaattttgaagaatctgttgaagagcacataccaccaaaacacacatttagtaattatacaaagtgccaaaaagttataccaaaaagatttaaatgaatagaattgccagtctacatgtataccaaatggatgaatggtgctcaaagagttcactaaaaccaaactgatggaaataaacaaaaaggagaagataaaaaaggacgtagacaaatttcctgccttttgcttttttttggaatgacagaaatgtcatcagcaagggaccaaatacaacatctggttccatagtgtagtggttagcactccagactttgaatctggcaacctgggttcgaatcccggtgggacctcttttttggtattgccatagtcctcaaatgggatctatatagccaattgcttgcagggcgaatacatgattcatgcgttgttatacatataatagttttgttcaccatgtttttgtttaatgcggtgcatcaacatgtggcatatctggccactttaatggtatcagaacctattgatcatttgatcttctcagtatctcaacttctccaaacagcaacctttagtgacaaaccttccatcaacaccattaccatcaccaataaatcagacattggtactcttggccttcaacaagctattttccagttaagagttgtggtttcatgctagatggtaatgacaattttggggtgaacataggcttttaaactcatgattgcagatggaggcaaagaaggatagggagaataagagaaattagtcaatacactataataccatggaagcagaaaaccatggctgacactaacacacagcatttgataaaatatcgcatggaatacataaaaacacagtctaagggcctgtttgggggagctttagattctgagaagcagctgtttggtagccagcttctgagaatctggaaaagctctgaaacccagcttctccagcttctgacttcttagttcatttttcagaatctataactacagattctcaaaagctgtggactgtttggagcagcttctagcagaagcagcttttgggaaaagctgcagctgggataagctcccccaaacagggcctaagagtttgttgaacaggcaaaacagaaacaaggaaaataggctggagcagcagagcttcctatacaatgaaaagacaagaaaatttcaggatgaagttgggagtattttatcagtgaacaagcattaaattgtcaaaagatagctcaacaatggcaagagttaaacaaggcatgtttctttcttttctttctaacaaagagttacaataagacacgatatatttttcacttaatcttaaaatttgcatggagaagattgccaagtaaacagttaaacatgttattgttgcgggtgaacttgtggagtaaaatactagaaattctcacatgcttgcaaacatggtgagggctagttttgtggcctacctcgcttgcaaccagaagaaaacacacaatgtgtcacacagcattatttcagacattaaatttcagcgagaataatatatcacaatatcaattagaacaagcaatcaatattgtcaggtacaacccttgagttgtatataaaacaaaatattcatccattttgaaaggagctacagtactacacaagggacatgcccacagtatacgtgctagcctcattagattgctctatattcacaattttgtcaacacatgattaaatccaaagtttaattatattagtatacgctgcattctactatgacataatcactctactcacaaacgtacatcaggtgcaatcaaacttcacaagatattaaggaaatcagtggtgaacattatctctcattctcttggaaaagcatacactgtcaaaaattacacttaataattatacaaagtgctaaaaagttctagtaagcgtttcaaatgaatattacgttttaccaaatgtatagtcttcacgtatgctaattggatgcatgctcaaagaaaacaatttcactgaaaccaaactgacaataacaaacaaaaaaaagctaaaaaggaaatagacaaaatttcctgctttttactgtgcttatggaatataagacagaaatgctatctgcaagcgaccgcatacaacatctggtcccatagtgtagtggttagcactccagactttgaatctggcaacctgggttcaaatccctgtgggaccttttttggggtattgcatagccaattgtttgcagggccaatacatgattcagctgtaatcaatataatatacgagtactgctactgtggtactccaaactgataggccaagtggtattgctctttttcctcaaaatacaagacaaatagaggtgggcattcggtctagaccgaaaattcggtctggttagttctttcaaaattggaaagcgaacacactagcatagatttctagaccgacagtttggttaaccgaaaattcggtctcggtcttcagtcggaccgagaagaccaatcctctctgtggcgtgcaggatggcatgcaggcagtcagtatcgatcgggaaaagaaaatcaagaagatcaatctaaagaaaatcctagcaagatgcaaagaaaaaccccataactagaactcacagatcaatacatcatctgctcctcattcttctggccaacagatcaagatgcggtacgtggtggcaagcagcaggcggcgacgggtggcttggtggcggcctgcaatgggcagcggcggcgggtggtggtggtggcggtcgggcgcacggggcaggcggccgcgcggcaggcagttccacagtgggacgacaaatgatggagacgagcgcaggtgaagctcatggaccatagatgacagctagggttgtggtagagtggggacttgacttttgattagaaattgattttgggctgacaagcttaggccatgaaaaatgggctattggactattgggtcactcggcctgaccctgtgcttttatggagttcagtcacatcgggtactcaagcaagataaacgaacaagtgaaaaaaaaagatcagtctttgcacttctctgaccgaactatgaaccgatgaccgacatttcgggtacttcggtctcggttttttatgcccacccctaaagacaaacaaaagtggtggtgggttttggtccttgtgtgtttttcaatgtctactgtttaaaggccagaggaggctttgaactttttttatatgaaagcagattctgatacaatgaaaagaaggacggaatttcaggatggagttgacagtattttcagtgaacataatagcaagagctggaacaggtagtgtaaatatcagggcactaaattgtcaatagataactaagcaatggtgacagttagatgacatgcttttttcttgctaacaaagaactaaaataaaccacattataatttttaatttaatcttaaaatttgcacgtgcaagatggtcaggtaagcagttacctgacaaggttaaacatggttttgttggggtgaatttgtgcagtaaacaactggggattcgcacatgtttgtggacatagtgatagctggatctgtggccttatctcacctacaaccagaagaaaaaacacaatttgtcacagagcattctgtgagacatcagttaaatttccaagataatagtatatcacgttataattagaagtaatctatattgctaggtacaacccttgagttgtatatataaaataaaatatccatcgaattttaaagtagccactgcatagggcatgcccacagtattttgtgagcatgtgttctctaattaggctgcgccaagttcacaattacttaaacctaagattaaatccaaagtttaattcatagcattagatttgactattcgttgcattcacatatgatataatcactctgttaattagtgcaatgaaacttctccgaagatttaactttgaagcatctgtaagatgattattacagaaatcaggggtgaatattatctgttggagtgcatgtaccatcagaagtcgcatttagtaattctacgaagtgccaaaaagttctacaaaaagatttaaatgaatagaacttcttaagaaatgtcagtctacgtgtatgccaaatggatgaatggttctcaaagaggagaacaatttcactgacaccaaactgatggaaacaaacaaaaaaagaaaagataaaaaaggacatagacaaatttcctgcctttaccttttttggaatataagatagaaatgtcatcagaaagggaccaaatacaacatctggttccatagtgtagtggttagcactccagactttgaatctggcaacctgggttcaaatcccggtggaacctcttttttggtattgccatagtcctcaaatggggtctacatagccaattgcttgcagggccaatacacgattcatgagttgctataaatataatagttttgttcaccatgttcttgtttaatactgtgcatcaacatgtggcatatctccctgctttaggggcatctgagcctattgatcatttaatcttctcactatctcaacatctccaaacagcaatctttagtgacaaaccatccatcaacactattaccatcaccaacataaaaaaaaatcaaaaatcatatacatagcactctttatattccagacaagacacttgtggtttcaagctagatggtaacgatatttctggtgtgaatgtaggctttcacactgatgattgcagatggagggaaaaaaaggataagagagaacaaaagaaattaaccaatgaattatctatgctacgtaaaatgttagtagtggtggtggttgttctgtcacaccacccctagcactgacattaaattttgaaatcacctatttgttcaataaggaaaatcataaaagcggtacttggactaaatatgtgcttaattgacttaataagctagaaaccttttattttccattgcaacacgtgggctcttggctagtaatactatgaagcagaaaaacatggcaaacactaacgcgttgtatttgataaaatatcccatggaatacattaaaaagcagtctaacagtctgttgaacagataaaacataaatgacgaaaataggctggagcttccaatacaatgagaagacaacaaaacttcaggataaagttgggagtattttatcagtgaacgagcactaaattgtcaaaagatagctaatggaaagagttagacaacgcatgtttctttttcttttcttgctaacaaacagttataagccacattatatttttcactcaaatcttataatttgcatggagaagcttgtcaagtagctacctaagaaggttaaacatgacatgcccacagtattttctgtgcatgtgttcacctcattagattatttcaacataccattagattactatgcactgcatcccactatgacataatccctctgctcacaaacatacatcagcgcaatcaaactttggaatatttaattttgcaaattctattagatgactctctctctctctctctctctgagcatacacagtcaaaaattacttttaataattatacggagtgctaaaatgttgtagcaaatgatccaacaaatatttaccttttaccaaatgttacatgtatgctaattggatgcatgctcaaaggaaacagtttcactgaaactaaactgatggaaacaaacaaaaagagttcaaaaggacatggacaaaatttccagcttttcactgtgtttatggaatataagacagaaatatcatctgcaagggaccacatacaacatccggttccatagtgtagtggttagcactccagactttgaatctggcaacctgggttcaaatcccggtggaaccttctttgtttttttttaggtattcccgtactcctcaaatgggatcgagatagtcaaatacttgcaggatcaatatatcaaacatgagctgttataaatataatataagagtacttctagtctgctactgtggatgttataagagtaccgagcagctgacagattgacctgtcagtagtagtgttattgctcttttttctcaaaatacaagataaacagcagtggttgtgagttttgatccttctgcttttttcatcgtttactgtttaaaggcaggaggaggctgtgagcttctttttttatatgaaagcagattctgaatttcaggatggacttgggagtattttatcattgagcatagttca

SEQ ID NO: 23955 - DNA, 13242 bp, Oryza sativa
caggcatcatttcttagtagttctttacttaaaggagatagacctttctccaattgttatgtaaccatattataaatgtctggatgtagtagggatgttacacacatctgtttaattgtttttactgccatacctccattcttccaactgcaaaaattcttctattaggcaaattcaaccaagtgaaaatggcttatacatagcactccacatgatggagagagaataaatccccgagttactatcttaaatcttaaaaaagaaggaagaaacaggtattgctcaatcccagtgccatagttgaaaaaagctggaccagacaagcagttttaactggaattggtgttgtgctcagtctgatctgctaagaccactcatgcatatggaacactttgaactggatagaccaggcagcttcactctgaaccaggcaacattccagaaaatgctggtggacctgaaaagcatggctatagcagagaatggggccaaagcaaggcctaacagaacatccaggcacacaacttgtatcaactatcaagcgaaaaaaggatgaaggggttcaagcatgggtcttcaaactgaaaacgtcaccactaccaccccaccaccatcaacttgcatttgaaatggaacatacactataattcaaattccgtgaactgcagttaaaccggaactggccatcagactaacttttcgtactatgcccagtgcaaagaaaatgtgtttccagttagcaggaactaagaattaaaagctttgtgacaaaagaagatttgaatggctaagacaaacatttcaatcattacataatatgtattcataaatgaggttaaaatagtttctcatgtagccatgtatgataagtgtcatgttttgttgtgttttgcaatgggtaggatccaatgatccataagaaagaatttgaaaaggaatgaatgagtctttggggaacaaatggcatctccaatttgaatcatggcatttgatctaggacaccaaaatatcgtggctttgctgagacaaactgcatttctgtaactgtgaccctccccatcctatcctaggtttaacaatgtagccaccatccacaaggtttttgagaatgtgtcgcacaagtgttcaagatggctatggcattcagctactacactgtaggagtacaatgaagcaattcatcctcatgagaatgtttagtgtcaaacaaaacaagattttcatgtatggtagaaagggttgtcgggaactgtttgcgcagagagcacaggctcatgcacataattgcacatgaagtgaattagaagtatgcactaaaacactcatggggatgtgcttgcgtgaattggtcgtattatcaaataccaatttgagatgaagttattattgaaaatactcacgaagagcaacaatcgagctagagctagacaagatttggatcagtggagatattttgaacctttctagctatgagttaaccgtcatcgactccaatgaccccaacgccttctgactcaggccaaactggacaaacatactctcttgtactaactaatgatagttgaagccttggaggcagcattctgaaaggcagacgcctagcctcctcatgccgaggtagcttgcagtgctgacaccttcaacttcaagccttactcacctagccgatttatccaatctatacggctgattaccaggcgccagtcctccaacagacacacctagggccttagtgaatactagttggatgtgatgacagatgtcacaaacattgttaagcgatgcaaagtgcattccaaatgggggaatgcttaccataatatagcgctgtgatattaaagagaaatgtgagcagactcatatccacctgcctctaggcataatatgaactgacagactggacaggtggtatctttgttgtgtccatgaaggaatattaaatactctttccatcccaaaatacaaagcacccttattgttagaacagtcaaatgtgtttttttactaataattaaagtatatttttattgccacgcatgtgatatcattagattcgtattagaatgtactttcatatgatattaatttcttagttgtcgataatgtattacaaaataaattaatggtaaaaaagattcaaagtatactcctggagactctgtaaaaggctaacacaccttatattttgggaagcagggagtatatttgaagtttcttttaaccacagcttaaccagtgttcctccggtcagactgtcagaacaacaaaccgagagtctgacctgatgaccagtctggcttttaatgctatggctccagaaaccataacacagatagaataccctaaccctgtttggacgtcagtaaacacaaggggccctgcatctagtccacaaacatgataatctcttgtttttctgcttagcttgacacactaaaaccatcaagtttgtagcgttgcctgaaatataattgaccccctgaacctaggagagaaacccacaagtacctcttgtaatgtgaaacaggataaggacccgataaaccaggatagggcactgactctgacccttgatttgtctactgggaggcgtactcttgctgtagacacaaggctctaaagcaatctagaagaacaagaggaaaatatgaaacttcttttctcagtgcatctttctgttaccattgctcattaatataaggatgccttcctatacagccatctgaacaattaatggatagaaacttttgaggaacccaataaatagaaattatcttttaggattaggaaaactaagtgttaacatatggaagcataacaaactggaactaatcccttcctaagaaactacaaattctatttctccaccttcccaaattccaaatcttgggctatacataacatgtcagcttgttaaccacaatttcactcccatcttatgagttacaaattatcagatgaatcctcgaccatctgagtttacagagaaaggaaacacaaagacttccccattgtatgcatctcgtaagattttttacatccattcagttgaactgtgctttcataaaatcatccagtttggcttacagctagatgtacatgccaagtagatgccctcccagagtcccagttctacgctagagggtggtaagtcttaaaatcagtcagcctgactatataatcaattaagagtgggtaattaactagttcagattaacatattttatgagttgagctttaccatggtatactcctggtacgcatgcttacgaatcaatatattcacattagcatgtcagataggaacattctaaatttctcctaaaacatacagagatgtgaatacatacgatttcacacggagtatagtataaatagtacttaactatattgatttcacagaaataaaaatgtctatgtttgcacaagaatggatttatttgaataaccaccagcaatattggagaaacagactgccatcaataggatcattgagacataaattaaaagtaggaactcaataataacagaaaaaccttaaattaactcactaggttagattatagtgaaacaaatacagcaataagaacacaaaaactacttaataaaacctacctacatttcaagatgaattggcggcatctgatccatctgaagaggagctatcactgtctgagtctgccaaaaagaatattaattgattacacactaactcaaatgtctacagctggtagatatatatactgtaaataccaaaatatgatgagcaaaaccaagggcagaaagaaatattaccactagaagaggatcctgtatcactgctggagctgctagagctgctcgatctacttgcattttgtccattattatcagcttgttctggcacagaagtagctaatttctcatccacaatcaaatctgctcatataagaaaataagtaaattatattgcttccataatccatagttcctggcaattgacttggacaattagatgaagtacaaaatagagcagatctaacttactttgctttggagattttacaccaatattaggctcttgactctgcaatccaagaaactgtaactttcagcaccaatcataaaattcaattaactatatagtgctacttatagaataggaataggaatgattgaatgcccatactggttgttgtggggcaacatgttgtgcatgcaactctgcatcctgccttgcaagcatggctcgctcagccttcctcttttgcttgctcaggttcttcttgtagttggccacaaatctatcaagttcccaaagtgtctcagtatccatgctatctatttcaacctcaatctcatcatcatgctgtctaacagacagattcttgttcttaatgatctgcacaacaacatcaagcttctccggtggcaaattctgaaggttgttactaagcttccgcttctcatctattgtcatatctctcttatccggatccttggcctttggtttcttcatcgatggagtcctggcactataagtgggagtatgacttaatggccttgacttggagtccaacaccatatggtgttttacagaatctgaccgatcaaggaagcgcacgtcaattggtggaggtggaaacttatttggcaatggcggacatgaggcaaggtactgaacctcagcctcaatttcgggccactgcgcctcaaagattcccaacaactgctcagccatgaaatgcacatcctgccccttgggattataggtcatggcattatggaacgtcagccgtacatcatcagcaaactccctcgggttcctgtactggccatgcgtgagtcgggtctttatcgtgccaagatccattgggtgcttgataatagcaaaataatcatgcaaaccaagcgcaacagcatctacaggcttgttaaacacccaaccaaatttgtgcttcattagcctagaaagcagcgacatagatttcttaaaagcatgagagtatagcctctgctcagcatcataaccagcaccatgagatgctaaggaacgatgcttcttcttgtggtgcttgggtttcttacgaccatgtgaatctgaaggcggaaacttatccttggcaagcaagaactctgaattttgatacaactgattcgcctttggtgtccgcttctccttctcgaaggactctgtgtgagtcactgacacggttagtggcccgcgctgcatcactgagcggaccggaacaatagcaccagcaacttgaccaggtatgggcgtcacaggatcagcgagtgcgaactgcgagtgcgcatacccaacaggaagctgaggcggcggcaccaccacaggcaaagcaagggccgctgcagactcagccgcgatggcctcagcggccgccttcagccgcttggaaagcccacgcacctggtcgagctccgacgcaagctgccgccgcagctcgctccgcgccctccgcttccgcgccttctcctcggcggccgcccggacgtctccatggccgttgggaacggccccgccgtcccgattaggccccgcggagacgtcgtcggaagcgggcgcggcgggctccccctgctgcgcgggggcaaccggggcgctcggcggagggggatggggggaggaagcgggcgcggcgggcggatcaggccgaggcgccgcaggcccatcctcggggcggcgaatcgacctccgaatcgaggctagggtttgcgcgagggggctggagctagggctagggttcggagggggtttagggtttttgcgtgggtacttgcgccggtacaccctgatctccggcgcccaccgcgacgtcaccggcccctcctccaccgcctccgccacggccggggccgcggggctcgccgcgggccgctcctccccgccggcgccggcgccaggaggggacgaggccatgcataaattaaaccctaaatccggtcccccccctcccgcgaggccccggatcgatgcaggcggccgccgcggcgagggattcgcgcctagccctgccggaatccgccggggtcgactcggattggagctcccgcggcttggctatggctatggcggtggaggtgggggtgagctgctgcgacgggggtgggtggtggcggcgtcgggtcgggggggtcgtgtgcgcgatctttttttttttttcttttcgtcgtttttatttttgttggtttgggttggggggtgaggtgacgaagagagggggggaggcggtggcgcacgtgtaatcgtggccgttggaatccgatggatggatattacggcacggcaagcgaccccttgggccttggaagctggaaaaagcaaggggccgtgacgtcatcgtcacatactaacagtcacatgcgtctgaagctgctgctgctcagcttgggttcgttctcaaactctttctgcctcgtattttccctttttcgctcgtctagatatgggatctatctcataaatacgggatctaagatattaaatcttttatttaattccatatatttattattcaatatcctacttttataccttttcataaattaaatcgtataatctaaacggagaggcctctccgtttagcgctatcgcgcgacgcgcgtggcagccgtcgatcggcgcgcgggcgacgtggccttcatccggcacgcgtgcgcgtcctgaccgcgggtcggcttgtcccgaccgcgagtcgcactttttccgaccgagagagagagagttggcactgttcaaaaattcctgtggcgctcgagagagagagcggcggagagagggagagagcggaggcggcgagaatctccggccaaatccctgccggagacgtcgccgcggcggcggtttgggaggggggaaggttacggctgtttcgtcctgtcgcgccagcggtggaatcaacggcggaggcggcggaatccgcggtagaggcgacgttttcgtctcatcgtgccggtagttgtgggggagggggggagggaagcagaggctgcggtttcctctccaccaaatccggcggtaagctgcggcgtgcagaggtggttgtggttttttgcgccggagagagaggagcgatccatttttgtgtgtgatttttatgccagcagaggtggaggggggagcgattattgtgtgtgttttttgccggtagaggtggagaggtggagcgatttgtgtgcgttttttgtgccgggagaggtggagagatttgggcattttaactgcgcaaatcagtgtgcgattggggcatttgttttttctctagctctatcccctcatttccccctctctcttcctcatccaggggctagtgctggtggtggatctcgggctctcttttgctgcgccctctctgcatcctctcagagagcacaagtggtggtggatctcttgctcaatttgaaggtatttctattttttttctctattttggcatttgcacatttgcttgcacaggccatgagtcagatttcatgttgtagcctcagcataatgaaaacttggtgccattatactaggatttctttgtgcccctttgatagcttttttagggttccatgcttcatttacaatgtaaacccagtgtgatttttcttcagttaccatgttgctaattgtagatgctaatattcagttatgttatttgtgtacattcagagaacagaggttttttgtgtacttgtgctgccatttttttaccaggggttttgtgtgccctttgatagctctaggtttccatgctttcatacacagtgtaaatatgggtagctacataggtttcaagtcgtaacaaccaacatggattgaatagatcaacatcgatctgcagagatcgacgtacattcagagaacagaggctgcagatagggggggagcatgtatgtgcatgcatgtatatgcagcatgtaattcaataaatcaaatgttccttaagcaacacatttgatttattgaattgcatctagtctagttaaaacttactttttcctatggcatgagtaatatttttagaacaatgaaattaagtttgcatttttttcttcctactagttaagttacttctaaaatgtactgacttacttctaaacacataaatattacttcctactagttgttaagttgtaattggttagtttttgttgaaactaatatttaaaatgattttccagtgatggctaggaagaaatcccatgcaacgaaaggcacgtaacgaatcagagtcaagtcagaaaaaaggggtgtatcacaacgtgggaagaagagagatcacggtggagatgatgcaacacaacctcctccaaaaaggagtagaacaaaggtattgaaacaaccgtctatctttctacccttgaacctgtgtttttgctttttttatttactgcactacactttttttatgctgctgcactagacttttatctgtatttttctagaagtaacttaactagttttagaagtaacttaatattccataaaaagtaacttaacacttactttttttgaaacggtatttttgatgttgaatatggacttggacatgtgtactacctatagttataaccggatggttagtaaatcagaatgatccagtattgaataaaatttggttaactaattcctgtcacattatgtgagattgcatgtctatccttgttctatgtacccataatcctttttatggtagaagtatgaaatgcaaccagtttttcgaaatcaatccagatttatgatgttgcaatccagtattgaatgaagttttggtttgcttcagaaggagtatgactatgtccccatacaattgcactacatgttagaaaacttgtaaaatccaagtggaagtgtttttgcctttttttaatgcactagactttttttttgctaaaggattgaatcatatgacttttatctgtattttcctagaagtaacttaacatgttctagaagtaacttcatctgttgtcaaaaataacttagcatgttctagaagtaacttacagtacaataccttttttttggaagtaagtcagtgtagtttgggagtaagtcagtgtagtttgggagtaagtcagtgtaattttggaattaagtcagtgcattttggaaagtaagtcagtgcaatttttggaagtaagtcaatttttggaagtaagtcagtgcagttttggaagtaaataccatgaaataggacagtaactttttagacatttacagttacatgcctataggaagcaattttttctcaatttgacatcagtggctatagttatgttttttttcacaattttgttttgatgcagtactagaagagaaagcgaggaggcaactagggggaacgcatcatgttgggtgcacatacaaggtacaaaatgaattaagaaggtgtaactcttagtgaagtgttagaagtaggggtgaaaacggtaacggtaattaccggccgaccggcgttcgttttcgactttctaccggccgagccatatggaaatgataatcgaccgaaacaaaaatggaaatggtaaaaaatatggaaatgaaaacggaaatggttttgctgttataccgatcgtttccgtatttaccgtattcttgtggaaattaccgtttcttataatatggtaattaccatattctaaatatgtcgatatttatagagcatgtctatacttgacccgcagcttacatattgactgactcttcaatcaaatctctaacttttgtacatggctaaaatgaagttaatttataatttatatagtataagcttgaatttatgtatacatataacatacttatgtaaagttaaatatatgtttttatagtttaatgtatccgtatttgttacctgtttccgatctgtaccgacatgtttccgtccgtattgttccgtttcaggttttccgatatttccgatatcgttttcgtttccaaatttaccgtttccgatttcatttccgagaaaaatatggttacggaaatggttgagactgttttccgatcgtttccgaccgttttcatccctagttagaagtaagtttctgttaaaattgctctgagagcctactatggaatgtgaattcaactttatgtgaaagtaacttgcaagttcctaggaagtaatttactgaagtgttagaagtaagtttctgttaaaattgctctgagatttttgaaacatcactactcatgccttttgctccaactttttttcctagcagcacatacaaaggaaatttggaggtatgagggaggacattaatcaagatggaagacaggaaacaacattacaactcatttcttacaaaattgcagcacagtttcatagaatatgtttatcagagaagacagaaaagatctcaaagattctaggttagtttctatgatttttttggatggatctcaaaaaaacagaggatgaacttcatgtgtacctgtgatatatttttttggatctactttactttcttctcctcctccgagttgatggtttcgtcctcctccccttgttcgtgctttttttctgatttttttccgccatggcggctgcgtggggattgacgctgccagttgtccggacttgatgggttggaggggggaaggaggcgcgcagcgctctgtcctagctgggcccacgccagctataccacgcgaagcgagagccgtgcaaccgtggtgcacgcgcgggctttccttttttggcaggggcgcgcgttcacgtggttgctttttctggcaggggcgcatgtcgcgtgataggactatcgcgagaccggtctcggtctagtcgcgtccaaattaaatggctttgcagtttcaatattgaccaatgcatcccatctttccatacttccaatcaatcgtcgactatgatgttacattatatttgacattatgatatttacaatccgagttatttttctctataggcatgtcttcgtttcggataattatttttcttatcttaattgtatttaagaccagcaataaattcaataaagattggggattagagttgacgttcgtaaagtttaggtgtttgggctttgagtaagaactataattggattatgcttattgactcgaaattggatcgggtgtcaagtacacctattcgaatgttccctctacttaaagttacttttgttttaagccaaatatttcttatctttgatcattgatatatacaaatccatatagtataacatgtgaattacatattatgaaagtattttgcatgataaattaaaaatataaatcttatgatgataagctatatgaatttatagaaatcgatggtcaaagatttcagatgtctgactcgaacgaacttcgaatgataagaaatttgaaatgaaaggagtataacgtaagcatggaaaagcgctgaagtttaatctggcccatctcgacaacaactttgactaagggtgtgtttagttcacgctaaaattgaaagtttggttgaaattagaacgatgtgatggaaaagttggaagtttgtgtgtgtaggaaagttttgatgtgataaaaaagttggaagtttgtgtgtaggaaagttttgatgtgatgaaaaagttgaaagtttgaataaaaagtttggaactaaactcggcctaagccacagcccgttgtagacctgacaaagtgacagtgatcaaaattacagaaagaagaggcactcaaaaaggaaaaaaaatcccattagttgggatttgggttgaatagtggtgactggtgtagcaaattagagtgtgttcttagcgtgtgtttagttcatgtcaaaattgaaagtttggttgaaattggaacgatgtgatggaaaagttggaagtttatgtgtgcgggaaaattttgatgtgatggaaaagttggaagtttgaagaaaaaatttgaaactaaacaaggccttaagtctaagttcccaacctcactatctcatttaccgcgcgcacgcttttcaaactgctaaacggtgcgtgtgttgtaaaaattttctatagaaaagttactttaaaaaaatcatattaattcattttaaagatttttaagctaatagttaattaatcacgtattaatccattgctctgttttctgtatcgaaggtgagggttcccaaccatcactaagaacacagcctcaattaggggacagtgcttggcccattgatggtaaacaagcatttgtttggaattgtgaacaagaaaaaactgaaacgaacttgtcccttcacatgaagcctagctagttgagtgaaactgaatttcgacccatccatttgtaacaacgcatgattaagtggtttgtgtcgacgtttgatgtcgcgattctggtatttgcatagtatgggtatcgttggtgctaggatatatgcgacattgtagtaaaagagatggggacgaggatttttatacaggttcgggcccctgaattatcatgtaataaccctactcctgttggccgaagccggtattgctcttattcaccataatcacaccagtacagtatttggggtagcctatctaactgttgtcgatttggcgatctgtagtattgactcgtagtcgacaacagggtagccttcctcctcgaatccgcatccggcgagatcagagacagcgctatgtctctcctgatggtagccataggcaccataggggactagccatgcctatctctgaagtcaatatctggcgtcttgtcttagcgtatgttggcttgtatgttgatcttctgtcttgatctattgttccgtgtcccctctcctcctagggggtcttgaatttatacccataggtgtccccttgtccaagtagaactaggaaaaccaatatggatacaatctgagtagtccttgtcgtttccatgtagaactctattcatccttccttatgcggaattcctcctgtatccgaaggttgtttccgtataatacatggtatgtggtgggtcctgccgagatttagtcaactactattaagtatgtggtatccataaccctgacagtagcccccccgacttcaatgcaaatgaacgaattcatattctcaaccgcagaccttggagtaactgttatcgagctcacgcgaccgttctcggtgagtttagagataacgttagacttcccttatcagcctcgtgcgggcacctatagggtttgtctgagtcaatctcctgatgtcaaccaagaaagtacagagcatacgactaagtctcctgtcttgctgtaatcgagaatttggattgaa

SEQ ID NO: 23956 - DNA, 7297 bp, Oryza sativa
  unsure (1)..(7297): unsure at all n locations
cgttttctctttttccgacttcgatcagtcagtttgttgagtcatacactcttcctagcccccagccttgtcgtcggagaatcgttctcggaggataaggctcttggacccttgacctcccttggttgaaaaagcactgaccatagcccccagccgtgaagttggaaaactcaatttccgattacacggcttggttaatacgcacggcgagaactcttacatgaccagatcttacatggtcgtttgtctctacatgatccgacaaggccttatccgctctgggtgtccccagccgaagttcccttaggttcctcagaggccttgtcaggacggcataaagggacatgaggataggtttcaactttaggtgccgtcgtggtaagggatctctggataaaacacttggcgatattgtgtacctgatatcaactttgtcaggagagaggtaatgggagaatcgctacacctctggtcgaggaccaggtagtagtcgtaactcgaccacttaaagtagaggtagtgggagaatcgctagaccactggtcgaggaccaggtagtagtcgtaactcgaccacttgaagttaaggcgcgaaagattgctacgatttactggtttgagaacccgcgggtagaattatctctcgaacgccaaaggaagctgcggtgcgagagattgctatgatttactggttcgagaaccagcgagcgagtagacttatctctcgaacaccaacggaagctgcggtgcgagagattgctaccttttactggttcgagaaccagcgagcgagtagacttatctttcaaacactaatggaagctacggtgcgagagattgctacggtttactggttcgagaaccagcgagcgggtagaattatctcttgaacaccaatggaagctgcggtgcgagagattgctacggtttacaggttcgagaaccagcgagcgagtagaattatctctcgaacgccaatggaagctgtggtgcgagagattgctacggtttactggttcgagaaccagcgagcgagtagaattatctctcaaacaccaatggaggtgctagagttggtttattacatgtgcatctcatgtggccagcatgactcacatacccaacttatagcatatctggatgtccgttcgcaatcatgtcgggtgatcaagccgatgacgttcgtgaggaattatccgttaacaaccttttctcgaatagtccagccatggccggtgctatgagataggtcgtcggtctttgttggcaggttgggcgtgacgactctgtatttgtcgagatcgttctcgataatggggtgtactcgaccacaacctactcgagtgctcaattgttcctgaaaaatattttctagaaggcaagacatatagcagataatatcgagtatgtactcaaaaaaaatgcatggatcttctagtattatcaggatataacgagcagattaaatatcaagcattatgtaaaccgtaaacaagcatgatttatacagaagaaaatagagcgagcccccagcattaaaccgtagtcggtttaacatcaggaacactcgcacaacagatattgtataaaaaacatgctctaggtaaacataaaaaattattgatctgacaatgttgtacaatctagaaataggcatgacaaattgcatataaaatattgcgtacctttgtagatacatgccggatgtatctacgaaattagtagattaatttaaaaaatcaatctcctaattatcttgttgcgtactcgttcgatatcatgtgatctgacatcttttggtacgccgcggagcttgaggcttgaatgatctcgataggccaagttgttgacgacgatggttccgatcttgtcgaggcacgtactctggtcaagttagatcctccatagccgaagttatcgagtagtatgctgtcagagaatccatctcttaaacccatctcgtcgaaaccttgaagcaccaaaagatcccttacctggcgcgccactgtcgacgtttgatgttgtgattccggtatttgcatagtatggggatcgttggtgctaggatatatgcaatattgtagtaaaagagatggggacgaggatttttatataggttcgggcccctgaattgtcaggtaataactctactcctgttggccgaagccggtattgctcttattcaccataatcacaccagtacaatatttggggtagcctatctaactgttgtcgatttggcgatctgtagtattgactcgtagtcgacaacagggtagccttcctcctcgaatccgcatccggcgagatcaaagacagtgctatatctctcctgatggtagccataggcaccgtaggggactagccatgcctatatctgaagtcgatatctgacgtcttgtcttagcgtatgttggcttgtatgttgattttttgtcttgatctattgttccgtgtcccctctcctcctaggggttcttgtatttatacccataggtgttcccttgtccaagtagaattagggaaaccaatatggatacaatccgagtagtccttgtcgttttcatgtagaactttattcatccttccttatacggaatttctcctgtatccgaaggttgtttctgtataagacatggtatgtggtgggtcctgccgagatttagtcaattactattaggtatgtggtatccataacctgacagtttagatctagtctagtcactgtaacacactaaaaagaaatgtgtttatatcagggctaacttaggatgccatcgtttggccaattatggataataaaccaaacgtcgtattagtgataaaaaataatttatgaataaaaactaatgatttaaacgtcaatgttaaaagagaaactattataaaaaaacttaaaatcaactttaaaaaatttaaaatttttggtatcagcatatacgttacaggaaaaaaagatgtggcccttaaattcaacacgttgataccaattgttggaacatttattaatgcgtcggtcttacaaacagcagtgcatatacacacagaatccccatgctgcacgctctttcctctatgaaccagcttttagggtattgaaaagcaaaagctagcacaaaatacatatagtactatactagttatcattatttttttgaaagatcaaaacatttactgtaattaactgagcagatggaactcacttcagggagactaaaacaagtagccgacagatataaattaagaaagaagcctattaatcactctataaactcgtatgcttttgatattgtttcccgaatctgatatgcagatgctgctagctggccctcatcgtcgacgacgaactgatcatagctcagtgatgctgagggttgggccccccggggctgagcctcttggacccctcgtaaaccgtctcgtcaatctcttctccatcatctcgctgccgcggcaatactgtttcgaccgccgtgccgctagtcctcgccgcggccggcgcagctggcggcggcggccgcggcgggggttgactgacgacggcggcggcgaccatgtcgtgaagccggcgatggtgatggagcactgggcagcggtcgccggagacggagacggagacgggagaggacgagccggtgacgaggaggaggaggaggcagaggcagagacacgagagggttattagtttcatctgtccggcgctggtaattagtgatggtgttgatacatgtttatgtagaggtttaagctggcctggaaacgtctatttatagtccaaacggcagtgctgcttgacttgtcaattacgtactggtttcatttttttgattcacaagtatatattttttttaaaaaatgtgttcatcctgtagtatatactacaaaaagagcccaaattatactgtttttattcacaagcagaagtattacgtgcaggcaccatacggagcatatacaatgttctttcttcttttcccctttggcagatttacaagctgacctaactctcaacattttacagcggagcatttagagtttggtgtgttgatgtactgatcgatgtatgtgtatgtgtgtcttttagttttaggagtataattgaaaagagaaaacgtttgaagtttattttgttgttgtttcagaagttaaaattgctttcctaaaaaaaaagagagttaaaattgcttgcatgtatatatgatctcttcatggttctaactcaatcaggtaagacatgggagtgtatgttgagagtgcatcacttcaagttaaaacgcttcaatttcaattacaaaaaaaggttaaaacgcatcaagtagtgtcaattaatttcttgttctatcataacattccactaattccctgcgctcgctggataaggccggttaaggccgtctgtcctttccctttttgacatacacattacctttgaactataatgaaagtgttctttttgacaaaatgtttgacaacgctaaagatcaaagggccaaagcaaaaaaagcaagcaacttttcttgtcacttgtcatggacaggacaaaatgtcataccaatgggccggtttgtttttttatgggatttgatactgaacactcaggtgctttttcatgcgaaaattagtttatagcataagaagatttgacgcgctcttttagctatagcatcaaagttcatgggcatattttaaaaaccaagtcaaagtccattgtggaaaccagccaaatcaaatcacgccctataaaaatcaacccagggaatatatatatttcgggattaatgtaggattttagagtatttttaatttttgaaaataattaagaacccggatctacatccaaactatacatagccgatttagagtattttgtgggagctaaattaattcatatgaaaattctataaaatcaaggtacaaagccactctatgatggaaatgcttattacattaactaggtgaaaccccgcgcattgttgcgagaatttagtatgataacaataaaaaaaataatgtgtaaaatagctagaaaacatcagattaagtaaattaatgtggtttatgataatttaaatttaattagtatgtacaatggtgatgcaaacgtaaaaagtaaggtgttatgactttatgaaagaagaaaagtagggagataatttggaccgtagattaatcatctaaaggataaaacaattgatgtgatataacttaattagagaaaaaaaggagaaatataatttggaccatagattaatcatttaatcactaagtgaaaatgaactatataagtatataggatatcataaaacataaaaagatatacattgaaacattatgtgaattatgttggatgataatttcacatgtttgtattggaaaagctcttaaattataaaaactataaaagatatagcatgtttgcataatgtttaaatgtgatgattattagtggatgatgatgttgcaccttgttaattaatggatgatgatgtggcatcttgttagtggatgatgatatggcatctttgcatgttaagcttaagaagttagtgggggataactttatagtaagataggattccatcacggtgcgcttgttttgatcaaaattaagggcaatttgctatgcatgatctatagatctagttgattgccagacaatccgacatacctgccataaccgacgtgaaacctaacaatgaaataggccaattatctcagcaggaatcgcatgatcatgctcacattacaatgtgtgctatgctgtattgtaagcactacccgattcggtattgcaattgcatgtcatcttgcattatggcttaatgtgtctcatccaaaagaagaggaatattttgcatcaattacttgtcggttgtcctgttctggcggcaacaatttttcatgggtcaccaaaattttaggagattcgccagttattaaacaagcacctcctctcttttaactttttagggttaagtccgatttacccctcaactgtcctgaaaattcaatttaaaccataaagtgctctaatgcgagatgttttacacctctgagcttttaaaacagtatgaactagactcccacacgctttactgtagaaatttgtgtatgtaagatatgtgataaatttgtacagtgatgaaaatataaaataatttagcaagcaaatgaaagatgcaaagccgagaatggaacaggtcgattatcaggtttttcccctacttatcgatctatttctaaaacccccgttaactctggtataagaaattttttttgacgtagggtataagtacatcgactaactaagggagcattcgttccggtgagttaggatgagaaagcacattgtagtccgcgcgtatgcttcccaaactactaaacggtgcatttttggcaaaaaaattctataggaaagttgctttaaaaaatcatattaatccattttttaaaatttaaaatagtttatactcaattaatcatgcgctaatagctcacttcgttttacgtatcttcccaatcttctcaatctcctatctctcaaactcaccctaagtactcctacctatcaacttgataagataagtcgtctgacaacagcaggcagtggtaacttgatcaattgagcaacaggtgcaaaaattcctgaaaatacatacaaatactccatctggtttcattttaattgatgttttggacaatgacacggtctacaagatacatctttgaccttatttttctattataatatatataataaataaatatatgtttacttttattatagtactttaaaagacaaatctatatatgttgttctagttcctttaaactanatatttttaaagttatcgatagtctaagttataaaaatttgacctcaaacttgtccaaaacgtcaattaatatggaactggaggggtatctgcaaactgtaaagcaatgacaaaaaaaaaacgttgatatactacaatatatagtgaatggtttgtactttcagaaaagaaggtgtaattcaatgaccgttaccattcgaaaaccatccattttaccttacacggtaatatatatatatatatatatatatatatagtacacactattaggtgtattatatatttataccttaacagagcttacctttttatgaactaaagaaatatgcaaaatgcaactttgatgctgtgaaacagtaaagggaaggaattaatatccaacagcataaatagttcataagatactcaaggacagcaacaatactaaaagttggttaacacaagttctcgaaaggctttaat

SEQ ID NO: 23957 - DNA, 6319 bp, Oryza sativa
actagttgactgttcaaaagaattgagcaatgccttgaaacaaaacacttccttctgagatgcttaaaaaagaaccaaagtatcatctgcatactgaatcactgggaaaccctttccattttgttcatttattggcttggacaacagacccagagagcatgctctgttaatcacactctgtaacaactcagcaccaagaacaaaaagcatggggaatgagaatccccctgtcaaacccctctcctacatttgaaagaatttccaggaacaccattaagcagaacagaggtatgtgctgaagtaaaaatcatgtgaacccactgcaaccatttgtcactaaaacccatgctttgcatgatagaaataagggcataatgctcaatagaatcaaaagatttttcaaagtccagcttcaacagaattatctctctctttgattgatggcattggtggatgtactcaaaagaccatgccaaacaatcctggattgttttgcctttgataaatccatattgattttcttgaacaaccttgagcattacaccctgcagatgatctgccattaatttgtttagcactttcaaactgatacccatcagagagataggcttgaaatcattaacagtttctggagagggctttttgggtactaaggttataaatgagctattaagcggttgcagatcagtatagcacacatgaaagtgtgctgacaacctataaaaatcctgagaaatgatgggccaacatttcttaagaaaaaacccattataaccatttgggccaggagctttgtctggtggaattatcttaattaagctgtcaacttcttgggtagagaagtaatccaccaaacaatccaaaattacagggttaggaaaaagctccatcagattaaagctcattgaaggagagagagaaatccccattctgctctcaaagctttgaaaaaacatattagccttctggtcatgcaaagtaaccacttgaccagagtgatcataaatttgagagatggaattcaatctgaatctctctgtggcaattgattgaaaaaacttagtattctcctctcccaacagcatccatctattcatgcatctttttttttccaatagagctttttaaactcaagaagtttaatagtttgcagcttgataatttctttgaaattccactcataaatacccaaaggcctatgttcttctattaagtcaagaaagttgagcacaacattacagttaaccaggagagcagttaaccttgataaattcttactccatttcagcaaactcttcctcaactttcagcttaaaactgatacacttagctgggtcctcatagccaggatccatagaccaaaccctgctgacaagataaaaaaaaccctccatttcaagccagtagttttcaaatctaaaaattggggacttcgggatttctgtatgtatcgattttaactacacaaggaacatgatcagaaatattgcgagctagaggaagcacaatggtgttggggaaggccaaggtccaagaggggcttgtgaaaacccaatcgagtctctccaacaggggattattctacatattactccaagtgaaatttctacccttcaaggggattttcaacagaccccgagaactaataatgtcattgaagatgataatgtcattcataccagctcctggcctatttctgtcatcaacagatgtatagaaattaaaatcacccagtaaaagtctgttttcagtcggcccaaaagattttaagccaagaacaaagagggaacattctgggccattgcatgggccataaatgcaagtcagggtccaagcatcagaagattgccttgatacaaaatttactgtgaccgaaaagctgtttatatcacctggagttcctaaaaagactttggaaacccaaaccactaagattccaccagaagcacctctagatggtgagaaagcaatcaatttactcgatgccattatacatcattagaatgaaaagaagtgatgctgaaaaaagacattggaaaaaaatagagtggatccttaaaatgttatgaaaccagcatctcattaattaatttatacaaaggccaacataattctcattcgaaacaaagaaatcaaattggtagataaaaaatttgggatcataatcttccttgccattagagaaaagatatgtgccttgagaatttgaaagataagaatgtatgagctagaaaaaaaagaggctgacctcccaaaagtcaccagagcttcaatcactggaaaatgttgaacctcttcaatcactggtgaaataaaggtcaatctgagccaaccaacgatcaaaacaaagaatgaataaatatgaaaaattaaattacctacctcaaatcaagaaggcaataaagcttatgtccagtgctagcacggattgacttaatctaacgataaggcagctgaagttctcaaacgaatacagcagttatcgaggacatgagtaatcaatttcaaccgtcattccgtagaaaggatgactcccaaaacaaccaaactctcccactccaaggctaacattggggaagcctttgaatggctctaggagtccaacatcgattaaaaggcatggagtttgtgtggattttagatgcgtttcaccggtaataagtaaaggacgatgatgattttggcacgacgttacaggcgcacagagttaatgtcttcatggcagccacgaaaactacttgttggtgggtgtcgacggtttccaggaggtgtggcaacaaagggagaggaagaggagtgaggcggcactccagaccgtcgcttccctagctgacgtgcggtggggattgtgtggtagagccatgggagtactgctgcacacaatcgcatgggagccatgggagaatcaaagggatgacgtggcttaacaatcgctcaggaaattgctaataactacactaagtggggatcacttgtatagtattataggattacccctctaacaatgtattagtaatggttttagtcctcggtgtcatacacttatatgtggtttaacaattggcattctaatagcttggtgggctgcacccatcatcctctaccaacactatatttgaaggcaacggggctcgggaggctctgttgaggctgcggaggcgcttagcaaaagtggcgaagatgttgaggtggcatcatgcctgaggggctgaaaggggtagaatccgagctccgtcaagggatgtaggtggaggcggaatggtcgatgtgttggtccgtggtgtggcagaggagcacaggtcaccgctgctaaagactactcgccgagcttcgtcaaggtccacggatttgatgggatcttgctctcctccctgaccttctcgcttcttcctcttctccccaagctcatatgctcacacttccatcctccccaagatcggcagttgccatgcaactcctccttgacctttgatgcgaggaggttgtagagtctgacaaagtggatgcagagctcgaggtccacaggaccgtgcgcctcgcatctcctccatgtcctactcatcaaccgcatcatccgccattgtctcgttgatctcgagcactgcctatgcctctagttccacttctgcctttgctaagctccacatctgccactgctgcctcatcgaggtcaagctccacgctcgccgccgccgtgcctccccaagcaccaccaccactaccgcaagttactctccttcttgagggtcatagccgacggatggcctcccgagtgtcatcgctgccgcaagttccgctcctccttgagtgttgccgctccccgagagcttcctcctcaagttttctctcctccgctgctcgagctcggcgctctccatctcctcttgcctcgcccctagatcaagccagcaaagtgatgaggaaaaaaatggaggtcaatgacaagtgggctgtaccaatatcttaccacatcattcgccatattggagtgccagatgggacaagtgggaccgaaaccaccttaaaacaggaggatggggataatgtgtccggattaaataattgaatggtgtaatttctcttgatgagctggtacatcacaacactaaactcatatgatgatcagtgcagcatagaaacctatagagcatgcccagagaatcccaaaatgaaatccaatatgtcggtgatatggtaacaagggttccccgtattgtggacaaggggtagcttggcaccacaccatctgtttcccagctccagagggtggccgcaattcacctcaaatgtcacgtgccaaccctagccttgtgttaacagtgaaatttggtaagcccggagtagtcatcggctgagagtcagcatcggcttcgaagtcctgagattagccgatgagaattgtcaagtcgtcagttgccggattcttgctatattcggttaaggaaattgatctactaaaagaagcttatccagagactgagttcaaagagaatgcggcatggcaagttatctattaattaggaatagtttgttagtttccttttatctttaggaaagtgtgtttagtgtcctataaggactttatcttttccttttatctttaggaaagtttctttcttgtccgacaaggacttgtatcaacccatgggtataaatatgtacacccggggtctatgtaatctattgctacgatcaatacaattcggcgcatcgccacccttttacttctacttttgtttttatgttccggcaaaacttggcacccgacgcagggctgcatcgtcttcgatctccggcgaagggataagtccaatgttccgccggtccaggcaattgtatcgtctacgttggcgtcgttcaaggctgcatcaggacattcgacctcttggattgctctggtttggatgatatatttgcctacctatttatcatatgtctctgttaatctagtcttagcatatcaatttagctctatcggctgcttctcgttttagggtttctgccggtatcggctaaatcgcgttgctagattagattagcttagacatctaccaccctgaaaactcagtcaacggcttggtcgtctagatattatgtttcttttcatatttagtactgcatcagttaagtttgatctactaagtcgtacttagaaccataatctctagcctgctctttgactcctaataagggtttcatcggggtttcagccagtgagttatctggacgttgcatcggctcataaggattgcatatacatataagttggatttagccgatgacaacaaaggtttcactgtttaatctaatcttgtggatttcatgacatcagacctccgaccgatgtatgctttaaccttcggatcagtgcttattatatcatatcaatgctagccgattggtttatactagactatattatagttatattttattatcaacagccaattgcctttatatcatatctacattggacatatagccgattgcttaaaccctatcgctatcggctggtatcagcattggctattatcggctatcggcaggaactactccatcggcttgtcagccgattggctgttttgatctactatttgcatatcttgttagttgcaggatcaaactgactggcacgcccgcatctcactaagatttggacctgcacaggagctaagcagatctcccaggccggtatgttcgattttttcatcaacaccttgggagaaagtttgatttggagttgggtgcttagggtcccaagcatgtcagggtttagggtttagggtttaattcctactagtcacatcaactagaatatatgtaaaagaggaaagggtgaactctaatggattaatatgaaaatacatataattagaggtagtagtttatccttgggataaatatgatacaccagcatactccggggtgaagtgctgcttgcaaaaccttatttgtaagggcattagcaataccaatactagtgcatcgcatgagaaaatcatacacactaatttgtcacttttattttgaaacaactgaacatattacatatacattaatcatatttcgttttacatgcacatgtttctgaaactgctaaacgatacattttctataaaagtttcaatagaaaagttgctttagaaatcatactaatatatttttcaagtttgaaataattaatactcaattaatcatgcgctaatagctcaccttgttgtgcgtatcttctcaatgttcttatttcccctcctcccaaacacaaccttagccattggatcaacaaggcaaacggcttatatattggtgtaccttgaca

SEQ ID NO: 23958 - DNA, 13284 bp, Oryza sativa
tttggatgccatccacgctgaaaccggcccacaccagcaaaaccgatgccggcgggaggagtccgagagatggagatggagcaggaccatccactgccttagtccctaaccaatggtgggaatggcagcggcggtggaaaatcgggcgatggggaggatgacgacagtggatccgagggtggggagggtggcggcggcgtatccagtggtggggagggagatggcggcagatccgacggtatatagggattgcgtcagcggcggatctggtggcggcgatgggaggtggggagggtgtcggtgacggcggggatgaaccccgagcacatgagatgccagcgtttcggatggatttttctttggatttattttgtcaatttttctttttagtcggagtacggcttaggcttaagcgttcacatacgaaaaatacaattctttgcatgggactatctaaataacaacagcaagtttttaagggaaaaactttcaaacctaattatagtataattgtaatataattttactataatatatgcaactttatatctaatttatatagggattacaatgtaggtacaataaaactatagtgtaattacattgcaattacacagttacctttgaaagttttttttgcctaaaaaacttgcgacagttttttaattagcaataccgtttttgcatatggttgctctacccgtatgcaaaaatattttttgacatctgggtgtaggcggaccacctatatatctccgtatggatccgcttgctaaattcgattttgacagtataaaaaatattttttaagtagtgtaggcgcgccataacacatcctagctatagccgatggagaatcgtcttccctgaacttgttgatgacggaagtggttagcggcagtagagctggaaggcagggagaggcatgaccacatggagaaaggggatgcctacattttttatcccgtgcagaccaatcaaatccactaatataataatataaggtcctattcagattatagccaaaataaatcttactaaattttagcgttgtcaaaatattggcaagatacaatattatcaaaattgtagaagtatttcttatgtatttaccaaatttggcaacaaactaaatatagatatttttttagcaactgtgccaaaaaaatggtatggttgaaaatggcgtcaaactgaaccggtcctaactttttggaagatttactttgtttctacaggacaatatcgatacacgtatagatgtttttattcacatataatatctatattttactagttaattattcaatttttatcgattacaataattttatttcgtaccttacttctttcttatcaacgatcaacattactctacttaatttgtaatacttccaagtacgttaacataccgtgaaagttctcatcaaatacatttgacttgagggagtagaaagtactataatttgtatagtacaatcatatcgtacgtcctcggcaagaaagaaagaaaagcctttatcgtacatttgaattagtgatgctgatgcgagattaattacgtactaattagacgcgcgcagagcacacaatccgatcgggctatgcgtcgtgcaaaagcaaacgcggcatcatcgatcatatcgttctatatgcaaacgcattgctgtgttgttgtgtgcttcgaaggccgtgcatgctccacgcgactaattaacgatctgctcattgatcaccttgatcttgcttacgccatatagtacataatgtaactgtatatatagagctagcttagctagggtttcgatctgctaattgttttttttctcattaacaattgctgcgcacacgcaattatcttgagaacaaagcaacatcctgttttttctcgtttagatggatgcgttgcatcgtgccatgcgatcgatgcatggaattaaaataacccttttattaatgaattcaaattcaatttaagtgatgtacgcagtgatcgatatatgtaagggagagtgatgatagataagggagagctgtgtagagatggtactctcccagttttgagtgatctccaatcaaaagtagcattgcatataggtcggttcttggcctgcagcatgcttggaatgcagaaatttgatagtgcaaaattaagaaggatgaaatccaattttagtcattatacggttgtttttcaacctcaattttcaaaaggaacagttttgatttactccctaaactttgagcgtagtccgatttcccatgaactacaacaacaaacattcgatatctgtgaactttaaaaccggacgaattatatctccttgctatctaatcaacaatataagaaagacaatttatataaaaagatctatctagacacacctatcattcattatatatatatatatatatatatatgtatattcttttctctttcgactctctcctccatctcttagggccaaccaaaggcccacaaccgaactcccctcactcgagcacacaccttattgtcatcggagtgtgtgatcatagatgcctcaagctacacctacgcaatctatagctattaaaaccggacaagactagtggttcaacccaaaaaaatcacaatagctcagtccagttcgatctagccctccactcatgatgtggccatgtgggtgaatcaagaatgcatgtttggcagtgatggtgatggcaaggtgccttctaagcagatgagaaagcagaaagtacatccaagcgagggagtggatgcctagggcagcatgtttgaaggaggaatcagagaggagagagaggatgaggtcaacaacaggtatgccagatctaactctattttgcgctgcatgacgtgttgggcaggggggattgcttgtagaggtggtgatggcaaggtgcttttgaggggcgatggtgaagtgcttttgaggcgcgggagaagtttggagtatttatatgtgggtagagataacttgtccaagtaaaccacgagcagcccttgtgagatacgggtagataagacactgtctttcttggatcaaagtccaacatcttctatttccgttgaagggttttccgttccgttcttatctactatacttttatatttactagaaaagatgctcgtgtgttgcaacgggtgaatgctattttaatcatgttattgttatacggtttatctaggatgaaattcactttaggaattcgcttggatatttttttaaaaaaaatcatgagctgcaattagaagtctgactttcatctcaagttagcatgcgagtttttctaaagagatttctcatacgactccttctgtagttttaaaagcaaacaaacttaaaatctgactcaaacacggatttttatttccaaaagcgaacaaaatttaaaacccgactcaaatacgaatgatgtaccaaaataccggtaaaaacattttcaatttttataacaatagagatagagatatctggtggctataatccaaatatagatccgtaagaccgataaaatccatcttctaccatatgtttagtgttttcctatgcgattttttttcgggaatgctacatacggggatcctgtcggcatgggatccttcgtccttcttgcctatccaaagagaagcgagagctgagcgcctgagccgtaaggaggaggttgctgtcgcctgtctgtgaggaccttcggcacggttggggaaaaagacctgctcggcgagaggaggacgcggccaccggcgacgagccctacacggtgagctcctgcgacgtcgaggacctcgtctgtgtcgtgtcgaggcagcggtgcgtcgcgtccgagccgccggtgggggatacatcaacgaagaaaggaggggcgtcgatcggtggccggagctagggaacggagtaactgcggtggccggagctaggaaggggaggggcagtggtggtggtagctgcatccggtggagcgagcggctgcggtggccggagccatgggagggaggggtggcagttgtcggagctaggggagggagaggcggcggcggcggtggtagccggagccgggaaaggagcagcggcggtggttagagccaggggagggagggcggtagcggtcgttggcgtcggcatcaggtatgtccagcttctgatacctagttgaaatcacatgatatcttgtaggtatcgcctgatacctcataggtatcgcctgatacctctaaagtatcactttctacgtggtaagaatcacatgatacataataggtatcacctgatatctcgcaagtattatcttttacgtgataagaatcacatgatacctaataggtatcacctgatatctcgcaagtatcacattctatgtggtaagaatcgtatgatacctgataggtatcacctgatacgtggtagaacagcatgatatttgataagtatcacctgataccggttaggtattagtctattaggacttgatatctaactggtatcatcctgtttttgaacggattccggtatatagcagcttttttttttcaatgcacggtatattcatcagctggttggttatttagccaagaataaaaagatagaaaaatgttcttcctaggcccgagggccgagagctgttcggtatggccgggtggacgcgttagcccttagcagcttattgggcctgaaaagccgaaacagtgaacgtcgtacggcccattaaagcccaggcccaaaagagcccacccacctcctctcttatctatgggagacgcgctctccctctcgcctcgcggtcgcctcgctttctccctcgccaactcgcctaccctccccacccccgcgtcggcggcggcggcagcggcagcggcagcgacggagcctcgccggcggcaagcgtactcacccggtaaccctggctcctccccccctccttctccgtacctcgtatgcgtgttcttctgcgctcgtgcgtgcggtgtctgccgccacagaaaaccctaggtccgcctgcggcgtgtcagcgagctcgcccgtcaccgcttagatccgcgcgggattcggcggtttcgcttgctggagatgccttgacgagcggtttaacgagatagggaatgttctatttgtttttaccccgtagctgcaaggtttctgaatctcagatcccctcctgccatgtcggggttgaaggctagggttgttgcttcagagttgtcgtgaattagtcatatatgcagtaaattcttggttggagctggatacgtgggtggttgggagtaattgctattttctagatcaacttaatatgctggatcttggtgttatatcgatgtattcatttgtttgttactgtgttctataccattatcgtatccttagatccaaaggataaaggaaagtcatagttcgaaatttgagctgcaattcaaaatttttggaacagtgtttacaactcagatttgttgactgatgtgaatagcgcatgaacttgcaaggtgcatgattcattgggctatgccaattttgatttggtagtttttaatcttaaatcctttttaacatgatgccatgcttgtgtttgaagacttctttccatgtacttgaagttacctatgggtttttttgttccctatacttttaaattacgctgtagtatattattcttaacaaaaaactatatctgtgctgacaagtttggcagttattctttggttgcatttgtcttcttatcgctaatgttcctgtatttacgtgtaattgcagacaaaacaatgaggaggtatagtccaccttatcgcagtccaccaaggaggggatatggtggcagaggaagaagtccccctaggaggggatatggaggacggaaggaacagggttctggcagtctcctggtccgcaacatccctttaagctgcaggtactggaactgtataaccgtagcacctttttccaatgactatattcttaatgaaataaataaatattccctctgtttctaaatatttgacaccgttgactttttagcacatgtttgaccgttcgtcttattcaaaaactttggtgaaatatgtaaaactatatgtatagataaaagtatatttaacaacaaatcaaatgataggaaaagaattaataattatttaaaatttttgaataagacgaacggtcaaacatgtttaaaaaagtcaacggcgtcaaatatttagaaacggagggagtataatatttcggaggttgcagatttattcaatttgactggctctcttaactctggcagagcggaggatcttagagttccttttgaaaggtttggacctgttcgagatgtttacctgccaaaggattattataccgggtaaagtgttgctaatgactctgttgattggtttgttgattggcaatcgccaaaaaaatgtttgttataatgttaggatagtaaatgtagatagtctgtatgcttctctgtattgtcgctgcaataagcttacaagcttttctaaagttattcaatagactggaaataaaaaaaatcacaacggaggtttggcgtgaacattttccagcttcagtgtggtatcaattactgcagtcaccttttcatttagctccattaattgaaatgcttgaatcatttttttaatctgatgatgtgtttagtaatttttttcatgtcactagagcatgtaattcactaatgtggtaacccatatttttgctttctttctcctacgcacttaatatcataagaagtttttccctgaaactattcccagggtcgtactggattgaagtaaatacgatgttgaagaatgcttttcaatattcctaacaattgatttgtttggcaagatagagtcttgtccgaatgaagaagttcttctatgaagacaagatttgactcattgagaaaattaatttcacgaagagaagataagagagttgtactgggtggtgcatgcgaagataaaagtgagagaagttgatttcaagttctatcttgacttttcgcacattcgggaacttgaagcgaatgcttctgtgaagatgctctttatgaggatcaccatacgtagtgttatacaagaaattcagataatagagcctggacatctaactgctttttgcaacacttgcttcccttttgctggaaatgttcgtaagtttttaactgtgcttcactgagaatcatagagggtacattgagttttgaactgtgatggtaacatggcagacacacactacacatgaacattttgcaccttcttatttgttagttttaccatcaattttcctcaaacaactgtctcataaaatatacatatacagggaaccgcgagggtttgcattcgtggagtttgttgacccttatgatgcttctgaggcccaatatcatatgaatcgtcaggtggtttttggccgggagataactgttgttcttgctgctgagtcacggaaaaggccagaagagatgcgcagtagagccagagtcaggtattgttcccattactgcttgaacgtgcggcttaatattctgttttgtgcttgtttacaatgactttgtgtggttgctttgcagagggtactctgaccatgaaggccgtcgttcatcccattacggtattctctcatttctcatcattcatgatcttgtgcatttctaaatgcacatctagaatcttgtgtgctctgtaattatgcttggaatacttgtcccttttgctgcacacataaccgtatgtttcagatttcagattagtactattggtcaatctcaagtttttgttaattttcttttcttaaatgcatgtaattttctaatttattttgttgccacaccgaattactgaggcatccatctgttcttacagggaggtctcgttcacgttcgcgttcccgctctccccgttatcgtggtcgtccacggtcaaggtagaccaattatagttcctgtttactttttgttgctatatgtgattcctaagccattatcttcattcatgattctctcacttacatgttttctttaaaggtcatactctcctgctccaagacgacgagatgactattccgcatccccacagagaaaagacacacatcgtgcaaaatctcctaggcgtcagccaaaagaacatgaagtagacaagaagcggagatcctattctcctgccaataaagatggggaccggcgtgatgctgataatggttatgaaaagtaagttcgagtgcttcttacttccattgctctttgcaatgcaaaagttctgcattggtttgcttttctcgcctcaaaaatggttgaaagtagcatacgatagacttttagtgtatgatattccagtaaagattgaatggctgttgtgccttgctgttggattaggggaaagcattcgaatattttccgcatactcatgtagtcattttggtcgtatgtgcgttacttatgggatatatataaaaatataccccctccgtcccagaataacttaatctagtacctgtccagattcatagtactaggatatgtcgcatccagtattagattaacttaattctgggatggaggtagtacctacctcatgaaatgccttcttgggtttctggtcatacactgaaagcatttatattcacaggaggtcgccgccagctgacagcgatggatcccctccgcaccggaggtcccccaggcaatcctcaggatcgcctccaggatcccgctccaggtctgccgacgggtctcctgcccgcagtgactaacagaagaacactgcgcacgctgtgctacatcctctctagcttcttgttggtcagaccggaccagtttaagtaaaaacccttttgggcttgttgtaaaacttgtaatgctagcatctgtcgtggtttggtagcggaggacttggatcgtcaccattgtgtgtgctcgcttctcagtggatggagacattttgagtcgtgtgtgatgaaaccttagacttgctgcatggcattgtattgtgttaaacttatccgtatgccttgtgtattcttgtgcttgccatgtgctcatgcgcttgaattgctgtgcacgcggagtcgaactatgccgtcgacttcttttggaactcttttcgccttaaaatatactacctccgtcctaaaacatagcaatagcaatttttagctatgaatctgtagctaaaaatgcttacattttgggacggagggagtagtaaaatattattgaattagataacatattatcatgaatatagatgaaatatagcaaaatcttctaccctataattcaatgaatgcttttactcattcatcatgtaacacattcaatggttcaaaatcttataatctaacgcctcagaatcccccacgtctcctcctcccctccccgcacccatctcctcacgccgctctcgctttcgctcctctctctcccgcgtctcccactgcccagcgccgtatctcctcctcgcgctctctcgccctctcgccgtcgtgcgccggatttttgaaagaatcgacgcgctcctcctccacagttcgcgccacgcgcccctccgtaccacgaaaaatcgccgcgccacgcctcccccacatcgccgcgccggcacccaccatcgtcaccgccgcccattgctctccaccacgcccccattgcgccgacgccctccctctctttcaggtcgccgcccccgctgattccctcgcgattcccaaccctaaccaccgctaccgccgcccctgccgctcaggatccccccgcctctcctcctccccgccgccgacgctgtccccccgcctttcctccttctgcccacctgccaccgacgccgccacccctggcagtgactcctccccgacgccaatgccgattcccccgccgtcgatgcctactcctatggcagtgcggaggactgctgcttccctgcccccatcaggtgtgtgcacgatttgtgtttgttaaaatgcttatgtgaaaaagctgggggtataaatgatatgctgcagattatcttttcctgttataggttgatcaataatggtttccctaattcaactttcatattgctgaatcttttggtctacattgatagctgatgcattgtttgtcagaaacctgttgaatgggaggcaccatcataattatatgatccagcattatgaagtaaccatcaactgatctgagcgtgggggtaatttctaaccctcacctctgatgtttgatgaatttcattttcttttttgaccagatttcctatacaaatataatttcaaatgcttgagtatatagcatattgttgattggaaatataattcctgacaattgttggtcatttaaaaaatataacaaatatgctcaaactatagcctataaaaggcacaacagaagaattgatgtagctggaagaaaaataaaatcaccctctgctgctttgtcacgagataaccagtaattaaccatgcagccaaaaaacattgcatcgataacttgtcatgtgagcatatttactgtataatttgcacaaaaaattcatgcttcatctattggaaaaagaaaacccattagcattgatatagttcattgtttgcatatttgtcaaagcacaatatttatgtacactatcacttggagttgatcaactgtacatttgtttggatttgattagttttaagacattttaagcgaaatttatattttcctatagcaactgattgcaatttttcctgtcacattttacaagttttgactacagcatcatcggtgattatccattcccgtatcactgtgaacagctgctactgtccttcacaatctcattctctgaaggtacaaccagtttcttcactattcccttcttaactttgctagctatgggatccgatgttcttagatttttttcataatggcgttcctatttggattgtcaagttttcagaattttttagaatgggattcctatatttaccatgtatttttgaataagtgacgatgtttcttaggttttataagtgtgagtttatcactggtgatgatgttagtcatatgagcactgcactgttaatctgttatatgtactgtaaattggaaaatataaatttgtatcactgttacatgttaatatttatataaaattcgacatttgatacgcttgatgaaaagcatgcgcagaagcctttgagtgcacaacccgaacgatacccaattgataaaaagcatgtgcaacctgcaattgttcctgataaactctctattgttcatgaaagttatataaatcggatcaagcatataagcttgctcttgtctgatggtcatttaaacaaaaaatctcttgacatgattttataattgaatagtatcgtataagtttgaatgtacacgctgactgaaatttcaaaaagtatgagaacattttttgtttcttctgacagatgtaagtttgtttggagaacgggacattacgcgctgcctcctccatcgatgctgtgctgttccactgcctcaagcgtcaccgccacagtatgccccatcttggtctgctctgccaaaaggtacacaaatcctccgcccccacccctctcccattctctttattcccaatccctgctatgtctcctctatccctattagtacccgctgattgttgacatggagaccctctcccatataagcaaggagaccatctctccccaatcctattcaactttattgttgacatgttagctaccttgataaatagagccaaaacacaagggcaagtagatggtctcattccgcatttgattgatgggggactgtctatattacaatatgccgatgacacagttctttttatgaatcatgaccttgagaaagctcagaatatgaagtcggtgcttctagcctttgagcaattgtcgggtctgaagatcaattttcatagaagtgaactatattgttttggcgaaacgcttgagtatagagatcagtatgcccaactcttcggttgctaggttggcaattttccttttcgatatcttggcattccgatccattgtaggaagttaagaaatgcggaatggaaagaagtggtcgaaagatttgaaaagaaattaagtagctggaaaggaaaacttctttcgttgggagggcgacttacactgattaactcagtacttagtagtctcccaatgtatatgatgtcgttccttgcaatacctagtggggtacttaaaaaacttgattaccttcgatctaggttctattggcaaggggatggccataagaaaaaataccggcttgctaagtgggacatcatctgtcgtcccaaagatcaaagggggctgggaattcatgacctcgaggtaaagaatatagcgttacttagcaagttgcttaccacagacggaatgtggcaacagttgatacgtaataaatatttgggatcacaacctttatctcaggcttattggaaagcaggagactcacatttttgggctagtcttatgaaggccaaacaagatttttttcggtttgggtcttttcgtattagggacggctctcaaataaggttttgggaagataagtggttgggtaatgcctcgttgagagatcaatatccttgtctctataacatagttaggcataaacaatcgacaatatcacaaatctttcaaacgaaccctccaagcttttcatggagacgagatttaattggagcaaaattagctgcttggaataatctattgccttgcatagctgatttggtgttgacgcaagagcaagatgaatttcgctggaatctcacccccaatggggtcttctcggtcaattcacattacatagctcttgttcatacgggcgtcccgaatattaatagacgtatttgaaagattaaagtaccgctaaaagtaaaagttttcctttggtacttacgtcggggagtaattctaacaaaggataacctagctaggcgaaattggaaaggtagtaaaaaatgctgcttttgtcataaggatgaaaccattcaacatttgttcttccaatttcatctatctcgtttggtatggtccgttattcatatggcctctaactttcaacctcctcgaaatgttactcatatgtttgggcgttggcttttatgtgttcctaaagaaatgagaaatctgcttttgatgggtgcagcagctctttgttggtccattcagaaacggggttatttttgataacaagttagtgtcttctcctttacaggttattactctagttacccagtggctgcgtacctgggctatcctccacaaaccgggattgcgggatactattgcg

SEQ ID NO: 23959 - DNA, 942 bp, Oryza sativa
aacaaggggaatgctagaatgttgcgatggcacgctgaagagcgtcaacaggacggcatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaataggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcctcgattccttgcagcaaaccacccggtacggaagaaaagcaagcacttcgaacataaggccgaccaccgtacgaagcctaaacatcgcagcggaaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacataatgatctgaagcatatggaacaacgcg

SEQ ID NO: 23960 - DNA, 15246 bp, Oryza sativa
  unsure (1)..(15246): unsure at all n locations
cttccagacaatgtccgggcaacaataacaaaactatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgagtaacgagtcgatcaaccaacaacttgccttcctggcgaggggaccgtctgggtcgatcgcgacattccagggatatgagatcaatgggtacacattctacacgagagcccaagacatgaagagcacgaaccaaaacatcgctgttcgtgtcgatgccatgggacacgatggaacaactgccacgtattacggtgccatcgaggacatatgggaacttgactatgatcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgatgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatattactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatcttttctttactcccggttgggtgcgccctcgtcttcttcaccaacacttaaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgcatctcccttcatgcatctcgatctctccgatctcgatctctctccgtcgccttcgacgccgccgccttcgacgccgcgcaacgccgccgccgcatgccaacgccacgccgccgccgccgtcgccacgccgccgccgccttcgccgccgcgtgcgcaatgccgccgccgccacgccacgccgccgccgccacgccacgccacgccaccgccgccacgccacgccgccgccgccacggccccacaacgccacgccgccgccgccgtcgccacgctgccgcgccaaccgccgccccgatgccgccacaccgccgttaacgaacgagaacgagaacgatcgaacgaacgagagcgagaacgaacacgtgaacgtacgttgccgcgacaacgtgaacgagaacgagaacgatcgaacgaacgtgaacgagctagggaacgtgaacgagcgaacgaacgaggacgaacgttaacgtgaaatgcaatatatatatatatatatatacatgtatatatatatacatgtatatatatatatacatgtatatatatatatacatgtatatatatatatacatgtatatatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattaaacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttatataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgattaacagatgcagtggaagcctcctctcagggcacgttccgaccagacagagatagggacgagctgacactcgccctgcagactccagagcatccaggacgaactcgagggaaaggggtgattccttggaagattgctttcaaggaggacatccacacgtacaggagtcggatgaggagcaagagagataccgaggcgaagattgcagacctagagttcccggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccatctccacctcaggctccagcatcgactcctcaggatcctgcaccgactcctcctcgtgctcctacacctactcccccgcaagctcctcttccggcaccttcaaagtcaagggcccccccagctccaccgcttgcccacataagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcagggggtatgtctacatctgtcaaggaggccatcaagctatcggactatgagcgaacgctgaagaaagcatcttctggaaagtccaaaccagtccctcagcttggagagcaaccaaaccaggagatcgagccgttggtgaccagtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagttgtacatggagatgagcgccaccggtagagagatgatcggagcgaggattagggacacggacttcttgcaaggagatgacattctctggatcaatttcaggggaatctacgaactataccagctggacgccctcgacatctctattatgagttgctggattttgtaagtatatcgttcagttagatttcttactatacgtctcctttaattaattaggtccttgtatataagtagaccatagaaaataatatactcccttttatcgttgtaaaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaatttgtgcggctattacgtgtgcgagtattgccactgccttgcagaccaaatcatcaccacaagagagctcgatgtacgtacaaataaatttaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatatatatgtattgaaacatatgtatgcatatatatatgcatatatatattttttgcagcaacaggggcatgcaaaaaaaaaaaggtcagctctatctttagtcccggttggtaacaccaaccgggactaaagatggctcagccggccacgtggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgtttataggaatgaagtatatgaaaaacaaaggaaattttcatctactcaaatcacttgaagaaattcttatggattaacttgtgcatgtatttttattcctttatttttcttattcaaacaggttgatcttttttatgtttctatggattgaaattcctcccaatcgaacaagcccgaaatggatatcccaacccttaatcatcatactgatcgatctgatgcatgctcagaagttaagggtctcatcgattatcgaaaaacttattataagccgtaatgacttattagtgatcgaataataatttatgtaaaatttttatatatgtgttcctagcaagtaacgttaaaagctcatgtaaaaagaaactacgttaaaaatatcttaaaatcaactttagaattaaaattaagttttaaaattcaaatttcagctttagctttggctttttaggtaaccgatgagactctaaataccacacaagtatttatgtactctctctgtcttataaaatacaatatatatagtaggatgaatatccagatttacagtattaggatctattatgtcattggctatgatttatcatatttcgtattagatttgttttttataagatgaagaaaatatgttgctagcttgtcaaatactgcagcaggagcaccaaaacatatccggttccacacgtttgacctgccgggttattaaggcatgcatcgaagcgagtgcactagttagcgtgagcatccctctgcccagcaatcacagatccctatatttaagatttaaccgaatattaccactactagaagtacttgttttgaaaagctactacagtaaaaataatagtgagaatttgacatcatctataataataaatctgaataatctcatttctagtttcattatgttcgattatgttaaatcaccacgtagcttgtttgttttttatcagatgaagaaagtaactcagagtagcagtaatcatgcatggaacttttcgttccgtttcacgatcgccagtactcgaccaacacaggtattatataggtgcttgaatcttttgtagataaagattaaatgttttacacaaaaggaggtggtgataacgtgtaattaattaagttttaattattacaaacttgaaaaatagattaatatgatattttagagcaactttcatatagaaaattttggcacgaaacgtactgtttaaccgtttgaaaaacgtgtcacaattatccgaaattttattcaactctagttggataaaggagcgcagatgttacgtgtatgggtcggaagaaaacgatcgggaaatgatataatttctacataatactctccgtctatcgggaataattttacatatttattaatttaattatttagtggtgactttaatatgatgttgataaaaattagaaaaaatataagatttatatttggctagaattttgcgaaaatgattctcactaattaatatcgatcggtcgagaatttttgctaccattttcatccatgttactggctgtcccaatgcagggtagagccagaagtttttgaaaccctaggatcaaccaatataatttattacatctttaattattttcataattttcttaattaatttataagggattaaggagatatgcctagggctcaaatcctaattaatagccttaggctgcccttgtctcaatgtattatacatatttaatactctattatcaactatcaagcaaaaaagtatcggtcagaccgacggcaaccaggcggtcagaccgacaggacaacttcggttagaccgcgatccgtcgaattagagggaaacttttattttcgctaaaaattttcggtttttgggtataccaaccattcactcctctctggttggcttagttattgtgattcgatcctacaagaacctcaaatcttctcatgcactagccatggcttttttttcaacaaaataaacatcttgtgcacaatggcaaattgcatgtactccctccgtttcaggttataagacgttttaactttagttaaagtcaaactattttaagtttgactaattttgtagaaaaaagtagtaatatttttaacccaagactaatatattataaaattttattcaattatagatgtaatgaaactatgcttgtgttgtaaatattactacttttttatatagagttagtcaaacttagagtagtttgactttaattaaagtcaaaatgtcttataacctgaaatggagggagtatatatgatcgctacgtataaacaagcaacacgtaatctattgaatcttgaaattaatgtaggtctatttcaatcaacctttttttttcatgaatataggttatttagaacgtacagtcacattttatttcctttcttgtttgttatagccaagtaaattaaacaatatccaacataaaaatgactaccctttccaatacagaatataataaaaagaaacaaaagtcactgagctctttttttaattgttgcgcacatgtttaaaatgaagttatatatatatatatatatatatatatatatatatatatatatatatatatatatatatatatatatatatgaaggagtatatgtatacaaatatatatacttaataattacagaaaaataattttgagctgcttggaaagcatttttgcggttgtgcggctcatgactcatgagcggcggtccaaaaccgaaagccaagcttgcataacgaaagttatcgaagtctttttcaattaactctaaaaactaagttgcttcgaccactgacaaataagtgacattttagatacatgtagttaacatgtttaaactttgactacttatattataatatgagagactttgtccatatatacaactatatatgcatgagtgaaatcttatattttaggatagatacagtaatagaccttcgaataatttcaactcaacttctaaaattaatatggttatactcatatttgtttcaaaaaaagtacttgaaactaaaaaaattataattcttagatatgtttactggttttgtattagtaattaacaaccaaacaaggtgtgagcagtaattcataatgaattatccagcagcagtagtagtgtatataaataaaatagcataaatccctggaagtcaggtcccggccgggatagaagccgcagctagctgctgatgagcgcgcggcgcgcgcacgtgcacccgcgcaggccacctcccggactttgaggcctcctgccgcttcctcccatcgccatccaccgcgacaaatcgatctctctctctctcccgatcgacgtaatgtaatattcctacaaattaattcctcttcctcatatttgtctgaggaaattaatcttcctaccaattaattccttcttcctactaccttcgtcagaacaaaattaatctagtatggaatgtgatatttctaatacaacgattttagacaaacacatatgttcaaacttataatagtaggaaataccacattccatattagattaacttatttcgggacggaagaagtatttcttctatttttttaataaaaggaaaattagtcttccataaattaattaattccttcaacgtaccgcgtacacatcccgtgtaatgtccactgcacgtacacgctcaatacccatcttttccggtggccggccggccggccgcgggcgacggcggcggcggcggcatatgatcaatcgttatcgatgtcgaccaacggcgccggccgccgactgcatgccagcttgggaccagcgggccggccggtatggagcgacggtgtggcacgtcggcgccggcgatcgaagacatgtcgccgcacagccggagcacggccggaaaatacatagctggctacatgtgtatagagctagtggcatgcagcagaatatatacgtgagtttactcaatgaaccagactgatgatcatgcgtgcaagttggagagactaattggagatggtgccgagatcgacaagtattttacgtagagttaatttttcgcatttctacggagggagagagatcagtaacttagggtgtctagttcacgttaaaattgaaagtttggttgaaattgaaacgatgtagtgaaaaagttagaattttgtatgggtagaaaagttttgatgtgatagaaaagttgcaagtttaaagaaaaagtttggaagtaaactcggccttaattatattattgcgatcgatcgacttggtaactaatgcataagtcaacggctagcttaactcacaagcaagcttacgattcaatgctagctcgatcatccaaaagtgatagctgatcgatcgaacccatatgtttttaatttttttctgtaccgattgaaaatatacgtccaaatctaatttgattaaagttcattcaaacttttcaatctaatcaggaaattctattctaaacacagtcgaatagaaattttaggatgatttttattgattgttgaatgaatttacctagagttttcgttatttgttatctaataaaccatactaatattagcctcactacggtgctctctactagtagaaaacaatataaaccattgatcatttgatcgaagagtttaaatctatttatactaccatctagttagcggtagtagagacatggagggatattattgtaaaaaaaaaggtgtggggagatataattgtcatttagcagtgactaaacttttttttttcctttttttggctttttcgatgaaatacgagtgatgctagcgcaatggatgatatatcgatttagctaggaaaaaacataaatgacaaagtaattcttaatcattgtattagtaaattactaatttacccctaataatacgtactagtgatataatactataaatagagagcaccggagtataatatatagtactcctatgctaccccaactactggtatagtacgtacaatttataaatcaacaatcaattaagatcattttattctactatactagctactccatccgtctcaaatataagtattttagctataaatgctagacaactatgtgtctagattcataaataaaagttgttatattttgggacggaggtagtagtagttaggctaccataaaagctcttccaaagataaacttatagccaaaatatatagggaaagagtaccaagggtggtctctatgggtattatagctagtagaagtgacttcaacattcttactatatgtaaataaaaaagaaattctattaccaataattgagatgaaagtataattagatatgatccattagattagaaaagataaatggtatagatttatttctactaccactagagatcattgtaaaacacctcatatgagaaaatagttaatatctggcaacacaaaccaattaagcagtacacacttagttagaaaccgaatatgatgtgtggcatttgttggaattaagctagcttaatggctaggttaattttgaggtatcttcaaccaactcacgagggttcaaatgctaaatttttttccatgcattttgatgcctatgacaatattcaggcatgtgtagagaatcgatgtgtatgagtgtgtgtagtagctataatacggtgcatttatttacatatttatatgtatccaattgtacttaaaaaatcgatgtggcatttatcattcaacggatgacaaattaaaatgggtttttaattgtcacatgaccccccatttaattcacaagaagtcaaatatcaggtttgaatataatttcagatcgtatcacacgcgcgctaaccgcaatgtttgaaccatcacaagatctctacttgggataagtaaattattatgagtgataaccaatgcaaaagttgaatcctcacttgaaacaataacaaattactagtagcctttaggaatagataatgaacaacatgtagggaatagaagagagaatagaaatggaatatggaataatggaatgcagggcttaattccctgactcccacaaggctggtcaaaggatgatctaaagttgttttagtttatttatgaactatatataaaactttacacatgcatgcgcatggaccatcatatcatatagaacctaacgtcttctcctttcaaggaataaatccaaacctatttggctagctctctgtcagttgtcacgcacaataaaacaaattaagcttcaagaaaatatatactacattgcacgtagcaattaatgatctctagagagggcatatatgcaaaaaaagatcatcactatttgcagatggagacatgtcattgctccttatgaggccatttttgtggccggtgcgtcccctggtccaaagacaacgctcctcctttcctttagtccttccaaaaccggccatgaccaatgcaaacacactgtcactgactgaccatgcacaaatcaaatcattattcacaacagctaatctccatcactctccctacatgccatagtactactttatataaccccatgtcatgtcctttgggtgagcatctcaaatcagatcatctcaagttcccaaaccctagctatctctgctggtctcccccaagctctcctttatataacacaaactacatcatctcctttctcttgtgtgcaacatcacaaacacaacctttcactcccatcttggctttctttcctgtctctagcttagctacctgttgcttccaagctgagaaaaaccaagcaaaagaagctgtttgtgtgcctttccaaggtatagatttgcatgcatatacactttatcctgtccagttagaaacttatataaggacttgtaagtttctttactgaattaaggttaagtaaacttgctaaatgcatgagttttctgatgcattgtgaatttgtgggtatttctcagagtgaaaaaaaaaatgcatcctaatggcgcgccgctggccgtgccaccgggtttccggttccatccgacggacgaggaattgctctactactacctgaggaagaaggttgcttatgaggccatagatctcgacgtcatcagggagattgacctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23961 - DNA, 751 bp, Oryza sativa
ggtgctaccaaccgggactaaagtcccacccctatatatatgtcttcttcctcctccagctgcccgagcaagcttcaaaatttcttcaaaaaagaggggaggtcatgccaaagtttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatacaggactattcatttccacttg

SEQ ID NO: 23962 - DNA, 23753 bp, Oryza sativa
ttgttgacatgaatgtgaggctttgcactcgtgtggttgtggatggagacaaacgggattgagggaacaagagcaactaaccaataagctcggataccatattagactagagatatggtgcacactgatgcatagtatttgatgaaaatagtttgtggaatgtatcagcccaggctatcaaccggcctaccagctctgagagtttgatgaacacataaaaaaatgaagaaatatagggaagtgctttgagcatatatttttaccattgtaacatacccaccaaaaattttatgggctcacgatgccataaaaaaaaccttgtaatatcttaaattctgaaaagaaaactatttaagtaaaaggttctaagtgtctagaagtgaaataaaagaatttcatgacatcacactaagtgatggatgatgagtcaaatcatggaaaggtctctatccaccaaaaaataaatgtttacccccagcactgcatagtaatttagaagagaaaaataagcaaattaacaaaagcagcaaaacaaaggggctacccaagacagaaaacttccacaagagacaggaggctctcaacagcaagacttcaggaagacaataaatggttaaatgatgtatcagcctttgtacattcgaccagtcactgccttcagtggtgtcattgaggacatgacagcaataacagacgaaaataagggtgatgataagggacaagcagtagcagaggtggctcaaaaaatggcagaccaccaccactgaattaaaatgagcaccccagaaactacgatggggcagggtaaggtgaatgggatgaatgcttggtcacaggtagtgctggcccatctaatcccagcacaagaacgatcatgggccctctatgcagttaaggtcagtttttctgattcccccttgcaaaactgacagtcagacagcctgtggtcactagcgatattaatttttagaagtctttgacataaaaatgatatcactctataagttgatatgaataacatatgagctttcatgaacccccccatatcttgtattaatacaacaaaacaatcaaatgagttgataggtaaaatgtaactgagaattagtaaccttaccacaaaatgtaactgaagttgttaccatcatgtcagtataaggtagcttgaccttgacttgaagggtgatatcggacaagagtatcattatatctccttgcatcttaaattttgcccagagaaacttctcgactgcaaggttacgatatcaataagaacaagtagttaatgttgtaaggttcaaccctttcattgtatataaaagtattaaaccactttaagagtagctatcacataagggacatactcatatatccaagtattttgtaggcatgtgtccacctcataaggcagctccatgttcacaactatttcaacttaaaaacgaatgcaaattttaattttgtgcattatatttgactatgtactgtggttggcgtatcttataatcactctgttcacatgtgtacatcagcgcaatcaaacttcactcaagatttaattgtgaagattccattaaatgactatacagaaatcggaggtctgttatgtattggagagcatgcactgtcatgcatttaacaattatacaaaacaacaaaaaaagttataccataaaaagttaaatgaatggaactttttaacaaatgtcatgttctgcatgtatctaattggatgcatgctcaaaaaggaacacagtttcattgaagccataactgatggaaacaattaaaaaaaggataaagacaattttgtatcattactgagtttatggaacataagacagaaatgtcaacaggaagagaccaaacacaacatccggttccatagtgtagtggttagcactccagactttgaatctggcaacctgggttcaaatcccggtggaaccttcttttttttttttggtattcccatactactcaaatgggatagtcaattacttgcaggaccaatatatgaaacatgagttgtttttattaatagaatagtttagtcatgagagtgcataaataacaaatgcactgttttgaattaaacgtgcatgtttctagtatatgtgcatggctagttgatctctgcaataaataattgtttgcttgcaatacatgcatattagcataaagtcgagaaaatagcatttacagatcatggtaaatagggtatagcctcatgaataacagcaacaaagaatactgacacctggcattcccacaaataggttaactatttctagagagcctcagcttattttattttggtaactcgtaggagttgtccctagaacattatagtatagggtgtaaccataatgtgactacattccagtcaaacttgatgtgtgactccattcagatactaattcattcatttgtcttcatgattttttttcttactgcttagaaataagagtgatcttaaaaatcattacacactacagtgcctttcagcttcaaaagggcagaacccaaatagacttatgcatagagctcagcagcatggtcaatcctaaactggaaatatcacgtctatgccaagccaaagaagtcagcaaaactaacttcatgttatgtttcataccaggagaaaaccataacctaggtcagttcgttcgctttacttcctgatttcggaaattcattgtaagactatcacacaggatccacaaaacaagaaaaattaaccattacaagaatacatgagcatatgagaaaaagagaataaatgcaaccaaatgactgccgcgtgcctgtgtcatgtaagttaatcctttcatcaagagagaataaaacaaccgttgcaaggacctactagtaatttatcgcttcacacttcaataaaataaatatatttggcagtatgcagaattaatttatttaatcacctctattgacttgaaaagtaaaatctgcggtgctaaagagtaaacagaaagcagcaggatgtccaaaaatacacacgtcatcgattatcacaacactagaaacaagatcccgcccgagaatgcaagagtccccatacgctctaggcacgcataagagggatacggatacctccctcagcgaggagcggagcggcgacagagatctctacacacctggatgcgcctcgatcagaagccctaacaggtggacgtgccggaggcatggggaggctgctgcggcgccaattgtggccacggccatgggtgagagaaggagaggagagggtttagggcttggatgcggcggcgatggcgagacggagaagtggggaattctcgacgagacgaggaggggaagagatgagatcggacagggtaaatgggcttcatgggccgcctgagtaagtaagtagttgggccgtcgagctctctctctgctcggcgcgtcggcatcggttcgtcggcaaatggcggcgccagcctacgtgtcctctcgccggcgaatcccacatcctcgctgaccaacgtgtcatcccctcgtgcacacgtgtcaaacccgaaccgcttaagctccaatattttaagcctcccgccgcaacgctgtcccgatcatgtacagcgacccgatcactctctcactgtctcgttcacgtagctcacctgctcgacacaatggcgtcgcagcagcagcagaagcagccgaggaaggcgaagcagaaggaaggggaagggcactcggcggaggaggcggcggggctggaggagatcggcaggtatcgcgcccaggcgcagcagaactcgatggacgccatccgcgacgccgaggagcggtacgccaaggctaaccgggagcacggcggcgcgacgcgggcgcccggcgccaccgtggtgtcgtgcgtggagcgcaagaaggagcagccgccgccgccgccgcagcacgggaagaagcacgaggcggcggaggagggacacggaggcggcaaggcggagaccggcggccaggagggggtgaccgccaagaaccgcggcgaggggcggcagcagcatggcgagccggacgccgccggcgctgctgcccgggagaagagtgctggcgccacgcacggcgccaagcaggccggctcgaccgcggccacgcgcgccgcggactacgccgcggccaagggcaccgaggccaaagacgccggcgcgcacgccgcgcaggccgcgacggagaaggcgaaggtggccgcggggacggccaccgactacgccagacaggccgccgcgaaggcgaaggatgtcacgctcagcaccggcgggacggcggcggagaagaccaaggacgtcgcgctgagcaccggcgggacggccagcgagtacgcgaagcaggcggcggtgaaggggaaggacgtcacgctcagcgccggcgagacggcggcggagcacgccaaggcggccgcggagaaggccagggacgccgcggtggccgccggcaggacgacggccgagtacacccagcaggcggccgtgaaggccaaggacgtgacgctctccaccggcgcgacggtggcgcagaaggccaaggaggtgaccgccgacaccgcgcacaaggtggcggagtacgcgcgggagaaggcggagcaagggaaggaggccgcggcccgcgccgccgacggcgcggaggagccgagctccgggacggcggacaaggccggcgacatggccggacaaaccaaagacacgacgagcgacacaacgggaggcatggcgcacaaggccggtgccatggcggcgcagaccaaggacacagtgaaggacgcagccgcagccatggcgcagaagacgagcgacacgatcgctcaggcagggcacggagcaggtgaagcaaagaaccgagcggcagagtccggcaagaactcatcggcgaccaccaccatcggcagcggcggcggcggcgacggcgacgacacgacggtggtgggcgacgtgctggaggcggtgggcgcgacggtgtacgggatagcgaagcacacgaaggggatcgtcgccggcgaggaggagctcgtccccgtcaccaaggaagaagacaagggcaagctcgagtgagcgagcgagcttgcttcactgtagtggcaagctccccgactgtgtcacgtactgcgtactttagttgattaggagtttaagtatatagtgtttgcgaataatgtttcctgtatttagtgttaatcacggatccacggctgtgtatatatatgttacaatccgcagatgtgtgaaataaacttgataattagtctatcagtctgattggttacatattactcatccaatgaacacgcccccgcgtcgtctcccgtgggcgactcgggcgtcgaaacctagccgccgccgccgcccctctccaccctcctctctgcctcgccgccgcctgagcaagtggccggcaaagccggcggctcgcgaggacggcggcggcggggctcgcggcggcggccacccccggttccggcgcgggcggacctaaaggtggagctggccggatcagcgtcggcgtcgagttgggcgcatgggagaaggtggaggcagggaaggacgaagccggcgacctctctttggcgggcactcggggaggggagcgccaatgacggggcggcggtggccgccagatccgggctgctccggccggatctggcggggtggcggcggggagagcggggagggcggggagggcggcagcaacagtggcggggagggcgacggcaaaggcaggcgcgtgcgcgccggccgatggtgcttgcaggcgtcgatcgatggtgcttgcaggcggcggggatggcgttggcagagggcgcgaaggcggctgcggtggtccctacgcggcgacggagcggtgctcagcggcgacggcggcggtctccctcagatctgcgcctcttggccggatttggagggtggccggcggtggtagtcggcgacggcggttgacttgcgacggctggtaacagcagttggcaacggcagcgacggtggtggtcgcggcagttggcggcgacggtgtcggctaacgacgccgatggaggacttggcggcgacgtggcggacggtgacagcgaagcggccgctggcagtggcggctgttcgcggaggcggtggctggcgttggtggcagcggcgacagcggctgacttgcggcggctgtgactgtggaggcgctggcgatgtcggcggatgtgggtcgctggtggcagcaagtggaggtgcgcggtgaggatagcgacggcgaggtggctaggcgttcaacaacagcggctgtggtggtggtggccgtgatcgcggtcaccggaggcatggcggcctcagacagccgagggagtgggagacggctacatttggtcggcgcggcatcgtctggtggagggtcggagaccggcttggcgcagagaggcgtagccgatggcggcggaggccggctcggcgcgagaggcgcgggcggcggagatggaggccggcttggcgcaagaggcgcggccgatggagggaggccggattggcgcgagagacgcgtccggtggaggaggccggcttggcgcgagaggcgcggccggcggtggaggaggcgacctaggtgtgaggaggagctgccggtgggtgtggcgcgatcttcggcgctcgaaggctagccggcgggggacaccggtgcaggggtcccacaggtcggtagagcttgtgtggtggtggggcatcggtgcggcagtcgtggatttgcaggatctcgtctgggtccctttgttggtctagtggcggtcggtcacgcttagcggcggccggtccggtcctagccttctcctgggcttgtgtgttggcgacgtcggtgtgggtggtggtttatttttcctttttcctggttacgaccctccagattgtaatcttgtaatttttttctactctatcaatagaacttcgcaccgtctcgtgcgagtcgttaaaaaaaaatgatggtactgggaacagatcacaggttgcaacgacaaatttatcttatacatagcaaaataatcccaagagattgacatgtgcgcatagtaaagatgatgtcgttttaaacaaccataatttggatggatgtacattcataaccaagtggcagtggcagtggcagaatttgttggtaggaatacctgaagaagagattagtttcccgtttttttgacaaattgacccttttcaaaaacttaattcgaaactaaccactgccaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtagtgaagggtaggtaatttgtaggagtagagttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtgtgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagaccttaatgaaagtcaactcatagaatcacccattagctgtcacgaactgtcggagaggtgtagtaggaaggaagaattgattgaggaaaacgtggaggggggcgagggagtaaatgatatggcggatgtggaggtcagggaagagaatgacccggtaagggaggaagtacatgcagaggagaatgtgccgttaagggaagaagtacatgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtagcacacaggtgggattggatgacattcattgctaagttcatattgttgcttcaatgtttactttctgttgtccctcctttccgttctcattgtgattgttccatttaatattttttcaattactaatgattccattttcatttgcaggatggagcactttccggggttggaggatttctacgaggagaagcaccgggccccacagattgccagcggagaggttagcatcaacaatattccatttttttatgatcgaatttattttttcttctttgattttagtttgtacagatagatcatccatcatagagataactcaaatcaaagttcaggagcctcaaagcagagcatgtaaacacacagatcttcttttcagttttcttgctcaatcccaaaattaaagttcctagttgcatgatgtattttccacaacccttgtatatgatatattgtcgctaactttatgttattatgtttgtctattgatgcagcgcttgaagacccttcgagtcagaggtcacacggcgcacatactgttcgacgaccggtacgtcccgtacctacggcgggcgcagctcttggcgttcgtgaccatggcgcagcgaccggtgcctctgtacaacgccgctgctctgacggccctagtggaccggtggcgtccagagacacacaccttccacctaccgtgcggggagctgacggtcactctggaggacgtcgccatgatcctgggtcttcctatccggggtcaggcggtcacaggtgacacagcgtcagggaattactaacgagtcttcgtattcatttgttaatttttttgcaattactaatgattccatttaatttccggttacaggtgacacagcgtcggggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatactgcagggcgtacgtgctgtacatcttcggcagtattctgttccctgactctggtggagacatggcttcttggatgtggctgctgttgcttgcggactgggacgaggcgggtaccttcagctgggggtcggctgccctagcctggttgtaccggcaactctgtgatgcttgccgaaggcaaggcggggacgcgaacctagcaggctgtgtttggttgctacaggtaagttcacgcatgttatgtttcataacatttcaatttcttgctaacatgttggaagctaacgtatgtgacgcaggtttggatgtggatgaggcttccagttggtcggcccatgtggaggacccatcaggcttggccacaccaggatgcagaccgacgtcccactgtagctcacctgtgggaatcggtcccatctccagtagtaggccgcaggaatttggcgtactaccactacacaaacgagatggactacctacagccagaacatgtaagctattcggggttctatcacacatgaagatggtttcttactatatagtactaaatgtgcttcaatgtgttttatttttgttgctgcaggtggtgtggatgccatatcaggcacaggaagtgctcaagctagaactgaatcccatgtgccatatagaggatgcgttgaagaccctacggtgcccactgatctgcttctatgcagtggagttccagatgtgccaccgcgtgatgcggcaattcgggaggcttcaaacaatcccgcaccgtttctccacgagtatcgacctacacaagttagtaatttcacttaacaatttattttgcttgcccaatcagtcacttcaacatttactacatatttgagttggacattttgcatacgtgcagggtggaccgtcggaagaacaagaaggtgactgattgggcttactaccatcaggatcatatcacgcaatgggagaagttcgaggagaatggagtaccagaccagggtcagcacaacgggacggagttcgacttgtacttggcgtggctccacaggacctaccgtcttgtcctacgtccggcttggacactagccgacatagcggatgaccccgaggatgttgaggagcagaacaagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctctgaaggagagggcggcaccctccgcaacgccctacaggtaatcgttggaaagagatgaaactacggtgttttcttccaaaagcgataacttaacatggattattttttatgcagagactacggcagcgatgtcggaagttggcagcaaggctcggctgcaggtcgactgatgtggtcgaacatgctcatgcccaccaagagggggatgaagaaggggaggtgggtgacgaggagggcgagcaagacaaagaggcggaggaaggagatgaggaggaagaaggggatgaggacagagaagaggaggcggatgagctcggtccctcgcagctagaggacgcaccagagtcgtcacagccggatatctcgcagcccggcccgtctcgaccacgacgccggcgggctccttcgcaggactggaggtacacccccgacgtgcctcgtcctcgcactagaggtaggaggaggtgagtgcatggttcaatggatggatggatagatggatggacttgatgcatggttcgatggatgtatggactggatgtatggactcgactggatgtatagacgaggatcgatgggatgtttttatttcttatatatatggacttcatatatggatgtattgatggattctatggatgtatggaatgatgttgggattgatggatggatgtatgttttgtatggttctctggatatattgctgcctgtaaatttctgtgatttgatgtttgcctgtgttgtgtgcaaagttttactaaagtttagcagggctgggacgtcagcgccatgctaaatggcgctgacatgtccaaactcaacgccagtgcagaggtcccagcccagccatccagaaggcttgctgggctgggccacggccgaaacggccaagtccaacctcagcgccaggtgggctggcgctgagtgtcgcacggtcagcgccattatggctggcgctgaggtccaagcccgcaagccatccagaagccttgcttgtctgggccttgggggttgcggccaagtcccacctcagcgccagtccggttggcgctgaggtagctgccacgtcagctggggatcggcccggccgccacggtggcacaatgtcagcgccagtcccgttggcgctgacacggccaacgtcagcgccaatgtgtttggcgctgaggcgacggcctatttttggatgaagtttttggcaggggttagtttcgaaataagttttccaaaagggtcaatttgtcaaaaaacctgctagttatgtggaaattcagttccaggtattgcatacatttttgttaatcgattggtgctaatgaactgccgtgtcctaattcctaaaagcctaaaattaatatatgatggaaattcagttccagatgatgcatacatttgttaatcaattgaagctaatcaactgctgtgtgacgagattacttgtgaggatatgaacatgcatgaggggatagatggcagatcgcatatgcatggcaaaaacatgcatatgattgttcatctgtatccacccatggggacttaactagattggaaggtaattaaccctgtcacatgaactactttgaatccttctttgaattgaaattcaggaaactattaccccttcgcaggtacgtatatagagctgatgctgatgctgcaacagctaattatactccgtttgttaatgaccgcgatccatacctgaatctgaatttctgtggaatttgcaggattcaaaatgtctttttatatatataaaaaaaaggactatgtttccgaatgctcagacattatcttctgcaacttagctattcattattcatgcagcgatcatgttgtgcaacgtagttacatgtggtgctcgtattttgggagtttgcgaccaatgtatatgcaatcaagttaattatagtttctgtagcactgcaattatcatttgttttgcgcgcgcatgtgaaatttgggcgaaaatggatccttgttttggggagaacattttggatcctcatttctcatctagctgtataaaatggattcgatattgcagctagcttgcaagccataatctgtctcatgtgtatatatgctcccaataccagaactggattgagtcatatctaactgattagatcgatagattgttacatacgtatgtcaaaaaaaaactcatgatcaataagcagagatgattaagtaggtagaagaacaaggagactgacttacatggatcatccgacgatgattaattttaattccatcctcttccaaatctcctcttggaggttcgattgagttggaattggagttcttctgtgcgcgactgaagttatctgcctctttatacaacgtaacacaacagtctcaccacccttcaaaaccaagagctttaactgtagagtaaatttcagtttgggctaggtattttgaccatgtttacaacctggactagggataagttgatgttttcacttaacaccatatatgttggcaagctttttcactttggaccggagtgaagggtttgaactgccactgtggctctgtccatggcatgccatcactactagaaaactgatctttactcggtcgtcccaaaactgatctttagtcccggtttaaaaccccacatccattctacgttaccaacccctgtcggtcccttgtcagaggggcggggatctttagtcccggttggtgtcacaaaccgggactaaagatcaccactactaaaatctcctagatctttactcccggtattactaaccgagattaaaatcacgtgtagtatataatccctattccctatcctctcaccaacaaccggcctcaatctcctcaacaaccggcctctcctcagatccatctccctctcttcttcctcctcccatccctaccctctcctccccctcctcccttcgcatccgatgcccagcaatgaccgcctcctccccctcctcccttccggtgcccagcggggccgcacccggtagggccgcaagcagcaggcgctgggcacgggccgagtagcgagcggcggcaggcggcgctaccggcatccattattttttctctttttttttacaatttgtgattcactgagattttacaatttgtgattcactgagatgtataattttgtgatttgttgtatggatctgagatgtataatatgtgatgtatttggtttgtgtataatttttttaagatttgtgatgtatttgatttgtgtgtacaagtaacttaagatttgtgatgtgaatgttttgggatgttgggtttgatttggaatatgcatcccacttgatttgggagaaaatacagggattaaactctggctaaaaaaaaacaatgaaaaaaaaagaaaaggagacctaatgggactgccgctaccctctcttaggtatctttagtcccggttatttcaatcgggactaaatatggacatctttagttccgcattgctagtctcggttggaaaaccgggactaaagtagtcccggattgctagtcccggttgaaaaaccgggattaaaaagattggaatcgggactaaagaggggttaccaaccgagagtataaatggtttctccacccgtgcatgcaagcagcaggtggtggactccacgtcttcacctccgttctgcattgccatcttcgatcttccttgggatcgatctagtaaatcgacagctctaattaattaaaaagtttatagtaagaataatgtcaagcaactctgtggtcaacatcagtcaccagcgcggcggtacaggtcatcgaaaccctcatcagcttcatctggcagtttgactttgtcagtttcatcaatggagaacatctcgcatgatgctaggattgaaaagaggagggagtcacgggtactttattttatggtttcttagggagattgttaattttgggttaagcttgattgattttgtgcaaaattagctattgctccgttgcgattgctgcgttagttataggtataagtgaagtaatttatgcgcatttggagaagcaacatagcagtctaaaccattgacccggtgcaaaatgcaaaagcttgcaaatatatatggtgttaaatgaaaacatagttctatccctagtccatgttgcaagtatggtcaaaatacatgccccaaagtgaaatttactcttaactgtatagtactaataagagaaatcagatcctatggtttcctagtttttgaattttaagttaaatgttatgagttttatcatagtaagatggatttatttctcacaaacccccctccccttaaaaaaggtaaatttcacttaattaattctagatattgtggtctaagttgaataaaatcatagcaattttagcacgtgacacttaacctcgtgtattatggttgtaaaattttacaaaatcatactattgttcattttggcattgatccaccatacttttaagttctacgatcacatcttaaatttatgaattttttttatccataatataaatgttacatgcacatatgtaaaacttttcaaagagtttatataggggtatataaaattggttaacagtacctggggttatgtaccatgtgctaaaatggagaaataaatcttaagggttttatgaaattttatgcaacttggatcataatatgtaaggttttatgaaatttactaaaaaaaatctgccagtatgctgttgcatttttacttttaaatgtgtgagttggcttgaaaatgtttacatgagttttttttggcacaattattccaataatatcatattcttcaattgccatgacccatgagtacaatagaaagcacaagtgaggaccagtagggcagtaggacaatatactgtactagtacatgtagtataacaattgcgttcttttggacagatcgtaagtaactagtgcactagtacgaccatgtgcgattctgaaacacgagatgtgaacttgtgaagtaactcttctggaatctgaagtttgtcctttgtctctcgtttgtcctaatgctcaatgtttaaacgaatcttttttcccttaagaagtactaatgcaatctggaattttcttcagttaacttggatgtacttgcttcagtaatcactcctactagtaccaaaggaaatttctttgcttttcgatatcttttgatatctccattgacagctcatacttcaaaacttatagggatacactgacaacaaaaaggagaaaacaaaccagggttcgtcagttcgtgggctgctaaaaataagtgcgaatcacatggcaagcaacgtacaacgcaataataaaaatagattcttcagatcagttcattagtttcaactcccacctgcatgcactgttctgaattctgcatccatcactgccaattgtatattcaggattcttctcccgttacctcgccatgttcagttcaattagcactagtaaccctcaccttctgctaattgtttgcagctaaaatgcaccaaaaataaactttcaggcagagctcattttctgtacaagaacgcagcaacatgttcagacaaaagctgctgctaagaacagggcagatttgaaccagggaaaccggagatactcaaaaagacaatttgtatcatatttccggaggcaatttacacaatcatgtgtctgttacattttcatagttatgtcgcctgacaaataaacaaaatcaagcttttgacagccctattccacctttgtacctgactgcaatgaatgtaatagaatgaaaatatacatgtatgcaaccttggaaccatatggaagaactactttccctgctccatttcagtgcactatcgtgatacacctctacaattacaacggaagaagtgactttctcatgaagattggaagatcggttggtcagcgaaaggaccatatacccaacctctggcaatgtgaccgtaagccgcctctgtcaggtgaatgccatcccagctccaatgggttgatggatcatcacacgcggttgcaccagcctcaccacatttggctgtgacattgaagttgtaagcggccttcgcaacggacccaggagccccgcagcatgccctaggtagctgcttgtaaaatcctgaattgaaaaggcaagaacgttagatgttttcaatttttaatcaacaataatgcatctgaatcctttttcttcaccagttgagacagaaacagtctctattagcagaattaaatgggccaaagatgtgtttgttgctaccacacacaatgaaagagaaatgctagcggatgtgatctagagatgacaaggccattgaaccgtgatgcccaacttggccattaaactatgcagaagatttcataactctacctgctgatgctccctctaattaaaaagcactaactacaaagcataaaaaaggtcattgccagcaaggtaagcaagcattagataacagaagtggatcaccaaaaaggatggctcagctaacagagcaattcctacatgtctgtactccccgcaacaaggacatgttgaaatttgtgatacacacgatggttggaaaaaggtaaaaaggttaggtagggaaaacgtgccaatgtgtcattttatttatttgtggtgttttcaagccactgctattcgaattaaactcacgaggataatatacacccactcgaacccatgtgcgaggttttaaaagaatcggtggcaaaatatgtatggagacaatcaaaatgtggcagttttgaaactgaactagatcatatcaaacaagagcagagctgccacaaccataattttaaagtaggtgacagtatggctaaggttcaaagcttttttacatggttgcctggagaaacaagttgggcagcctgtgtatgtagcttgtataacaatcagaccatcagacaatcctaattgttagccccacattacctatcatgggtggaatctcattatagttcaggatggccccctctctcaagaagacaattaacaacaggacaaggtttgaacaaagagtggtagagtactaatagaactgatagccatactactttacagactagtgtaaaagattctaatgaagatgggattagtaactttgcttccaatttactctgaacatagatggagctactctaattggtttcaaatcacaaattgtgatccatcattactgtaatttgaaatattgcagtgtgctactagagagataaggcacctctacccagatctgaactatctaaaaataatatattgtgtctttcaagggtgacaggaggaaaagttgactctaggtatcagttgacttgatctgttcaagtaaattagagcagcaagagctaaaaaacagttattttgctagaaaagccaatttagtaccgatgtgaaataaaggataagaacgaactgatgcttcctgagctagctaactatcaaagagctcaagaacttaccaaacttctcgggctgaagcatgaactggataacaggcgtgtagtaatcgccatatatgatcctcacattggggtgcttgggccggagcttctcaagcatgcgcttgagatgtgcattgtgcacccatgagaatgtgttgtaccgacggacgcagccgctctgggggccatacccatcggccggctcatcgagcatgttcaagtagacagggaagcatccagtgggcatcacaccgggtacaatcagctcccttgcgccctcagcaatcaattgctgcaccaaacacgaacagttgtataattgaaatcacattctccacatgaccactaacaaataggcgacacaacgaagctattgaatttctacctcgatgccatcggagatagcctggatgacatccggcatgaacttgtaggcctcctcaaggcccttccccgcaaacagcggcgcattgtagtcgttgccaccaaactcgccgacgacgaagagcgaattcgcatagaattcatcgcattccactgcaaaaacatcaaaacaatcagatacaattccccaatccagttctctctggagataaaaacaaaaacaaatccccaaattcagtgaggcgaggtagctacaaggtaaggtggggatttgggcatatgcaatttatgattatacccttggtggagttgcagaagaagggcttgagatcgcggaaccactggatttgggtgaggagggcgccggagttccagacgacggcgccgagccccttggcctcgaagtagggggtgtcgagcgcggtggcgccggtgatggcgaagttggcgccgtgagcgaagctggagttcttgagcttggacggcggcagcagcggcaggccgaactcgtcggctgcgatccaaaccaaaaaaccaaaccatcagcaacacaaagcaggcagacatcgaaatccaatctagcggagaaaccaaggggcgcaccgaggtggtcgacgacgaggcggccgtcggagcagcggccggtggggtggccggggaaggtctggccgtaggggagctgggcggtagcgaggcggaagtcgacgccgttggcgaggaggttgccggcgtcggccagcgagtccccgaagttgaacagcgccctgtacttccccttcgccttcccgttcaccttcccctccgccgccccagcaagaatcgccgccaccgcaagaaccaccgccacgaccaaaatcccccgaactgcccccatcgccgcccgccctatccctcctccgttcttgggtcaaacccaccaccacaagaagagggaagaagaagaagaagaggaagagagaggggtagcggctaggtaggtgtccggggtgggggtgagggggttcttcttgtagctaggagcacgaggagagagagagagagagattgggatgggttggtggtggtggcgtggcgcacggcggcttagctctctctctctctcgctctcgggtcgcgtggcgttttcttctcgcgagctagctgccgcggctgcgcggtggcggatggcgattagtttactctcgggctctctcgcggcttggggagtaattgcgatttgggattgggagggggaggagtggggaagaagaggggaggaggcgaagagaggaggaaggtgagaaggaaggaaggaagctgggggcaggctgtccggtgtggaggaggtgggggattcgacggcacgtatgtgtgagaaatggaggaaaaagtgggctacacggttggactttgggggcgtatttcgggcagggtttgttggactcgagctagatgaagagagcgtgtttggagtcaaagtttttggtctgggtaatttggcagtgttagatcaaattggggagtggagagtgtgtgactaatggtgggtctagttcacactaaaattagaagtttggctgaaattagaacgatgtgacggaaaagctttatgtgtataggaaagttttcatgtgatggaaaagttagaagtttaaataataattttggaactaaactcggcctgtatatgaggttggaagctctggattgggtgaactcatgttttcgtatttctacttttattatagaaacacagtataaacgtatgcgcttataacacgtgcacattcaccactataaacatacacacgtacatcatatccttatgattatctccgaaatattggaccggcatatttttttttctagtatattatttatgtcatacattttcgatcttaaaagtttaaataatactggccgattgtcctaattcactggcataagagatgaaaatattacatcattgtataaaatggtatggtggtatattgtaacgagtttcatctaggctcgaaagaattcctatatccgacattataaataggtagaataatcaaataagtgtgaccgcatttttcttgccaaaatgcagtgggggcatgcttgtgtccaaattgataggagttaatttataatcatcgtgttatttgtaagttgttagaagttcgttctgagaaacttggttttatccagctagagtattataagttgcaagcacttgttctggtttttaatcagagtaatacctctggctttaactcaattgagtaataatcggttggtccacactaaaaatttccaacagcaattgcacctaatgagatctatcataatgcacctctttagctaacgaagtataaattgacagcaaaaccatggtagtgacaacttttagcatcgcaaatccgcacgcaaaaaacttcagtgcataccaacagaacaacttttgacaccagttctgcccaaaatggcacgtgttgccgaatatgttcatccaagcaggaaatttaatagacaaagtcatggttgggttgcattcgatttggccgtcattttcccttaatcactgcgcagattgctcctcatcattttacagttttttttcccttcaatacttcttttttcttaccgttgtgtatcaatacttaagtacggtagtttgatcggtttagtgataagattgtatctagaatgcgggggatttctcatgaaataattcaattcagtatggatcaataaaatatatcccatttgctccaaagaaaacctaaaatgcgttgtcattgtgcatagcaatttaacaatgtgtcactgtcataaactgttagagcttagaacatactccaggtagatggatgatgaacacaagactacataagcaaaggtcgtatggtggtcaatttaaatgcgatacaacaccaactgaaaaagaaacgattgtgctgtgttaccaaccagtgaaccaaaatttcttttcttaaaaggaagaaaaggattggctggcagattaaaaccacatcagataggtcaaaatgatgcaaatctggttggtatgaaatttttagataaatgatactaatatactactttcttatccaccacggtgccataacatgggctccctgaatcacccacattagaagaagaaattaaactaatcctcccaagtttcctcctaatatcttcttgttgattttgttgatggcccttgtggttcggtgagaagtcagaagacagcaccaaaccttccagagcaaagttggtctaaccataaaaaaattgcgtaagggggtggtttcctctctaaacattgttgtcaagtagttgcaaaatacacctccagttttttctaatggtactggcatgtgcagctttttcacaagaaggaaaccactccaaaacctaacctgatagctgtggtgtgaccaaatgattgaggcatgaaacagatggattaatttatacattgaaaggggtggaacaaacgtggcaaataatgagatacatcgactgtagcaacagtagtgcatgcaccttttttttttaaaaaaaacaattattgtgcaaatacttcatgacaaaatgtaaaatacggaatcaaggtttttaaattctacctagagtgattagccataaaacgaattgcacttaaatcttcacgttcgcagggattacagacttgcaacgattagtgatgactgatggcttatatatgaataaatatatggtatgaactcatccttacgaccttaacaaccgctaccaccaccaccagaaatgggacataatttttgacatggatcatatgttaaaaaaaattattatgttgctttcacatggaacatatgatatgcctgcccataacctggttaagcttgctctaacatttgtattcaacatcaccttacagtccgtgagactgacaaaacggtggttctttaattattattatttttccacaggcataatccaacgcatctgacgttctagcatctcagaaagttggttggctcgtatctggcaacctgctcggctatcatttgtgcaaaggaaggcgacacttgggtggaccaaactgagcattggactacaaccattcgttttctcttttcttttaagagtacacgacgtttattcatacatgaatcagccacattcccacggaaaatgaagaaaatctgtcttcgaacaggcccaaacaaacagataacaatcaacatcccatctagttgtgcggatctataatgctgctgctttactactatcaagttagactggcactttagtcctactacaaagtacaaagagaacaagaaaccaaccaccagatgttcagttcatctcgtagtgaagaaaaagaaaatattaagcagcttccttcaagcttccaaccaaaacgaatgcccaacttaaatggatagagtccaagggtacagacaacgaacaaaacaaactatcataagcaaatggggcaaccccaccggaaaggttgcaaaaactagtgcacaaaacgatctgacaatacagtacgatcagtttcggaataagcattcatcacaaaggacatggactggatcacaggcaacacaagacaaacaccaaagcaacgtttatcaacagacttcatttgggtacattttacaacaccgtcaacaggccacattt

SEQ ID NO: 23963 - DNA, 13863 bp, Oryza sativa
  unsure (1)..(13863): unsure at all n locations
tccacaaccaaaagataactcaggattccaggctcgggatcaaccataaaaatataccaattgggtggaacaacagaaaggccaaaagtagcatatataaatattaaaatggccaaaacaaaagaaaggactccattgggaaacttacctacacttccaagatgaaatcatctctccattgtattttgaataaaaaaaaaaacgactgaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcagaatctcataatacaaccatatgagagcaaaggataattgttcctactggtcacctcgctgctgaccagtgcatgctaaatggagggtcaagttccgtacagaccatatcataagccgcagaaaacaatatggaagaacctacaccagtagtctccgcatctccacaaccagaagataactctggattccagccgggatcaaccttatcagtcagaccaattggttgtaacaacagaaaggccaaaagttgtatctcataaattctagaatggttaaaacagtaattttagctccattgtgaaacttacctacacttccaagatgaaatcatctcgccattgtatttttaataaaaaaaaaagggcgggggggggggggggggggttgaatagaatagagtaaatgaggtaagcttatcatgtactggcatatttaaacagattttcagtaggaactaacattatccattcagtacgtcaactaagcgaaaatatagctcattaaatcacctgtaatatactctttgtgtttcatggtagaactagccactagtagttaacaagttggaattgatcaaaagaaaatacaagtctcaaggaaagagtcgtctataagagattaggatctatcaagctcatgcacagatgcactcagttttcctaatgtgtacttcaacatctcagtctccctctatttcatctaggagtaactgtctaccttattcagattcatcatttcaaaacatttctctattcaccaattcgtagttacttctgtccatcctaagttcatttctttggcattgtgcaataccaaaacaaaactttgatcactcttttttatcataatatcagaagaattacaacagtaattcatgatggaagtattttacaacgatgagcctagctgtgtcattttgatcatgtgggaaatatgtaatcttaagcgttcgtctgtgataaaagggggaaaatttaatctatactacagattttattggcaccaaataataccacaagattctttcacctttcaaaaataccaggaatttgacagagaaccaatttagtaagcagacaaaattacccttgcatctcacatcctttccctctcttcaacaatatggggcctccaccatatcatccgtgtctctgctccgtccgccatggcatcacgtccgggcaggagaccaccaccagtccagtatgcgtggaggggcatttctgttttgctgctgcggcgttgcgcccgggcaggaccccctgggtcggccatgtggaggcacttttttcctccaccactggtgtttgtgctgccgttttctaatccaccgttgtggcctcgctgcaaagcacaatagccgtggaggggtcttctttgctctgtcgtggcggggtcgcttcgagagcaacagccgccgtggtatccgagcggcctggaggccatgatgagacacccgccaactcgaactgcttcatcagttcacatgcctgagcaaggttctggatgatgagctccactagctggtaccaaatacaacttctgtatcatgctgctgctgcggccacgatggagattggagaactcccaatctagttcacacttcatagggtagctcagtaatcttctcaaacactggtaacggggacaaattagtttgtccaagattgggtaacatccattgaaatctgtatcatttttggaagagacattgctgcaatgtggtattgagtggaggtgcaagaatcttgtggtattatttggtgctggtgaaatctttgtggtatagatgaaattttcccaagaagaaaaaagaaactaattaacctcaagtagactgtcacagcatattttttggaccaggaaaactataccagagtagcagaggctaatgatcaatcacacatgtaactgagaaaagagaaaaatatgctgtagaaatattcaaggaaactgctgaaaacactagaataaattcaaaaaaatacagtcattgcaactgctaagatcagtaatagcatatgattgaagaggcattatcttcgagtactacaccagttggtactttgctagctaggtggtttatgcataataataaatacaaaaaaaaacagaaatataaaatgtcatagccacaaggttgtacaaataaaggtgtgtttgaaatttgaagtcatgttcaggtatttttactccctgcactcacgaatatttgcaatggagtagcagatagttaccaagaaaaaccagtttctatattaaaatattaatgtgaccgataaacccctgacaactagcccatggcccaatctagccacaaatgggtatagaggatttatttgatacggacaaaatagaagatgtgcaatggaaaatgtggggttaaggggattataaactagcatagctggagactgtccatcttcatcatgtccatcaccaatgctcatgcctacaaacgtttaaaagtaaaaaaaaagactcagattcatggagaaaacaattaaatattagggggcaactatgagaatgagatttagtttgaaaatgaaaaaagaacttagtttatttatttatctactatcccgtacagttggactcacaacttgcagcgcgacttttttgccaatgacataacgaactgttgtttcataaaaagaccaaaccaaggtgttattatggttttcagattattagcaagatcagtaaagataaaggtattcagtgaaatggcactatttaagcactaaaatgagccacttgagtacacatttgcatttcggttggcttgaacttgactttcatagagatcaaaataattaagttctatcagtaccaaaaagaaatgctgtactcatattttcaatctgtatatatacttcaactgctacagaaacaacaataacaaaaagaaaaacatcaaaatatattgaagagttcatcaagcagcaaaacaagagagtgatactaccctagtttacattgctactttagcaatcgaggatattcatgcatacatcgacaaaataattagaagtccaaattgctactctagtactcaaggatatgaaaggcaaacatcaaccaactatgaaatgtaaatcatgccattacctgcagtgtaaacacttgcaaatggataaatgaaaagggcagcacagtctttcaaaattctcttgaactccatagactcaagatggaccatgaagagaccattaattgtctttaggaaaatcacattatagtcctcagaaaaccccattacgattggggagcccttgcgctctgttggactcaaggatagaagctcgcccaattgaactgttttctccagcacccatccagactcagagacatcatcatcccaatcattcttcctcctccaaaattgtgagcccaaatccgacatgaagacgaagccgaggccaccatccgctgccggcacgacacaaaatcgtcggtatccatcactcacagccattggcacatcatcaatcacagctagcctctgctcgttcagatcgaactcgaggattccacccggaatccccgaaatcaaccagtagagggaatccccaatccgaacaccgggaacagccagggatatcctagtcaaattgtgtgggaggggtgttgcgatgagatccccccatttgccggtctccgacgagtagatgcaaccgatggcttcgtactgatggcgggtgcccaccagaacgatctggaatcggaatccgccgccgccgccgggaaggcgaaacaccgcgccgttccgcacctcggtctgtccctggtcgcactccggcgggaaggcaacgcggcgctggtcgccggagacggggtcccacacgaggaagcagccgcgcagccgcggcatcactgggttgacggcgaggacgaggccgtcgcggcagccgaggatcctgcagcggaagtcgtcgaaccgcagcgagaagcgcccgccggcgcccacggccgcggggacgcggtcggggggatccatggtggagacgaaggaggggctcacccggtggctgtggaagaagccgaggaggggcgcgccgcggcggtggtgggcgcggaagcggcggaggaaggcggggtcggcggtgacgaggcggcgccagcgcgcgcagacggcggcggcgcgcgggagggaggagggccgcggcgggaggcggagaagtatctcggcgaggaggtcgtcgtcttccagcggccgcgggtgcgggtgcgccatcaccgggtttcggttccccgcgcttctccgcttaggtgggaagtggagactggagaatgtaggcagactgtgagactgggactgtgttgtttaggcgagtttacttccaaacttttttttcaaactttcaacttttttatcacattaaaatttttctacacacaaatttttaacttttccgtcacatcgttccaatttcaaccaaattttcaattttagtggaactaaaaccaaatagatagaaaaaatttaggccaaaaacgtcacatcaaatatttatatatatatatatggggtattaaatgtgggaaaaaaaatcaattgcacagtttgcatgtaaatcgcgagacgaatcttttaagcctaattacgtcatgatttaacaatgtgatgctacagtaaacatttgctaatgatagattaattaggcttaataaattcgtctcgcagtttacatgcggaatttgtaatttgttttgttattagtctatatttaatactttaaatgtgtgtccgtatactccaaaaactttacactcaaataactaaacacacccttagatgaggaaaatgttgagatatttaactatttgccacttttagatgtggcaattaactatttgcctctgaacccatatgtcatagacacatatggatccacatttcattgagataggggtggcaaatagttaaataccaaatttaaaagtggcaaatagttaaatgccccggaaaatgttagctcgaggtcctcctcttttattttagtttttaaatcgtactttgaacaatattacgcaaatcccattaacttttaaaacatttgtaaatgaggtccatcgacggtattgtttacggttttagctgaggtggctcttttgactaggtcttcgtcccatatgacatttgcatgacgcttacgtggcaattcaattcgataaaaatcgtggagctcatgtgtcagtttaaccaaaaaaaataattaaaaaacatggggccttacgcgggacccacatgtcatctcattctcattttctcttccctttccttcctctcttatgttatcccttccccactcctctctctctctcacacactcctctcaggctggttaatctcagcgcaaagacagtttgtgctgagttcacggtttatttcttgttaaagtttcttttactgtatagtttcacaataagttttttgaaaaggaccatttaaaaaaaaacgggaggggggagagagtaggaacaggggacccgtgggctggtctgtcgggacaagttcgcggcccatgaaatgaaatccggccattaggcccatcccagtcatggtgccctgtcttgcatgccatttgttcgaccgatggaatccagtgtcgcacgctaaatacctcttctgctcttcatccatccgatcactctgaatccaagtgaatctccggattaggatcggccgcgagttattttgctctgtgaaagttgcttggctgcgtatagcactcctcattcatcaacatcgtggtgaagagaaacgaggggctcaaaaatcaaaggcaaattttactacagtacatcgtggctttgcagttttaactgcaggacaccaaagtgactttggggtgaagacactttcaaaagttggatatttgctggtggacactggacccactaaaataataatttttggtttaagaggagggagaaatcgtgtgaaatgtatgaaatgtccttgggcccacatgtcagatttccatctctcttctctctctatcccctccttccacactggcacacagccatgcgacgggcttcagggggcaggaggagggttgtgacgagggggacagcggcagccaacggcctaggccttgccgggccagatcggcgtcgccgccacggagcccgcatcttgccaagaccttaagagtggcatttaaatgtcgttcacgaaatcaacacgacatgttgtttcttgtttataggataaattatatgaatatagccacatccactatcagggccggccctggccctatggagccgaggcgaccgccgggggcccatgatggtggggtggggggcataatggtggggggcaacacctaatactagtagtctagtacctcatccgatgttgagatcaatgatttttattcagaattaaaggtgatgaaagtgagtttgccagattcttcgatttccctaagattttgaagtttgttatggatgcagatttctatccaaatgtttcagttgcctatcgaattctcttaactttacctatgatggtagcttcagctgaaataagtttatcaaaattgaagttgttgaaaaactatttgagatcaactgtcgcaaataaggttaaatggcttggctatgtgctcaatcgagaaggatatcttggacactattgatcttaataccgttctttatgattttgcatcaagaaatacccgaagaagtatcttttcataggaagcaatggatatgacggggttctattcttcattaagttaataaataattatattagttccaagttacaaatatattgttattttggtcgattttatttcttgataattaccaggaatgttaaatttaatatatagatgtatttgttttcattttgcaagtaaaattagcgtctatatatatcaataaattttatatatagcttggagggcccatcgcgatgagttcgcctagggccctcaaaatcataggaccggccctgtccactatagtccataatggaatatccatggcatgaagtaggaaaattaagaagtttgtaacctttatttagtactgatatcgaacagaatcaccaccaagtgtcatacttgtggtgttttattttactctacgccgatactagttctcaattacattactctgaggtctcgctttcggactcattcgataatcctgggtagtattgttgttgaaatctaggagtgaaggcaccgtgctcttctcccctgttgttcttgaggcttcgggcttgctcccttgagatgcgatacgcattagcgactacatcaactggcaaggcacggaatactgagtttttccctgcaaggtggctgacgaaggcgttagcgtttgtcttgattgcgatatattggcatccttcacgctctgctttcttcaagacagcataatgttgcggaatgatcaataattgtcctgggcgaaggacaccatcaaacacagtctttccaaagttactaacgacttgaactcgagatcgcccttgaatcatatagaccaaactatgagcattgacgttccagaacggcgagagaatagcattctgtagaaatcagtagagaataatgttatataagcaacaaatcaaagatcttccaaaaaaaatgaagagaacaaaacggtgctataataaatacctggtataggtttactctggtagcgctcatttggatgaggttaaggatggggaacttctgactattgacacttgttatccttccggcacgtgggttgtatgaatcagcacgactaggattttcaatgtttactctcaccttgatcgtgcaaaagttctcctccaatccgttccatcgagaagatgtttgctgtcgttcactgtattgaacttgttgatattgatcttgtgcttgtgcttgttcttgctgttgtgtcaaagtcggtttcaacaattgaaggccattcttcacatgtatgatctctcctctttgatcattttggctctgtagcctctttgctgctactgcgttgatgcctaaagcctcacttagcatctcaacaccaaatccgctgaatatgttttgcccagagtgttgctcaattgagctaccatatacttgttgttgttgagcccgattgttgttgccggctaataggaactcctgaaatttttatcaatgaaaaatttaatgttttacgctatgaattgcattgtaagaacatatgaaaaacatagaaaattacaactttgatggaaatatttgttcaaaaaattaccttttgcctaggttcaagctgattggcgttgttgtttacgtcataaacatatacggcaacaataggtgcatcaccatcattgtagaaccaatgtgcaacaccagctgggagtgcaacaatgtctccttgcctaaattgatgaatcttttggtgctcatctctaaacttttggctctgactttggccttgagatgaaaattgttggaattgttgctggtaagtcgcagggcaaccggggaaggttaaacccatagaacctctccctaaaaattataatgttcacataaggtacatacaacattaatttgaccatggagatcataactactagttgcatcgatagagttctcgattatatttattaggatacaaaccttggatgatgtagaccacgccaggaatatttgtgtatcgaggtaccaaaaggccttgaggctgaatgacacgtcggatcacaaaagtacccgtgcactggaataattcattcttctcatcgaagtactcagtcaccccagcttctgacctcactttccgaagtggttcaaatgcttgtagtctatcaaatctacactccctaaaacttccttgccgaggactatgccatgggtttgtgctgggattaaatagctgggccatagaaccatggcataatagaagaacacaaaagtatatagaaaaccgagagaaaacggaactcgccatagctatttgtacttgcttatggaaacttaagctaattgatgtgagttcaaagacagaccaagctagtttatatagcaataaaaaagcatcttgggatacatggtgatatagtttgttgcacgtacagacaatatatggcttgtagtgttaaaacagtacaaaaggaaaggcaactttgcaagattgaactatacatttcatgactcagccatgacaaacttctggtgcttttggagtaatacaaatggagtttgttaaagaaatgtctatccatactcttaatatgtatctttgccttgtcattatatttgtttttgcaccataaagctcttatgcttgagaagatgagtctaactttaagatgataataacttgtaagcatgttgtcatttttgcatggcaagctatatttgataatttaagtgttccttcaaaatagcaaatttgtaggtttgttgtcatttacttgatacactacaattgataagtaacttgtatttttaaatgacgtacttgtaactttgttgtcatgtaaaatatatcagacagtaaggcatattggtgtaagtaattttaccatgtcataagcctttttactgcttattgacccatataacttgcctatatatattatttaactatttgaaaaacacatattatgataattttacacatctgaccacggagagctgtgaggctacacgtgggcccgtgtcactcaaatccacccaggcgcacggatttgcttcccgtgcacctaggacggctccccgcgtgctcccgctctatgtgaatcgtgtttgcagacgagtggacccactcgggataccgcgcgggggaccgagtccactagccttgtgcactcgtcctaggccacatcctcgtccggtccactcggtcccccgttcgtcgtagctgctccgtcgtgtgttcgctcggctgtgcccacgcagcacgctgggccacacgccgccttcagcccaaaaaggcagaagccatcccctttttcctttttctttttccatttaattcaataatactttttttctttagacagagaatcaattaatcttagaaaatccatatctcttcaactgtctgttcgattgactctgttcaacttctaaaattcctcaaaaatcgagatctattcagtggcacacttagtactcactaatacgagcttttccttggtcgttttgttgagttatctcgttccacgtgtagcttcggagccagaagagtcctagtgcgcggaatacgaggaagaagctcaagatatcaagcaaggtaggtcacctttgattattttgagcccataatttgaaactaagtatttcatttctcaaaatgcacatctctaaattacacatgaaatgttggccgcagtttgcaatataaccaacaggccccacctacaattgctgcattaacctccttggtcgactacaatgctaggtctcagtattcgtgccctcaggtacggataccaatgaccctcctcaaaatttgaatgatcaactatgggtaaaacttgggtttacaaaatccctggaaaacccgacacacctgggtcggtgccttgaaaacaaatgagtttactaaactcgtatttcggtagaagtactggtggtatggttttctcgttcttgctcatatggaccgattcctttagaatttcatccaaccataacatgtgtgaccacatgggtgaattgtgacatgcctggctgagtaattagctaggtcaggcaaatcttgatgccaatggacaagtggatttgtcggggtggtgttggggaggaccccttggatttttcctggcacaacatggtttgggacctaacttgttgttggtctgtgggacccctccagttttcataaggtgtccttgtgtgggctttcgaaatgccttgtcgcgaaatcccttaagtcacaagacgtggctattttgcatgggctgggtaactcaggttagtggcgttgtgtaggtaaagtgtaccttctttgtagagattaacaaactgtttgaacagtcgtgctcacggtcatgggcggaagtgaggtgattccttagcatagttttggttgactactactttgtgaagttgttggtagcaagaatctgttttaaattgatatgtggctcttgggagcagccagactcggggagtcctcttatttgtttggcaaggagccacccatgcagatgcattaaatgaatacacttcactgctttggtcatgtgagatgcatcttctcacttgtgtagttgagaaccactcacttagtcgtttcaaaacctttatagaaaaaaaaaatctaaacatggaaataaccagcctttctctgaagcttgcattaaacacctaattcacatggtttgttgagtactagtatactcacccttgctctatataaatacaccccccaggcacaatttctcgatgaagaggagatggatccagctgatgagttcttccaggaacaagcaggcttcgagcggtattagggttttggcttagttccaaagtcatgcttgtggctttgtctagtctccgcttctgcctttttgtaatgcagttgtgaactcgggggttgttcgcagttccaacaatgattgtatccctactcataataacgaaacccatgtcgctgtgatattctatcttcctttgtactagctctatttcctgggactggtacatgctcacaagttaatatgaatctccttacattggttttcatttggagctagtttggggcgtgacacatggtatgctagaagaatatttctttggctaaaatttgcattcaccatacttgtgatatttttttaaaataagttcatcttagatggtcactgtaaatatataaatctagatggagacagttgcgaatatatgtgacatattttcggtgctatggaagatattttattagggaaagattataagtacataacttttcaaacaaaactcttgtgataaaagtgtgtgtggcacactatgaaccagcctagttttactgtaactaatttatactcccatcgttttttaatatacaatgtcattgacttttttacatacgtttgaccgttcgtcatcgaacataaaagatataagtccatgcttaaaaaaattaataaaaaagtcacaacaaaataaataacaattacataattttttaaataatattaattgtcaaacggatattaaaaagtcagcaatcttatatatattaaaaaaacgaatgtagtacttgtgttccttttgatcttaacggttggtttatgggataaatacatttattccattaggttcctacatatgtcccaaaggatatctaatcccttaattaactctgcctactggtggccttatggttccatgttgaatgccccgtgcaccaatgcccatgcctacgagcataaaacgttaaaaaaattaagattgaaatataaatcaaatatatattagaggcatccataagtatgaggaatttttatgtactaccccatctatgaattcagggacaactcagctttcagacaacattaggaatagataattaaacaaaaacatatctaccatcaaatgaaaagaacattcttcagcaaaatataaaatataatcaagtattttactattataatccaaataaattgattcaaaatagttttaaaaaaatcaataggcaagttatatagtcaataaactgtaagaaggcttatgacatggaaaaattacatacaccaatatgctttattgtccggtatattttacaagacaacaaagttataagtatgtcatttaaaaatacaagttacttatcaattgtcaagtaaatgaaaacaaacctacaaatttgttattttgaaggaacacctaaattatcaaatatagcttgccatgcaaaaatgacaacatgcttacaagttattatcatcttaaagttagactcatcttctcaagcataagagctttatggtgcaaaaataaatataatgacaaggcaaagatacatattaagagtatggatagacatttctttaacaaactccatttgtattacaccaaaagcaccagaagtttgtcatggctgagtcatgaaatgtatagttcaatcttgcaaagttgcctttccttttgtactgttttaacactacaagccatatattgtctgtacgtgcaacaaactatatcaccatgtatcccaagatgcttttttattgctatataaact

SEQ ID NO: 23964 - DNA, 1169 bp, Oryza sativa
ctggatttttcacattttggtccttttgaaaaacttatttcgcaagtagacccctagaaaaacttatcccaaaaatggttctttttggggcaccagagtggctggcgccgttgttcaacaggacggcgccagcctctttggcgccgtccccctgccgacgtggcggggcgatgctgaggtggctagggggaatgcgccagagtggctggcgccccccccccccccccgaaattttttatttttgttttatttgtttgatatttttttcacgcttagggacacacaagaaccaaccatagaaaaattgaactcaaatgaacgtaatatgtgacatgtagaatttttcctctcctctcctctctccggactagtgcagaggagagagatgtgcaacttttttatttttattttatttttttgatattttttttcacacttaggaactcacagaaaccaaccatgtaaaaaataaactcaaacggacgaaatatgtggcatatggaattttccaaagctccaccgaaaaacttctctcctcgaaaacacaattcttgcaagcggaatttggaggttttaatatcaccgaacccggcaaagcgggggagaatcggatgtaactttttctgtagatgtccgtgcatatattatttgcctgattccgagtccgtatgaaaaagttatacctattttaatagatgacatattttgtctatttcggtagagttttggaaaattctacatgtcacatattttgtccgtttgagtttattttttatacggttggttcctatgttctcctaagtgtgaaaaaaatatcaaaaaatgaaataaaaataaaaaaattacatctctatgtactgtttaacttatatgtcattttatgtggttatattttaaattagattaagtaatttcatatagtggtagagtgcattatgtttaacatgctgatcaaagggttttactaaaagagttatggtctaattttattgaaggtgcaaagtagactaagtggtatgctagatattttcagacttagctaagtggtagtttgagtttaaattttttttgtggttggttgtatcgtgatcctgagtgtgaaaaaacatccgaaaaaataaaataaaaatgacactgttgcaactctatatagggaaacaggaatggag

SEQ ID NO: 23965 - DNA, 1551 bp, Oryza sativa
  unsure (1)..(1551): unsure at all n locations
nnnnnnnnnnnnnnnnnnnnnnnnnnnnnnnnnnatcagcgttacagttgctcacatagtgtaccatgagaacgaacatgccaaccaaacaatctgagaaacaggaactattctatggtcaaattgcacatgggagccacccgacatgcaagctgtgacaaaaagtaaactagaggcaaaaaaaattctatgggttgtgaaaccaaaatacaataatgctccatgggtgacccactaatccattgcgtgcagtgcaacacctctggatcggtcgatctagtacacctagttgcaatttttttactgggtcaaattgcaacattgccttcttaaggccgactactaatcaatcgatcattcttttcgcctgacgaacccaattttcagagaccaagacaagaacagacatcgaagtgcagagcataacctctcaaaaaaaaaactattagtttattcgataatcaccgagaattcttgccacgaaagaacgtatcgaaagaaatttttgtcacatcaacctgatccaaaatgacaaattgacaggaacacaaaccttgtggatgagtccgtcgtcgatgatggagcagctgatcttcttgtagagctcgaacagcgcctccacctcgttcacggagacttgacccgatgcgatcgacaccaaacaccagatcagatcggaccacattgcgaaattggactcgagaagaagaagaaggcgatacaaacaatgggaggggggtgaggtgaaattagagattacagcatctggattcgtcggcgaggcgggcgagctggcggagggtgagggaggtgcagccgatgccgaccctgccacgctgctggtggttccatttcctggcgacggcggcgaggtaagaggaagcggcggaacggcggtggcgggaggcggcggcggacggcgggaggaggtcggcgaggcagtcggtgagcgcgaagaagacggcctcgccaatggcgacgaacggcaggaacgccgcgcacagccgctcccccaccgtcagcgagctcgccgactcctgcaaatccaaaatccaaaatccaatcaaacatagctccaagaaccgcagcgccgccggcgaccggcgacgaacaggtagctgaaccaccgacccaccacgtcgtcgtcggagaagccggagccgtagcccgactccatggatgcaagatcaatcacccgtgcgcttctctctcaccccgcctctccccatctctctatatacagaggagacaaactctttaaaagatgccgtctccgtccaaaaataagttcactattagtacctcctttcgtttatccaaaataaatttatttctttaaataattattatcatatcaaagtttataaaagtaagatgtaaatacaataaaataaataaaaataattatattaagatttaataaacgtactcttagtcttacttctatcccatcctctaacttcaaattataactttattgttttctattagcatactttttaaattgttacttctagatgataaaaaaaagtatataaaggtttctatcaa

SEQ ID NO: 23966 - DNA, 690 bp, Oryza sativa
  unsure (1)..(690): unsure at all n locations
nnnnnnnnnnnnnnnnnnnnnnnnnnnnnnnnnnaactatttcaacttattttgcaagcttggtttaccttatttacttccctttttactttgattttctaactttattcaaattaatccaaaaacttgtgctattaattggataaaggacttaactccctcctttcacttgtctttagatgccgcgttacaagcctgagtacctgtttggtgttgagggttttgtccaggagttgcgtacaatgtcctttgtcattggatttgggactgcccctttttatgcccagattcctcatgatcgtcatgaagagaagtgccgagtcaaagtcactttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgttcccatcctcgtcaaccccagggaagtgaccgtggtagttaccttgagactgaaggaatngagaatgatgctaccacgaaagcatttgttgagatgtngttggctatggatgaaagtcgtgcggagattgtgttagcagctcaagatcgtgaagaccggaaatcgtgtaagattgcaagtagaagaacaggtggatcgtttgaaaaggaat

SEQ ID NO: 23967 - DNA, 537 bp, Oryza sativa
tgcatgactgtgttttcttggacaaaacatatgtgcagattttgctggaagtgttgtaacaccatttttacatttttttataaaacggacgggttcaggggcacaatgtgatctccaattctccatatattcttttgaactaaatgccagcatgctgcaatggaattcaataacctacaccataatttgtaaacttgaacaaaatcttaaaactcgaatacatgatttgcatcagaccaaccagccacttgcatataaacatgtgtagtgtacaatcatctgcagaagatcatacgattaacgcgcctaataaatcttccaaacagaaagctagcgtgagcacatttcattgacagctaaaggcaatactagttttgccaaccacccaggtaacacaacagcagcagaaacgcattattgtgaagttacatttactgctaccacagatctttgggagaaaaaaaaaggcaacagttctttacacataatgtaaaattggtcacgacctattaatttggaaaagcagatgaagcacac

SEQ ID NO: 23968 - DNA, 3241 bp, Oryza sativa
ccaacaacacaaactgtatgagagtatgccaatcagtgaaatctatttaaaacagtccattcggctacaaggttgcctttcctaagacttaatatggtcagtaattagctgaaacacgaccacgctagaatgtccacatggtatagaaacgatgttgtaacttgctgatataattgcattatggtagtgttcacaattatgtgattaattcatttactagtggcatgtacgatgtgcttaaatcacagtatatgttaagagctccttagcgttatcttatgtaaattgatttcaaacatacatgcatacagctaaatacctgataacatttgtaattgaaacacgcatcagtaaataacagaaatttgccagtttgcaatggagaggcctctgcaaatcagcaacttaacaataccaatgagaatatgcgataaatggtgggacaatgatatcataggtttgcaaattcaatattctcttggtggctaaaagtaaactgtaatcttaactctatgaattacatagaagataacactgttctaaccaaaagttgtgaataccatttactctggttactatagagaccagaccacacaagactaggttcgcaaggtttgctgtgacccatcaaatatgacctaaccctgcagctggatacaggttgggtggctaggagcaacaagctaacagaagtatttcagagtatgcagttttcatgacaggatggatgcaaatgctcttcctaaaatgtaggtccataaaaacatgcatctacaagtcttttctgtttttttagagagagaagtcttttatatttttttctgttggtcaactagtaaaatcaatagcctaagatatgaaacctgtccaacctgaaattcatagcaaagtggaccattacagtatatacaagatggcttagctgcattggttagagacccagaatatactacccaaagtggttttgcagttgattccctgcagtatctgcataacgaagtaatcaaaattatgcttaagataagttgtctgcgaagtacagacatgcaagagaggtggggaactgaatatgattatttcaagtttaccatatgctactgatggcacatttcactgcataaagacacaaactacaactggagttacaaatgtgctgaagtgcaaacatgctaggttccaggcttccagctaattggttattaaacacagaagtttcccacagtacaataaaacatcgctagttgattttgttttccaagttgatataccttcccgtcaactgacctcccaaaccacattaaacggtcccagtggaactgacaacttaagcctttaaaatttcaagaaacataatgctgaactcagaaacccatatagtattgaagcccatgcaaccacaaaattaaacaaagcatctattcaactttaaaaggtaaatgaagttccaataagagttgtggcaaggcactaccgcactaggactttgctgtagtttcttaattcagaattgaaaacactgacaaagtaaagacactattccaaaaagtgataacaattaacaacccaaagtaaggcatccaaaatcacctcaaaacttgatcctgttctcttgagatgcgttctagaaaagatgcccagcatctattgtcatcatcaacctgcaacacaaaaaaaaaaagtaataaataacactctagaagtgcattagcaaacatatggcaaagcataacaggaaaacaaaaacctcaaactgatccatcaatgatgccgtcatgtcatcctcttcactttggccttgttccatcaacaattctgatctattctcacaactagcaaaacaagaaaccttttcggtttcatcaaccaccatgtattcaggccatatattgccagcaaatactgcaaatagttagaacaacaaattagatggagaaatgtttattttatgaaacatggaggaacaattaagagataaatgggcaattaccttttcctgcatctggcataatagcagaagcattatgtgagccagatatttgatggcactcattcttgtgctttgcacgccaatgcaattcctgaggaaggatattaccgagtgattaatccaaaacagtgatatctgaaaactctagcagcgcaaacaaactgattaaactgaaaatacaatataattgcctggttagttgatacctgatgcttctttgaacagtaactggatttcctacaacgactacaaactttttcccctttccatgtgccacaccaacaacaaaaccaagtttgggatcctaatagaaacatttgaagacaaaaagcataagtttgtgttcatgatttatacacagcatgcataatggattatttaagcaatatatcatatcaaagcaaagtgtttcctggacgtaaagctgtccataaaattatcaaaagcatagtgttttcaagaggaaatgtgagaataaaaagtgcattttctacacaactttaaaagattgtttcaacaagcttgtgaaagtttcacaaaatagacggtgataattcctggaattcagcttatgattaacgcacaaaattcatctgaccttcctttatcgaacaaccatttatgcaataacaaatactacctccatacatatatgtatgacgttggctagtataaatttgaactagtttcctctaaaaatttgaactagccaacgtcatataaaaaaaactggagggagtaatatagaacagtgacaaggggtattcttgtgagcatgtcccaaaattgccatacagaggacaccacactgcaagcaccaaacaagcagaaagtatatcaaacaagactaccttctgcacattgtgatccgatggatccaatacaaccctcaggctctttcaatgaataatatgaattaatttggggaagttggcaccggaaaactctaacactgcaacagctcaccagaagaggttaacagaatatacccaaaaagaattgggtgagaacactgtgtagaagaacaacaaaaatattatgccagcttcaccttcttctaggattacctgccctatccttcccctgctcatgctgatctagtagtaagcatgccatggatgggcacatgaacacaaataatgtgcggtgataggctgtctccttgcactgaattggtgcataaacctgcatataaatgattgttaacaaattgatggcttatatgcataaacctgcatataaacctgcagtttg

SEQ ID NO: 23969 - DNA, 5823 bp, Oryza sativa
  unsure (1)..(5823): unsure at all n locations
nnnnnnnnnnnnnnnnnnnnnnnnnnnnnnnnnnnnnnnnnnnnnnnnnnnnnnnnnnnctaaggttacttgaggatccatgtcctcatcatcctcgtcatctacgtagtcattcttgaatacagcgacaaggtttgtttccttattggggttgatctgaaggctctgaagcttgtcagtgtcaggttccatatttcacagcaattgcctgcaaggaaatggatgcaggaggggatgagtgtcaccaatccagctgaatagaaaaggcaaaacatttcgctccaacaggtgcaaaagggtgcgaacacagagcatgagggtttagttcagcaaccaaaaaaaagaagggaaattaggatatgagcatttcatgttggagtgaggtataattcttcctaactatctttactatttcctccttttcacaatgtaagtcattctatctatctagattcattaacatcaatatgaatgtgggaaatgctaaaatgacttacattgtgaaacggagggagtaattattaaagtgaagtcggaagttcagatttcagcattttacatacagcatgcatccgtatcaatcaatcaaacaatatatctaatgctggccgtgatgggcagtattgattagaccacgtgtcacactgtcacctctcacttttccgcgttcaactttgaccgtccatcttatttaaacattttttgaaaaaattttaaaaatataagtcacaagtaaaaacatccttcggaaatagattagataatatttggtagatgacaaatattaaaaagaaataatatttcattgaaaaaagggaagcttatatgattttggactgatgagatggcgctgacatcagcgatgacatcatcgccggcgacgacttcgaagggcggtgctccggtgagaggcgacagcatcgggagagagagagagagagaggaggcgacggcgaactcaccaatggcggcggagacgagaaacggcgacgggaaacggccggcgcgaggtactgtccacggtggaacgactttccggcgacgagcggcgacaacggaggggtggccgggcttcgtcttgatgctgcaatgccgaaggaggaaacagtgacgaccagtgaagacgacaacggcggcgcgacggcgcacagcggctggagatcaaaacacattggcaacccactggttcacggcgaggacggcttccggcgatcttcggcgaatgaaacgtggaggccggtcttcctctctttgctgcggtcctgttggtggcgacagcgctgacagaagatggcggagccgacggctacagctggctggagcggcggccggaggtggagagagaaggcggctacggggagaggcggctagggcatgggagctcgagctacgggttggaaacgagagaggagggcttgggaagagggagagatcggctcgggaacggatggattcggtgaaggaaaattaggccgaaatccgcgggattgagcttagatttgatgggctttattgggaaacgtagaggagatcaagggaaatccgttcccggaggccggatttggtggaaaggtggcggcggcacagtgcacgggcacgggagctcgggtcctggctggaggttgaagatgaactagaggtggccaaacgggcggcacggcccggcccggcacgggcatggttccggcacggcccgtttcggcacggcccgttaggcacggctgatgaaacgggccgtgccgtgccgacccacgtgccgagccgccggcccaagcacggcccgtggatggccgggccgtgcccgtgccggcacggcacgcccgcggcccacgggccgttcgggccacgggccgtgcacagtgttttttttttttaaaaaaaaggaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttggtaatgttaaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaacttacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaataaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaaagttagagtacaatcataaaaagtttctagaaattggtaaaatttttgtacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctttgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaatttcgaatatttattgaattcacaaacacaatacaaataatacccaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaattttttatgaattttttagcctcccacgggttattttcaaatttgaacggtcaaatagccgttagtgccacgtgtcgccttcccgttggaccgccgcccgccctgtcacgcgccgccggcgctttcggcctgacgggccgcccgggccgtgccgtgccgcgggccgtgccgtgccggcctgctacaggagccatgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctctaagatgaacaggcgcgggtgaagcaaactagacctttttttctgggccaaaaagggcccaagctgaggagaggatttttattacttttccaattaaccaatgaaatgaactacttccaatgctcacataatttcatgaaaaaaatcctgaaaatacttggacacttaaagtatttaacaaattaaaatcagatcatttaatgattaatttattatttaaatattattgaaatgttcttttattattaaaattagtaattgagctctgaaaaatctgaaaaaaattccacagagtataattaatcatggagagtttaataaaaattaaatccaaccatactttatatttagaaaattttatttcccacatttaacttcacttgtaaattaataaatatttaatataaattctaagaataatttattaaataatttataaatcctgaaacgaaaatcatgatgtgacaatggtttctgccagtgctcctagctcccgcaatacccccgtgcccctggccattgcacatcactcggtggctcggtgcattgacgacatcggcaagatggagacaaatcggtttaagagtagtaaaaaaaaatactccctccgtccaataatatag

SEQ ID NO: 23970 - DNA, 8786 bp, Oryza sativa
acaaatcggtttaagagtagtaaaaaaaaatactccctccggtccaataatatagtaacctagtaccggacgagacacttcatagtacaacgaatctggacagtaagcctgtccagattcgttgtactatgaagtgtcatatccggtcctaagttgctatattatgggatggagggagtactcgctaacatataggtcccatggatgtttctttagctctttctatataacagccacatatatgctatgttagtacaggtggaccaaatcagcgtgccaagccatcgaaaactgcccttaaaaccacagagggagtcattttgtgttgttttaatagttagaggggtcgatataccctagttttagggtcgagggagatgaataagattgggccactagctgagggactcagattggactttctttcccctattttcacagttggttttgtgctgggcccaaaataaggagggcctctcagtcgcccacaacctcagaccaaaaggcttgtgcactcgtctctcatctcgtcctcctcgtgctcctccgccaaaaccccaatccaatcgggctccgactccgactccgaccaccgcgccggcatggaggcggtcatcgcggagtgccgccccaagcctctcttcaccaccgggcccttcctctccgccgtcggcggcggcggcggcggcgtcgaccgcatctccgggctccccgacgacctcctctttgtcatcctctccaagctccccgtcagggatgccgtggcgacgtccgccctctccccccgctggaagagcctctggtccagcgtcccgctccgcctcgacgacgccggcctcctccaccgccgcgacggcacgcgcctcggccgggaaggcgtcgccgccaccgtctccgacgtcctcgccgcccacccaggccccgtgcccgcggcctccgttgggtgctgcctctcctccgacgaccagggctaccagctgggaggctggctccgagccctcgccgccaagggcgttcggcaactgtgcctgatgggcgcgccatggtcgacgcgcgctgctctaccctccgctgtgttctcctgctcatccctgcggcgcctcttccttggttccgtgcaatgcaactgggacctcataccagaccatgcctgcttccctgagctacgagagatccagatatgcaacgccctaatgaagagccaggatctgtcccttgttttggctgtctgcccagcgcttgagacagtggagattcttgcgagccgtaacaaaatccccaccgtgcgaatgagtagccatactatccgcaatactttgctatggaagtcggtggccaaggaagtgaacgttttggacaccccttgcctcagcagggttgttttgtggcaggatcttctgctgccccactcaagatataattctaaggtcacaatcagccgtgccaccaaaatgcgcatttccggttacctggacaccggcatcaacactttggtgatcaacgaaaccacagttaaggtatttgtccctttgttggatatatatctctaatcatatcgaatctgtgaaactgtgttaacgcgttttaatcgttgaatttgaaggtaaacacaaatataagcttcaagacacttatccccagcgtgaaggttttgggtctctctgttcatttcggagtacgaaaggaggctttgatgtccatcagcttccttaggtgttttccagaggttgagacactacatataactgtgagatttctttccttctttcattcccgacatatatatacataaatgtgagattgcgagatagctgtctttcttctttcattcctgacatatgcatcattttacacactcactgcagccattctttcattcccgacatatgcatcattttacacactcactgcagccatatgttcctttgatagctggaggtgatcaatttttcttcttgtgcagagcaaaacggacaaggcttcagaagccgaacaattcagtttctggggaaaggttgatcctgttgagtgtgtgacctctcatctcaagaagttagtgttccatgggatgccatggtgtcctggaaaccttgagtttctcaaattcatcgtggaaggggcatacttgctagagaaggtgttgattgttcttcctaaaggaacttacactagcatgcatagcgttatcaccaaactcaagttagcacctttgacctctgcaagttgggctagtcacatctgtaaaatggaggttgtccaatccagtcaaggaactttgagctaccaaagggcatctgatcattccgtcgatgatcctttagattattccctgtaggctgttctatctgtttgttgtgattataacatattgtcgatatggttatcctttaggtccttcatgtctgtatgccattttcatgtgttttggcttgttatctagagaaaaatgtatggtttgttggatatgcttagtactatacttgatggggtgcaagtaatagaatgcagagcatccgatgtgtcagtagttcctctccattacttcttgtggcaagacagcaagatactctactctcgattttgttgcctctgcttctgtttcttgtggattaattcatcatgcgtcatattgggcggcatcggtctctcatgtctgagaattgtagtaagagcaggtacaatagcaggctataagccagctgcaaatatattttaaggagataaatgaggagagagaagagcagcgggctacagatttgtagccagctgtattacagactccaagacgcagtgtgtgtatgacaggtgtgaccaggtattaatagtgtagtatgtaactattgtatgaatgagacattagattggctatagatgaattggagctagtagttggctatactattaaacttgcgagcaacagatgtggaggaagtcccaacaaaatttagagacagcataaaacagctgtaattccattcgagccaatatatcttttttccttcttcttccagatgttaactggttactatagaatttgttcaattagatggaaaagacaatctgatttagcgaacaataatgttgtggtcgtaattaagcacatcagttttgggctaccagaactggtgtcacttggtaaggcctttcgaatataagttatttttctctttttttttaatcaactattaagttgttctggcaaaaatctttgtaaattctaaacaaggcttggttacccaacattttgatatgtgcttggtccatctccaatgcagcttgtacatgttcgtgtgcgctaacataattgttagaaacatatgtacggtgtgattgtggtgttatctaccaagatttaaatagacttaaatgttggtgtccataaatgttaaggttagtgattttcggttagtcccgtctttttccaatgtgtgttaagacggcgaacctttaaatacttatttaatagagttcaaatttcatcgcagtaatagtaatactatcgtttatcacaaattatccatactatcttttgatttgattataatttcaatttagatgggacctatacccccacacatttcaaggagacgataaagtacttttatcaaatgctcgtgatgaagattaaggacctgtttagattggtgtcattttaaatcattctatttttttaatgaataaacatgtggatgtagtttgttatcaaacattagttagtttgttatcaaacattagtaatacatagagaattttggcaataacacatttagccaattctaaaaaaaaacttactttaggctgtgtttagatccaaagtttggatccaaacttcagtcattttccatcacatcaacctgtcatacacacacaactttttagtcacatcatctccaattttaaccaaaatccaaactttgcgctgaactaaacacagccttagcattgctaaattttgaaaatattcattttggcattaatatgaaaatattcacatacttaatttcgttgtaaagatggatgagggttagagctagaggttgattagtaagtactagtaatactcgtagtagttttgcgctaaacccagtccctgcccatttcgccctccccggccgtccccgtcgatatcacccgagccctaactcccgactccttcctcgccgcgccgccatggcgccccctcggcccgcttcaccacagagcttgccgcccgtggctgccacccgatcccgcggtcgcccgtacgagggctggactctcaaggagctgattggggaggtgcgccgtctacgacgagccgcctcctcggcgccgccccggccggcgggcgtcctcgacctcgaccagggggacgcgcgcgcctcggacacggtcgccccctcgccgccctcaccgtgtgaatcccaggagcaaccccaccatcttggcaaggttttgagtactcatcctctcatccacgtccttttccaagctcaaaccccccaccctttttaatttgttcgttcgtgcccgcagaggctggaggatgtgcttatttcctaacgggatgtcgccttccagttcatcaagatcggtcgacaagacgaggcaagcactacaaaattttaacgcgttgtctctctctctctctctctctctctctctctctttaaaaaaaatctatatatgccattccaaacgatagcattttgggggaagaaaagaacagtggacagctaatcatgtttacagtaggaacaaacgacgagacattacaggttttcagatagaaacaaagatcctgaagtgcgtaggattcgtatcgtgactaacaaggacataatactataatagccactaggcacagaaaatgcttcaacatggtatgcagtgtgcaccctcgctgacaccagtatgttgtttggtagatgctttgcaaaattgtatgcatctcttgtcaggaatgatgccattggcaggacaatgatctgtgaaaccaccagaataaagcacatatatcttggcttagcgacacatatatagccatgcccattgtatgcatcatgaacgacttacacatggactagcttgctggacggtagctctcagccagacaaccacactttacagatgcgcacatgcttttaacaaacaatttttcagagttcaagctagttcaaaccattaaacttggatgagtctaatatatcttttggagtttgatacatgacatattcttttttttattggtgtgactatacacacaacagacattgcgaatctaaaagcacacctatgggtattgatttgagtgcctagacacagaggtgcttgaaacgctgccctaagaatgttactgagaatggcaccaacactaacattagttaggccattaagattatcccatgaacaagaccttccttgctcattgtaaaacttcaggttatttgaatgcttatgcagttatgtggttatgtctgattgcaattcttttctaggtgcgtaaaatcgtgaatgtagcacacgatattgtggttaacttctgcaatgccattagagcgcccgaagcgttcaaattagtggctgctgctgaggtatctttttttaaaatggtcgctcttttttgagcatttgtttctatttatttgcttattttctttgtcctgtctgttataatctgttgacagaatgtgaaaccacatctgttgaagatagatcatgatgacaaccttctgtttctacaatttaaggctgcactggaggtacacgctgttgatgcaatatacaagtaaagaagtaaatgtcaccttttttccctgtagaatctaatctgtataatatgcagagggaacagcaggttcacaatgttaaccatgagattgctatatctcttgacaagtacaccaattgcccactgtccgggacggagattgcagagttaactcagccattgagaaggtacatcgtcagcaaaatatacttcagttattagctcctctatcacaaaatagtgctgttttagacagaaaaaagtccagaatccagatatcggattggttgctaaaaattccaatgtgcaatattgagcatataatttctggtgtgaaatatttgtaacacctaataaaaatattatattttcaatgcaatatttgatcggacaaaatttataaaattggaccatgaataaataacatttatttgtgattagatatttggagggagcactccctagcctaataactgcagcctacttcactgattattttttttctttgattcattatgacttgtggccacatattcgagcggcagcacatcatgaactacatgggttcctctctcaaggggtgcccggtcattggttagtataagtgttcatttgtaggataatttttcaaatgtgccatcacaagtatacaactggatttgcacaatgttacttgaaatgccattgacttcatcagggaatactattctgaaatggttaataggaaccttgcatgtaaaaacttctccatccatttgttagcacttagcataagtctacattattaggaagtatgatttcacaatgtaagtcaacaaaagaattcaagaacatcatcgatttatcattgcaatatttctatattctatctctgatttaataatgtaaaagaggtttgatatttctattatactataatgggggtatatggcccaatgctattagctttgtattggacttttaggtctttcaatgttggggggatgggagctactgtaatatttatcgtgaacaaggagggagggggtagtataatgccgccattatttatatgaaaaaaaagaagaagagagaacttggtatgtataccattccattgctttgctttatttggtatacaacaaaaacaacagctatgtgatggtgggaagtgtctagcactgtagtgggtctttttatctggtttgttcaacaatgtgctgcatggttgtggcaagtccaacaagtggcatgttgtgtgggtgagatccatgggtgatggtgtgagagtggtggcaaggttgttgcaagctatgtgctacctgattccatggtggtgacctggtggggcatatgaccgacatgtcccttatggataaggtaaacagcggtagtctgactagtatgactggcagttcctgtggttaatggctgagtatccatagggtataagacgtgtgtaattcttttcaagaagtgactagcaaagccattttggttaattttgtgagtgcaaccagtggtgctgagagggagggataaataacgctgatagtccttgacatatttttttattaaaaaaatattctagtaaggccattttgagaaatcttgtgcaaaatcagttgcatagttgcatttagccgatttctgatgttattttgtagttaagaaatttaaatgatggcatttgaaaatctctctttttttaaaaaataatgttttgtgttgaggttgtatgaggttctaagtcttctttaggttgtcctggtgctgtgtcaaacgacctggtatttgaggatgcagagcttaggcacgacataaagtactgccactgacagagagtaagccaaatggtttcaatccagttacaccaggtgaatagctcggtaactggatcttatatgaaaagagactattgttttctttgtatgcaggaatgtgcaagaggtttggtttggttacaggtcgaacaggcttcaattctgcaacgcgaggcaaacgtctgctgtgttttgtttctctgggcacctgtcatttacctttggcttaaacaaggcattcagcggttgatcgctgtgccatgcccttgtacatagaaacaaatattattctgtacatggaatggaagagttccaacacctgcaaatgaatgagcactgtcagcgttgggcaagtggttccgatttcggctggtgtggattttaatccgggattgaagatgcgtgcatcggcagatatcatatgccggtcatgctgttgttgccgtaacaattttttgtttctaattgttgctacttgctactccctcggttccataaggttccataataagttcatttttttatctccccgtctaccccaaaataagttcaaagttcatttttagtaattgatacatctgagtttgtgaaattaagtaggagatagatgtattgtgataaataaagtgagaaataattgcattgggatttaatagagtagaaattttttaatccgttttatgttatattggtatacgtggaatggatgaaaaataaacttattttgagacggacgatggaggtaataattccagcgatcgagctggatgaagctgtcacaactgtatcaccaaggttcgttacgttcacacaagacaatagggagaacgccagccaccgggcgcccgatgcggcgcgcatgcatccgacgctgctgccgtcggggtccaccacgccgcctgctgagccgcccacgtctctcccacacgcgccctcgtgctactatgtttcccaccacatattccgttgcaacaaatcacccacatattttgaaaaccctctactaatctatttctttttttccactaaaaatgtttcacatagtgtactcaatgtttcactatgtatagatctaatattgcagtgaattgaaacattcttttataacaaatcacccacatattatggaaaccatctattaaggatattcgtttcatttttttccacaaaaaatatttcacctagtgtacttataatgttttattttgtagtgaattgaaacattcttttgcaac

SEQ ID NO: 23971 - DNA, 976 bp, Oryza sativa
  unsure (1)..(976): unsure at all n locations
nnnnnnnnnnnnnnnnnnnnnnnnnnnnnnnnnnnnnnnnnnnnnnnnnnnnnnnnnnnnnnnnnnnnnnnnattagcccccatctttattcctctcacaaatcaagaaacccaattagttaatcaatgacctgacatacgagcattttcaaaccttcattggagaacttacaaacaaaataaccgctgacaaaatcataggaaaagcactaagagactaacaaaatctaatttcataaacattgtgaaaaacaaaccctagactcttgacatatttaaatctttctaaagactttaattaaaaatgcatagaaacttattgaacatatgaagagatctcctatttcctcgccgctaacatgggcactagagaggggagaaggaatgggacgaaaggacagtaatagctaagggcccccccaaaacccggagccatacattctttttacataatagattgaaaaaacggtctcgatattacagtgagaatcttaaactcaaggtgacaaggagacattggaggtggtttttcaaatttacatggtatttagatgatacaaagcaagcaagataaagatacattgttgatatcaaataatcctgatttcgcccctcggccggcgtgacaacgctgcgtccaaaaaagttccaattttcgcaatgagtttggaagagattttgtttctaaattcaaaaaaatgaaaaagaaaataaaaatgttggatcactgccatgcatgggaatgaaaaagtccgatcctgcatgcagtcatcactggttggttagtggttaccttacggttggtggatggcaatgctagggaaatgaattgtgcatacctgcacgcatcatgtatctatcggctctggtagtggtggcctggtgggtggggaggatgtatttacagtgataagagtatgttaaggtggtgtttgaaagttctgaagatgaagatgaagatggagattaagtgttt

SEQ ID NO: 23972 - DNA, 6640 bp, Oryza sativa
cacgtgtgggttaccgtagcacttatggctaatcatggcctaattaggctcaaaaaattcgtctcgcgatttacatacaaactgtgcaatggggttttctttttatctatatttaatgttccatatatgtgtctaaagattcgatgtgatgtttttgataaaagtttttgggaactaaacaggccctaggaaaaggcggtcatggcactgtatataaggggattctcaaagacaacagataaagcgctcaaagagtatgaatatgatttgagaaagatgaatttgtgcaagagatgattatactttcacagatcaaccacaggaatgtggtaaaggcttctaggttgttgcttagaagtggaagttcccatgctggtctatgaattcatcccaaatggcaccttgttcgagcttatacatggtaaatatagtagaataacatccatttcattggatgctcgtctacggattgctcaggaatctgcagaagctccagcatatctacattcatcagcatcccctccaatcgttcatggcgatgtcaaatctccaaatattctcctaggtgacaagtacatagcaaaagtgactgattttggagcatcaaggatgcttccaaaagatgaaatacaatttatgaaaatggtacaggggactccaggctacctagacccagaatacttaaaaagttacaagagcgccagctaacagagaaaagtgatgtttatagttttggagttgtgattctagagctaattacaggaaagacggcaatttattctgacagtgctgatgaaaacaaaagccttgcatcatccttttccttctggcactgaaagagaacaggcttcaatctatcttggacaagaacatattaggtgttggaacagagctgttccaagatgttgctcaactggcaaaatgttgcttgagtacaacggggggagaacggacattgacgacagaagtagctgaaaggttaaaagcaataagaagcacctggcgtgaacaattgattgagagtgctaacggtgaaactgtatgtttgcttgaaaactcatgacagtatgacccttccatcactggacaaagtggaagcttgatgacactacatttagaaactggtagacgatgagtatgaaagtaccaatgaaaggttatagcagagtttcgattagcatttcctgacataaatatcttgtaaaaatgtatcgttcatgttcaacaataaaaactacaggaaatcaatgagaacttacatttgacatgattttaacttacatttgacatgattttatgaggttcagtatgtccgcacaaagatttgccatggaatgatctgtcccctttttgttttgcctgatggtttgtcctactttcaccatggaagatcttcagagaaagacatagttggcacttcaatactggaagtggatgacttcagtgatgcagaggaagattggaaagatgctgggaggtcaagatggagagttggactgttggagactatgaagagttcctggaaaacaaccaccttttgcctctttgttacttgctcacttttgaaacttggttgagatggatggaatggaacttgttcctgaagagctggttgggatggcgccagtttctctagaagaggagctctgctcgtctcttgtcttcgttttgttaaacctctaaaacttcttcacacctctagttatggaaatgattttttttttgtgaaaacatggaagttggcgctaatacatagaaatagaattacatcacaaaggatgggaaaaaatcaatatatcaaaataaaggcccaaactatagatcatttctcgaatgataaattaaagtagggtgaaacatgattagaaatgttagacaagatagtacactaacgagccttttctgccacagtgatcacaatacactcttctgtgaataaacaacaactgacgattgaaggtctctatcaaccttgaagtgggagtgaaaaaatctcctaacctgccaaacaggacacacgttatgatgttagggaatgggaaaaacctaagaataagagagaaaatattttaattatcatgtcatcatgcaatgtagtgctacctatctgtttttaacattttaagagagagctaattcacaaattgtaactacaataaactattaactacctgagtgcaacaaacaataaccttattgtatttttgccatcaattgcaaagcaaaatagaacttatgtcagatgctcacctttcaacctgatgacaattctttctaggaagacataaattcacaaaagaatttagtaatacactggacacataattcttgagaacaggatacttgggagtcatctgatcgtgcataaaaaaaagaactaaaacatgaagggggcaaagacaacttaaaaatgcagcccatctttttattttagacatttctttattttagttgaatcaactaaattgtaagccttatagaagaacttgccaatctggacaatagctttgattttttccccacttttttattagaaataatcagttccctctggacatcagcagtccaatatctgactttgatattaattttcatatgcatatgctagtgcaaaattatattgcaaatctaacggtatcaattccacattactaatttaaaaggcattttagacaattactggtcgaacttagagaatttagggtattactaaaacatcatatatttataaacaggctactaaataaatgcgtatacctattgaactgagggaagaagagatttttaagattcaacagtgttttacctcttgaaatgaattgcgcagaagcaacttgacatgcctttcttcagattcaaataatacaatatgactgaacgaagataaatttccaaaaacctcgcccacaaaatctgctgggttcatgaggaaacggtctgactcatccaaggtccctttgttttcactggtaacatgcaaactaagtcaggataattggctatgatgggtacaacatggtaaaaagaaatgctatatctactggactagaaacaatgaaagaataatcacctaggagtacagtccaaaaagcgcataggtaggttgtaatgtaatgtagagtaataaggtgtcgaatggcaaggcataaggaagaggacactctttactcttccatcatgggcttctcgtgatagataaagcatagcatcttcagttcctctctgacataatgaaaaggtacacatacacataacagaagtaaaggaatcttgaaaagaaaagttaactaggcacaaatagaaagcaaccaaattaacccaaaacacacacataaagaacatgtttacttaaagtagtacttacttgatggtataaggacatatataaagccattggaacatttgttaggatgagcagaatgacagagagcttcaacctcgaaagtcgtcctttctcattgtgaccttttcccttgagttgtgccattgcagctaagttatgtcctgagaacatgaacataaaaggaagcaccgggagaacaaacctgttgtatccgatccatttatatcagggcatgtgtgtactagtctagtgataagagattgaacattacaaacttgtgcgaagagataagtacctgaattctttatgtccaagtatgctataaaccactaatacccagacaataagaccttcaagcctccattctcgagacttcaaaattccagaaatggaaaacggtaagaaagtccaaatcatcgatggaaaaccttggctgaagtaccagtggaacacatgtgttccatagtagtctcctcctgaagagaagaggttaaatttcaaaaaattaagtggcactatgatccgggaaccatacatccaacaatcaagaaacgttgtcacggcaaggacaaagaccctgcagacagattagaaagcatgtaaggtttataaaagtattcctcaattgtgagaaaaagaaaacatgaccttacaagaaaagcaatgcttcaatcatcaagcgtttggataacaaggcaatcctaattctaacaaaataaactgaagggatcaagagagctcatctaagaaatgatatgcataatgctgatgacacgataaacaatctatcgcacgtgtcctaaagctagtgtttgtgcataaccatcttacttatgaccatatggtaatcaaccatgcattcttccttttggtgccatttggcatgacagatggtaatgctgatccttcctgtcttgaacaatgtgaatgactttcttaacaacggtgcagcatgtggaaacacatacctactatccaatatgtttggtgtgtttttcagaaaacctactagcgagacaacttaccatgggcaacaacatcctaaatatcaccagcataatgcttattcaatgcgaaatttcaataaataataggcattagcgttatgatgcaaaaattcaagaaataacagagataagggcattataaaaatttgccatagacagcatcctaaattcatccaatttatacatatccagtgcaaaaaaccgagaacgaaatatactgtgagaataagtttgacatgaattttaaaatagtttcatacccgagcggaacgacctcgagaaaaataaaccgggattttgatttcatctgaataaaatccaaaagaccaacatatagccatgttatggcacttgttggccgaatagcacaagctaaggctgctatgagtagagccatttttcttgatggagggctttgcttgctggcagcctgctgctttgaaacaaccgaatttccctttacagactctattgcaacaaaccaatagtaaagtccagtaacagtcaaaactgtctccatgctgtttgagagagtccgtgtaatacagaagaacatgaaccagttaacaagctgtgaaaatagctggaaatgacttgttaaggtcaccattcaccaggaaaatggacttgtttatttacgaaaaaggaacatcatatctacataaatgagttcaaggatactgcccactgggcaacgtgattattgaaaatgagttttgaaagtttatataagtagagatccccaaaagatgcaaagactgattgtagaagacgtggagccatcgcctgtggggaaaaaaaaacaaagaaaaaataagaaaattctgcttctcagtgcgtaaaaaaaataaagccatgcagagaggagtgatatttgattcacatatatataggtttcctatccttttatagtgaaggacttgtttgcttaggattgagattgaacatagaacaggatacaaattgtggattggttagaattaagaacccaactgtaagctatcccaatcaattcccaactaagaatctagttacatgagaaactgttgatactgagcacttctatttcttttacatgtgacttaacaccatgactcaaaccagaatcctataactctaagcttcatttctaatcttcattcagagaaatacacaagaattttttggcgtgaattcaaaaaatagttaccatgaaccatggggaatccaagtggagcagcgaaagaatcttgtagagagcagcaaagatgaaggggtggaggtaacttcgaagaccacgcttccactcccaagtaaggtggccatacctgcaacgaacgaacagagaaggctcacaaaatgcagcagcttaagcatcccactcccttggactggagtgcccgctggattcgaagctaaacaccggcgaagagggcggcgagttttacccgaagacgatgcggtgggcgacctcgaggcactgccagtgctcgtcggggttgaagtaggtgcgcaccagcagcgcgttcgccgcgcggaaggccagcgccagcgcgagcacccttcgctccgatcccagcgcccacgcccacggcagatccggcctctcctcccccgtcgaagaggcctctgcggtggacgagccgccgatgccttcgggaggcggcgggccagcggcgttacgtcgcctgcggtggctcatttgcagcgaggcagccaccaccttccgcgctttgtctagcgcaaggctagcgatggggagtggaaggaggacgaggaggaggcgcagccgtcgccgtcgccggagtcgcggaggaggagaaggagccgcttatcgccgtcgccggagtcgaggaggagagtgaatttctccctatggtttgggccttttgggctgtggaaattcactctccggcccatttcaactgcattttcggcctgcagaaaaaaatattaaattcgaaatctatgggattacatcctgaaaaaaaaaagagattgaattcgaaatctttcaaaaccaacagaagcagcataagggatgatcatcctgaacagttgttgtaatcatatctgataagaatatcctcacaactaggcattaccaaccttgcatcgtgccgtgaatcatataggtttctgcaaatacaccacagggtattttttttgtctctgattttttctatgttatatacaatatgttgctgggtttgccaagttctaatatgccattgcatttttctgaatttttatgatatactatagtcgtctggtttgtctttgttaaaattgtacaattttattataatga

SEQ ID NO: 23973 - DNA, 4233 bp, Oryza sativa
cgaaccttgtaagcgccgcccctcccctccatgcgccgtgtcgtgtcaggcatccttcaacaatcaaaagcaagcaagagattagttgatatatggggcatatcatatatatggcctcaactagcaaaactttggcagttgattgctatcaggtttcggctgattttggtcacaactgatattcagttcagtcagagttgctgaaatatgtgctgtccactcttttgctgtgagatttggtaatttaacacttcttaaaatgggtttcgattgtttgattatcaaatcttttcttttggtcagatgctttggaacaaagggcagtggtagtaaccaacaagcatggggagaagctcgtgggagtgctgcatcacacgggttcaagcaagatcgtcgtattgtgtcatggttttatatctaccaaggtaacatttggaaaaatgcgtttgtaataagtttaaagtgagatgcgaacaaatgtttgtttagcagaaatgcaagcgacataaatttgtgtggagatagtttgtcttgttgcttcccaatgtaaattcacttctgttttccagaacgacagtctcattcttgacctgatggctgcattgacaaagaaagggattagtgtctttcgctttgatttcagtggaaatgggtaagtttgctccagaaaaccatgtcttcccccagcaatttcagttcttagaagaagctatagtaatactgctttaatcttagactatgggcatggttctttttcgcatgagtatgtcttagaatggggagaatagctactgtagtccctaaagtttctatgtaggatcattttagtccctaaccttttaaatagttcaaagaaatccttaaactttgtcataaggcctagaataatccttgggtccaccaaaatcgtcatatggatatgccatgtcatcattcatgcaaaatctatgataaattgtctagtttacctttatgtatatcatagaaaaataaatgtaagggtgaattagacataaccatagggaaaaaaatacttttcctttttttcacccttttgacgtatatttttgctcttacatataccatatattttttaatttttccttttgttttttattttcctatgatatatgtaaatataaattggacaaatcatatagattttgcataggagggtgacatggcatgtccatgtggcgattttgatgggaccaaggactatatcagcccatgtgacaaatttaaaggacttgtttgaacaatatgaaaaattaaggactaaaatggcccaggagcgaaactttagggaccatcttggctattctccctcttagaatgtacaactaatgatggactgagacttgatcttcttgtatctgagggaggtgcttctgtaattccgttgttctttaaaatgtaatccattatgaaatgcacttagtgaagcattatagtacacactatctgacttttacttgcataaatcttgttaattgctgtcttttattgttgcaatccgtgctgcttgacaaatatttcagagaaagtgaaggagaattcgagtatggaaactacaggaaagaggctgatgatttgcactcccgttgtatcatatctttgtaaggaaaagtatgatgtaacagcaattgttggccatagtaaaggtaggtgatatatgccattttgtagatctggtctggtaattctcatttctgttgagttattccattcagttttcatcattagcaagttaaaaaagatcgtccagttctttaacaagaacttgcctattacgctcctctgtgttcgatagcaaattagtgataatgttaaaaccttgttgcagcatctgtttggagatatattgctttgatggttttgtcttggcattcatttgaacagaacatgacattcttatattatttgttctgtggaacacatggagcatatcatatccaatttgttttactcccattatgaatttatgataaattttgcatctttccactaagcaaaataccaacatgatgtccctaatccgcaataccttttctttaatggtgctcttttctttttgttgcacagaatgtatatgtcctctcttctttgttgccatatattactaagttaaatttgaatatgtatctatttttccagggggagatgtagtaactctatatgcttctatttatgatgatgtacgcttggttattaatgtatctggtagatttgacttagagaaaggcattgaagaacgtataggggaaggatcaattgatagaataaataaagaaggctaccttgatgtcaaggataaatcaggtaaggcagcatgtgcgattgtgcaaccttaatcttccaagtttcttgcagcatgtatgcctcgagctttgcatatctgtttacattttgttgtcactttcatgggcatctgtcctacctggtgcaggaaatgtacagtacagggtaactaaagagagtttgatggagcggctcaacaccgatatacgtgctgtaagcatgtccattaccaaggaatgcaggttaggaaactatcctgggccctacttgtcccttgcttttgaacttgtaaactgaaacagcaaattactgcagcattagtgtttacggtttataacatagacgtgtatactaaaaaacttagaagtcaacaatgttaccttgtgctataatataacaaagatgccatgcacatattcagataacttgccgtctttgttcaggttcttcacagttcacggttcagcagatgagactatacctgtggaagacgcctataagtttgcgaagcatataccgaatcacaagctgcaagttattgagggagcaaatcataactacaccgcgcatcgcgaagaattggctgatgctgtagtggatttcatcacatctaattaggtatagaaaacctatctgttgaattattcatcctggtctctatgggcccttcagaaattactcttttctccacagttctgcatgtctgagagactgagacaacctcattcacgagagatgacttcttgtgatggaggatccttgtgtaggttttgtgccatttctctgccttttctcctctaaacaggtataaatctttggggaatcaaataagcagaaagcaggtgtatccgtgtatattagtgtaccatttcgtaggtccatattgaattactgatatgaattgtttcttgcagatgtctgtgtacctacaggattcctgtaaatatcaaactctatagtagaaccgtataaaatttcaggtttttactttgtactaagaattctgcgtgcaaaaggtttcagagcacaactgctgctgcttcctgatttcctggtagctggagtttttatctgggccgctattgagccagtttgatgtgatcattagttgggctgcttccttatgggccaagtccttatatacacgtggatagcctaggattcgagcctatccaaacaaggcctctagccaactactagcttcaattcatctatagctaatctaatagctcattcatacaatagttacatactacactattaatatctggtcccacctgtcatatacacactacgtcttagagtccgtgctacagctcgctacaaatctgtagcccgctgctcttctctctccttatttatcttcttaaaatatgtttgcagttagcttatagcttgctattgtacctgctcttatgtggaccaaaaattggttggccgtggttttcggtgattgtaattgagttgatcaagggccttcctaactggcgcagccgcgcacgctctctctctctctcgacctctcctcagtgctaataacacttattatagttgatgatattaattagcggtaatgataactgttagtattagtatttttttaaaaaaaatacataatagaacttttaactcagatttagaaaactttcaacttggatttgaaacttttaacccagctttgaaaacattcaatccagatttaaaaactttcaactcaaatttgaaaactttcaacttagatttaaaaactatcgacttagacttgaaaactttcaagtcaagattttttaaaaaacttttaacttagatttgaaaattttcaagtgaatactttcaatttatttttttaaaaaaatcaacttacattttgaaacttccatatctagttttgaaaattttcaagtcaagatttgaaaactttcaacttggatt

SEQ ID NO: 23974 - DNA, 12430 bp, Oryza sativa
aaaaaacacatatgttagcttttccggaaaaaaaatacaggacgtgggcgccgtccgcctcacgtatacgcgccaccgccaggttatgcatgggccttatgggcctaaaactcacaacgtcaacgcgcgcgcgcggctgatcaatccttctcaagctggcggaaccgctggcagttgattggtccagttggcagagtaattttctgatacgcgtcaattttatacaacagcaactcgatcaactggagagagccacgagctcacgacgaactgccaaggctatttaggtcccttaacgccctcccagagggcgtgaggcgtctagatttgtaaattttcaaaactaaaaattatttttaaaatattttaataaaaaatgtaaaaataaaaaaattccacatatggatacatatgtgtatcttctggtgtaatgactaggtgttagcattatcacaagttgctcatcgtttaacgatgaattgaaaataaaaaaatctataaaaaaccctacctaattttctacttaaaaagaagaaaatgtagtgtaaatttcacaacaccgcttttggggcacccataacgtaaaatccaaggtattatatatatatatatagctagttgaatgcatgtgctttgctttcgatggaagaaaatatattataatattccataaaacaaataaaaatatattttctataaaatgtgtttcacattcctttgctatagggaatattgacctcattttgattttatgtggctatccatttatatatgattattttaaaatatgaagaagtttatgattatgaatggtcacattatggttggaatactgaaacaatttgcaattagggaatggagggtcggccttagcgagccaaccctatctatttccacaaattatgccggccatatgtcttgatagccatacaacacccatggattgatggatgtggcacacatagccaaccgaccctttttaattcctacccatctcataccgctcctatttgtagcctcctcacacccgctcccgcacaacttcccgaggtggtattattcagatcctcggcttgcgcgggtgagatgggcctattgttattttccaccctagcggattgttttgcaaaaagatcatcgtgtttgcacggaatatcgcatacgtactcggcagcctgacacccccattgtatttattatgtataacccctcggcgtccagtaaaatacaacgcgaagaagagaaaattccgtttctaagggtaccgttgtaaacaagacaaccatatggggttttctgcaaaacgtgatacactagcccccaaactgaaaccctcccggattcagcttcagtgacatagggtatgtatgtcacacgatgacataccgtgcatctcggtcatccaaaccgaatccaacggctgcaataattgggcccacctgcactctaaagtatctttgcaggtaaaggtcgcaataacctccacatctcctcctggagataaggaatgttaaattcagtgactggatttctaagattaccaagtgtagaacttgcaacaaggcatggcaaaattcaatgatcaagggatgcgatgtgagacagtgagagtaaattaaaaaaaaatccagaaaagtgctatgctaaccatttagaaactttatagtattttctagcagtagattgttttgatgttacagtcaatgtgatagaaaaatattcagccacaaagttctccaccattttaactcctgcatagattgtatttgaaacaagggtataatgccacgaacctttgctgtgaccaacaattgctttcacatcatatttctcctgattaagatgtgaaataacagaatgcaagtcatcagcctcctttctatagttcccgtactggaattccccttcactttctctgaaaattatatagtgaaaggcttataaatcatgcattgatgccttcaggggaaaaagggtagatctgaaagacaagtaacatctaaaattcaaagaaacaacagaaactaataatataaaactaataatttttttatatttatgttatccattttatattttttttcgaatctttttgccatgtttttcaatgttaaatatcgtacaaacatatattcaatgttaaatttaataaaactaattttatgttgtaaatgttactccctccgagttgataatacttgtcattttggataagggcactgtctttaaaaaaacaatttaaccattatttttcattataatatatataaaagtgttaacaaatatatgattttattaaagtactttttaagactaatctatatacgtagtcaccatatttaaaagacaaatatttcaaaaaagatttataattaaaaattctaaagtttgacattacccttgtctaaaacgataagtattatcagcctggagagagtactattttttttctataaatttagtcgaacataaaaaaaatcactaaaaaaagaagttaaatgacttataatacaaagggagtagcacacacggcacaaagacaaacttagctttcagatacgtttgacatcaattttctaccatttttgtagaagctcatatagtactatactacaaaactatgctccgtacgccccaaggttcaacgggccagggaaccttccaacagcccaagccaacggctctccccagggtttacaattccgacgaaatccggtcggatttcacgaaatttcgacgaggctcgaaagtagaaaccgtctgagatttcgaggagtttcatccaaatttaaatttaaattgataaaaaagaaaaaaataaaataaaatcttataaatactatgatattcatagaacctattgggatataaattttcgaaaaaaatgatgtattgcgtgtatttactaaaacttacatcaagaaaaaaaatttcagcaaactacctctattacaaattacggatcgaaatttcgatgatttcgatcggaattttgccaaaaccaaccggttttcaagaacttgtcggtaaacttagggaatttgtattcaaattttggtttatgaaatttgttcggaatttaccggtttttcacttgatttcacgaaatttcgaattccgctagtgtccgaaacggaagggcctgtcagaattgtagaacctggctctccctctccagggttcagttgcctccctgtcagtcactagtggaacacagttctttagctacccaaaccaactctccgattagattcggcgatccctcttcccccctctcttcgctgcggcacccccgggaatcctccgatccaatccggagcacgccaccgccgccgccgctgccatacggcagccatggcggagccgctctcctcctcttcccagggttcatcggttccctgtgagtcccccttgattttttttctttttttcttttacctcccggattcatcctctttacttgaacgtggattgtttagattgctagctgacggacaagagggcgttctttttgtgtgtatataattcaatgatgttttggccaacgaaaagaaggggaagaaaaggagaagaagattatgttactccgatataataattaagggcctctcgttgttttaacttttaaaatttggcttatatgcataagcataagcgaaacaatggggctctaactctattatatggtttctaaacagctgctcaggaagaaagggtagtggtaacgaataaacatggagagaaactcgttgggttgctgcagcacatgggttccaacaagattgtagtgatctgccatggctttacagcttccaaggtgcataaatatgtcgttacagaagaaattccctttgtactattcaaaatatgtgggtcactaattttttttctcgatttttgtctgagaagcaacaagttttctaatttttagcttttttttttaccaacgtaatgaagcttgactcttggtctcttgttttcagaatgatagcatcattgttgatctagcgaatgcacttaccaagaaaggggttggaatcttccgcttcgatttcagtggaaatgggtaggttgctcatggagctagagataatatgtacgatgctgatttaagttcacaaaagctagtgttgtaaatgctattctatcctctgttaattaatttcaccggtggcattcaattttatccttttctggagttcttttcgggaatatgcataagacttccgtaactttgtattgagatttcaagtagagctttgttttcacatcagctaaactagtgaaaaagggtaagaaaaagaataacagcaattgaaggctacatctcgcggttggttgtgtgggtggaagaccaaaaggtaggccatcagattggcgctcctgctgtgcgccagtgggctgcctcttcagcatccgtggcagccacttcccttttctagaggtttggttagaagttagagcttattagctaaatgagctgaggttcctatctgttgttcctttgaattttaagatgttacttgtctttcatatctacactttttttcccctgaaggcatcaatgcatgatttataagcctgtcaccatacaattttcagagaaagtgaaggggaattccagtacgggaactacagaaaggaggctgatgacttgcattctgttatttcacatcttaatcaggagaaatatgatgtgaaagcaattgttggtcacagcaaaggttcgtggcattatactcttgtttcatatacaatctatgcacgagttaaaatggtggagaacttcatggctgaatatttttctatcacattgactgtaacatcaaaacaatctactgctagaaaatactataaagtttctaaatggttagcatagcactttttctggatttttttaatttactctcactgtctcacatcgcatcccttgatcaatgaattttgccatgccttgttgcaagttctacacttggtaatcttaaaaatccagtcactgaatttaacatttcttatctccaggaggagatgtggtggttctgtatgcctctatctatgacgatgtgcgcacagtggttaatctctctggtcgatttcatttggagaaaggcattgaagaacggctaggcaaagagtttatgaatataattgacaaagagggttacattgatgtcaaaaccaactcaggtaaggaagttcctatcagttattgcgacctttacctgcaaagatactttatagataaatcatatacactgtgtatgcttacttctctttcacgcgcattagttgactgtccgtcatttccaatgtaggaaaggttttatataaggtaacaaaagagagtttgatggaacgattgaccactgatatgcataaagcatgcctttccatcagcaaagaatgcaggtcaggaagctaactcaaccgcttttacccctatattcaaataaacagcagtataagtgcttaacatagctgaacatgctattctcttgcattcccacagctgaaatattgaatgcatatctcttatgttttggacagaggtttccagttgtaccagattttgaggcaactttatttgtctttgttcaggtttttcacagttcacggttcagccgatgagatcattcctgtggaagatgcatacgaattcgcgaagcatataccgaaccacaagctacatgtcatcgagggagcaaatcactgctacactgctcaccgtaaagagctttctgatgccgtggtggatttcattacatccagtgaggtataatgcagagaaagcaatttattcacctgttgttctttgtaggcactgtctcttacagtctgtttcaacagtgttttcatatgactgaccctgggagttgctatttttgtctgcaggatggggataactcgtcggcataagatgaattgagttgtgatgggttgtttctgtacacttatagaccatttataagcttgttgaagttgccatattatccccatctgaagaatcctggatgttggccattgtgatgtgtgcattcagtatttcagtattgtttctgatttattggtttggaactgaaattctgaaactgtaccatatttgaataagcaataaagcgtcgcaataaatcttttcaacgaaacaagctacatccgttgcgcgttgtaacctgataacctgtctgagaagtagctatcaccgaccttaggccctctttgtttaggcttataagccaacttataagccaaaaagtctaagtctaaacaaataagcagctttttcgtttggcttttttgaagccataagccacttaatagttaggttggagaagcttttttggcttatatgagatagatgtatgactccaccacttaacttaagacattaaattcactggcttataaatcatgtaagccaataagctgacttaaaagtctaagcaaataagtctaagcctgaacaaagagggccttagcatgatctccctctatatgaagctcgccccgtgcagatacctgccatgcgacgcctagatgaagcctatatatgcttaaaaaaaagataaaaatttgatggtcgtctagttattagtgcaacactgtctagcacctatggggtaccaaatttgttaccgattggtatcagaatttgatacttgcttagtatcataccgtttggacagaatcccgtggtatagcagcctccttaaaaaaaaccaaaatagacaaagaacttcgaggcaagaattagttaaaagaaaatctccagtagcgccaagccgccaatgatgttaaaatgccagagttccctgaaactggagccacttgactcagtattttgggtaacaaatgattacttgacaccatacaaaatgctaccgtttctgccaacaaacaagagacaagtgtaaaatccagaacatgtccttccatggaacagcaggcaaaagaaaaaaaaaaacaaggccagcagggcagccagtgaaatgctaatcacaaacggggaagagactctgccctgatgaactccttgagaagcgccttctcttcgttgatcttgttcttctcagcagcattgcgtggcttgatcttccgcttctcttccagcatccacttgtagacctggcgctgttcgtcttcgggtattggtggaagcactcttttgggtggaggagttggaggagtaggatctacagtctcagcagctggggcagctggggatgacaatgctacaactgcagctgcagcagcagcagtctgagcgttcttcttttcctggtctctcttgtaggtctttgcaaatacgtaaactgcatgtaaaaggaacaaacttactgtatgaaaatagctttcagtaaaccaaatattagtcaacacgcaagaaatgaacagtaccatcaatatgtactatcagaattcagaggcaaacctacctaagctttcaatattttcaatatgcaaaggccaggagtagttgcaaagacatattgcaagtgggacaaagggcaaataaacggttagtgccaatggttttgtgttctgtggccattttacactcatggatgaccaccacagtatttccctttccttcttgcaaagaagaaatccagcagataaatgtaactttcgatacacaagcacacagcgtcaagcgagctgtatatttactccattcagtagaacccagaatacaagaaaatcaagctagtttgaggcatagcccatcctttaatagaaaagattcatgagtataccgtactatacattctaaactctataaggaatgctactattgcccagtatgattcattgtaattatacttgactaaaatggaaaatacgtaaaatatatattgaatttatctttgtaacagcaaagccctcaaatttctcattgacaaattgaattcactcaatatcacccattaactccctactaaatagtagagcagagtagcagacactggcccactcgcttatttttttatctagacaatccaaactccacggcaagaaatgtagctaaaatttggattgcaacccacaatccccagcccatccccatggatagctcacagatcgtggatcccaaaccaggcttcagtgtattttgaccctagtcctgccagtgcgaaatatactccaatacaaaacatcagtttaccatgtaaaatagaggtatttatatttggtaccacttggtgtccacaacttgcttcttttatccctcctgcagcaataaattctactacctccgtttcaggttataagactttctagcattgtccacattcatatagatgttaatgaatctaggcacacatatatatctagattcgttaacatatactcctatatgaatgtgagcaatgccagaaagtcttataatatgaaacggaggaagtagctttgtcggtcccctataagcgaaatttgatgttcccagccacaaaccatccatcattccagaatacaaggagctaaccacctagtcccacaaacattattgcataatacaaaaccaaacactataggagaacataaacacttccgcttgttgcttctgatagtaaattcgaggcccaggaataaccgagctatgtcagttcatcctacttacacaatcctataacactagtatcacaaatgctctaataataatctctatctgatggtccaaaatccactccatgtgttagtaaaaatgcacatcatatctacaacataacactgaaaccaaactgaggtgacctagatgaacaattactaagcgcatttagcttgagactacagctaaccctacagtcgcacaaccgctcctaagtcctaagtcctaaccatgcctaacatcatccatccactaggcttttgcgatccttctcgctcggatccacacaacgaaagaaccgcatcatccctaagaggcatgtctaccacatgggagggagggagatcgatccaggcacagggggtctctcacctccgatgaagatgttggcggcgaggaggaacgggaagatgcggcgcatgaagacccccttcttcgccgacggcgcctccggcggcgacgcggggtcgggcttgccggcgtcggccatcgcggcggggtgcggactggaagatcgcggtcgacgggggggcggcgcggcggctgagacggcggcggcggcggcggctgcttctgagcctgaaatcttctcccccgccgcgttgttctaatcgtagccgttcatcacgatcagatgcacgactttccacgccgatggggagatgggccgtgctggccctgcttgggctggatattggatttaaaagaaataagttcacttcaggtcccttctgtcgagggtgagtttgaaaaacgtcgttgaagcacattatcagatacaacgcgtccctaatctagcaaaaccaggtcaaatgggtcctacagcagtattgagggggcatttttggttgttgtggtgttgatatggcgatagaagcaataataataataataaacccacgtgggatccgcatgtgaaacaacatattcttcctcatccccttctctctcccccatcctttctatcggctgggcggcgagaccgcgaggggcagaaggcaaaggctcggtgcggcctggtggcttgaggtccctgagagcccccctcgacattcggccactgctgttgtgtggctcttcctgtgcacctcgacgcaaatcaggagctcgacgatgatgaggtaggtgggaaggctatgtatggctcatggggcgagaagactgtgactagggtgaaaacggggcggatatttcccgcccgcccacccgaacacattattttgggataaatttgggtaaagaattcaggtacccaagatttttcacggatatcgggtctgaatacgggtcttttttgggagcggcgatgaggctgaccggtgacatgggccaacgagcatgagctcaagaagggagaggagagagataaggagaggggagacgcaacccaattccatgtgggccccatacttttattttctttgttctgagtaggatgccatgtcagctaaaacagatatccatagtgttttaggaccttatttaatccggctttataagatggtgattcaattttagtattgcgctttagggatacgattcaaattcgacgtaaaaataagggacttgtttcattttaaaatctaaaaattacataagtgctaaggagtgaaagtttgtttcttaaatttgataagacccacctatatgttacacaaaactacaagaactttggcatgtgacacataaccttaagtattatggtcctaaaatttataaatcacaccattaatcatttttatataatcctgtatcaaaattcaaaaaagctttgcttacatagatgcgacattcatatgatggataaaaacttataaatttgagaacttgaaattgtggtagataaaagtcaaaacccagtaattttatgcaatttagaccataatatctagggttacatgaaatttactcttaaattaattaattagtgaacttttgtaattttaatattcacactttcaatgtgaaactttgaatctgtgagttgaggatttggaaatttcaaacaataagtttgcaccatcgaataataagctttcatgtgatcgatatctaagctattcctgaagtttatttatcaaatattaatttagcgttttaatcaaataaacaatccgttctaataatttgcacaaaatctattttacaccgggtttaattgctagaaatcaagaactgggtgtctgggttgagaggacaaaacaacgagccatgggataatatttctttttcctccggttgctttcatgcaagctgatcgagccgccaaccatccatctctctcatgtttgctactaggtcatagatccaatggcatgcattaattggaatagcttgttgcgttttctttcatttctttttcttcttttttaaacaacggagattgatcgcttgtcacgttatccatttcgagagtatctttttcgacgttccatcatctcttatttgcttgttttatatcaagaaagagacatgaaacctgcagagtgctgttctcaactgcttggaggtgatatgtttgatgacacttaacacacatcacagggtttaacacacatcacaggtgtctgtcaacacctcggaaggggtccccttgggatccttttgtaactttgctggtacaaactcggtttccctctcttctccttttatgaaataggcagagctcctgcttttacctctcaaaaaaaaaataacacacatcacagtacgcgtaccaaggtatagttgcgtaaacttattggagcagtgactgtgcacccctagtcctatcttaattatctttagtcttcacttttctttttgtaggccaaaattcaggagaacatgattttaaaaccaaagcgcccttaactggttgtgtacggagagaaggggagaggggagtggtgagcggcaacaaacagcgtgcaggtgggcggcgctagaggctgtgtcctcaccgctccttcagggagctgatgagggcaataccctcgcacgtcgtcgcctccccctcctccctccatggctccaccccgtcgtccccactgtcgcctcctagcgagtcctctagcataggcggtgttggaggcggtgtgcaacatacgatgagcgtgcgggcgggccacgctggaagacgcgccctcgccgttccttcgtggagccaagggcggtccaacccccacccccgtatcatcgcctcctcctcctctccctccacctcatcaacttcgctgtcgttgcagacaacccctcctgtcgcgcccgctaccctctccctctcactccgctcaaccagctagggtcgttttggtcttaaaaccctccgtgacattctaatcataagacaatatattgagtggtattttatttggtgtatcctattgaatggcttttcattgaaccacgcgaatggagcaacatatcgtccgttttctcaaaattcaaataagtagaagatgggagaatcatggttagggccatcgataatgttttaatactgatatagattccattttattaaacaaaatacagaataatatgtactactagaatccatcttaataaatatatcctccattgcaatttttaaatttaatattttatgaataagtttctgctagaatatgtgttggagtccgaatttagtatgatttctgatttaataattctaaaatttggaattaataaatatcaagttttgctcggtttgaacattatagtctcatttatagagtactccctccatctacttttgatagtcatatttccaaatctgaaaattttatttttgatagacatatttcaattcgaacaacttatcatcttaatgactttctt

SEQ ID NO: 23975 - DNA, 2111 bp, Oryza sativa
tattggctggtaggattggaacacttggcagcttgtctgtcactgagtcgtcacagtaatcatccagcaagcaaaagcatgcgtctcagaaaggtttttagccacaaaataatctaatctggtttgccctaatcagtgtgtttagagaaatgcaaccgtgtgttttctaccataagtattcagcgtcaattgtcaatcgatctttgaagtagcatggttgcatggatgaagtagaaagttcagccaactgccctaaaaagagcatgatccaatcacagagtgtatgtaaaaagataaactggaatgataattcccaaactgaccggatacaaaaacgttgaatttcccgagtcctacaaccaatcatatatacagttgctcactactatgctccttaatcctgaactaccgagaggatgtatgtacacgaacttgattgtctgctaaaagttgaccaatttgctgtcatagatgagcctcggtttgcagaaaaattgagtctcaaagcattgatcttgattaacaatcaccaattgtggttcttcagcgagggctcatgatgaattctcatatctgtttccattcctgagagctggccaagaaacatgcagcacaaagttggcaggatcagcaggcaacctgtcaccatcatccggggatcttgcgcagttcaaccttcaagtgattcctagattatgttcaatcttcaaccgcggtgttgaagacaaaactagggaaaactgtcgtgatgtccctgtagtataagatggacaaaaaaataacaaagtaaataacgaggaatttaatgaagtcctgactggtatttttttcaaacaatttagcagtagtttccagacgagatttctctgcgcaacagtatatatttgacagaacttaatagtccagttcataaagctctcaagctcatatttaataccttagataaggcagtgtcatgttcttcaatagattaggatgccgcaatacgaattccttccattcttgttggtttatttttccatccctatcagcatcagcatcttcaaatgtctgaaatacagaaaaattgtagcaaaacttaaatccatgcagcaaaaagggcatgttcacataggacagagccgaggaaatgattgatcaccttatcaataatggcctcgagaagttcttctgacaatttcatatcagattccgacaaaatagcgataaccatttgcataacctgcaaaacagaccatgccgtcactaccagatttgtactagaacacaaataacatacttgttgcaaattaatacagagtgccttgatgaactaacctcctcacgctcaataaacccagtttgtctcaagtcatacaacctaaatgcaactaaaacaatccaaagggaggccttattgtaaatatacctcgatacatgaatttaagaaggtagtgtctgaaagaagtgtacttacaatttatcttgtcttccaatggtgccaatggatggaagacgctaagagcatgaataaactcatcaaactctattacaccatttttcttttcatcaaataaatcaaaaacctgtatcagagagaatttctttcagtggttatacttataccctctgaaagtaacatgccatggaaataaactaacaattaaaaggagatcaatggaaaacatagtgcacaaagtggtaaatggtcaaataaaatttatagtactaaagagagcaaatgaagtaaacactcaccctatcaagaaaaagattctggccgcttggagtcttaaacaatgccagctggagctcttcctaaagaacaattcagcataggaactgttacgtatgacaaatccagcatagagagcatttcagattttatttgtctttctcaagtttttattaaaaaaaacattcacttccattaattacgatgctcctgaaaatacaaattaaatggtttttgttgacttcgaatgtttgtatggcaaagatactacagtgtttttttaccgaaaaacagccatgccatgcctttcccttaaccaataagggttacagttgctcacatagtgtcccatgagaaggaacatgccacccaaacaatttgagaaacaggaactatt

SEQ ID NO: 23976 - DNA, 2990 bp, Oryza sativa
ttattgttttctattagcatactttttaaattgttacttctagatgataaaaaaaagtatataaaggtttctatcaaaagtaaagaaatctattttttaaatttataataatcaatactcgattagttatgttttaaatggattagtttcgtgtgccgtagaatcaaatctctaacttcatctatagattcttttattaggacgcgctaaatggaaaaaaaataaattattttgggggcggagagaatactgtgttgctgggtgcgcgttttgccggctagcgctgaaattctttggccggaggcggcgaggcgcttcgcgccgggacctaccgacgaatccatccaaaatttaggaaatggttaccggtaatgaactaatgttttatgtgatcagccgtacagctctggctccaaagtttttgcagctcggtatttttaactttagaaattataggtcaggattttaaattctagaaattatagatctagaaatacggagtatgattacatggataagtaaattattttgattatatttttaaataacacaaccactctaatttaactttgaaaagtctaaatccagcgcgagtgagttgtgatctggagttgtaccgaacacggtctaaggttatgcttggtttagattcaaaaacgattctaagttttggattaattatagcggatttacgtccccaatttcgctgttcaattttcttcttgcgatggttaacgagacaagtaaattttttttccttcttaaaatcatcttttctttaaactatttttcggaacgtaaaaagtttcgaattttaaaatcgttgcctgctgctttgcttggcaccggagtacgttattggaaagaatggttcgctttcaagtttaaagattcggttggcgtggatgaccatgaattcatgatggtctgtctcagctccgttcagtctctgtccctcaagtcctggaccgcacggagggcgaccccacgcagcgcacatcgccccatcaggttgtgcctttctacttgtcaataaatatattgtcaagtctataggagtatgttggacgttatccatccccgtcctggaaatatctcgcttaggatagtcccaacccatagtattcataagtaatgtttatagtaccatgtcaataagacattataatagaaactacactctacaacccatggtttcttaaagtgggctattaataaattgtcggctctcaaaactaacgattcggaaaccgacatgtttaactgtatcaagccctggatcagtagattgatacaggttcaacaatttagatcttcatcgcatacatttggtaaagactccaaaggagatatctttatataaaataataggacatttacaagtttgtggctaactattacagcagaggctatacgatgactcaactctgccgttttactatagaattaaaccatctaactacactagacttgaagattaggtttaaagggaactaacttatgtgattgaactcccagcttcggcaaaaactccaattaaactctgaaaaagaggggttgaagcaagggtgagtacaacgtactcagcaagctattatattaaccaataatgaatatatgaaatggtaatatctgtgtagagctaggtttacttgcagaaagctgagaataaagaggtagaaatcctgaaatgcttgatatgcaacagtatttaagaaaatcttgaattatatttctaaccaaagtaccatatgagtcccgatgctcaatccgtgagcacggctattcgaatagattcaaggatattcatattgcagtagatgtacgctttacccgcagtctacgacttgccaataatcattagcttagtcatggcctagtattaggttattaacaattgtggcacctgttccatgaactctagtccacatgcgctctgaatgtaatgttatcagcagcgagaggagttctggcgttcccggggtttttagagagaactggatgagagaccccatgtcatctcaaccaggttttcataaattcacacacacatcgcgcgataatcaagatatttacctgcgcctcggtaaatatcacatttgcccttcgcggcatatatttgcctccttcgcgaggacttatataagaaccactgtacagaggtaccacattgttaattaacataatatctaggtctgtccccattctagaagctgcgatcgtactcgttcgtttgacataagtacttggtaaacttatatcgaccgagacagtactagccacccggaaatcaaccaaatcttgcgtactgtcccaatctaagttcattatgttttatgcaatctaactaggcagggctaagcaaaagctagcatataactggtttgctatatgttcagattatgcattcaaaatcatgaatggctaatgcatagaatagagatatagaatataggataattatgctcaaggggaggaataataacttgccttgctccaacgcaaataaatccaagataggcaacctgattatacgattctcgaaataccataggttgccatccaaaagacaatagtctttactgagaaagaggaagaaccaaattcaataaaagccataaaataataagaaaacgataaacgactaagagggctagggtttaaggtataacctatctcttttatagggtatagggattatggggctagtatttgctagtggtaggttttggtagtataatagctagggtttagttatatgggagtcgactgtggagtaggacagtatctcggctaggctctatattttatgtggaggctctcgtggtttggacgataggaaatatactggatagttgatatggttaaataggcatgtggctaatatgggttaaggttggctttgatagaatagtggctaaggtttagttgtttaggccgatatcgaggtaggataaatatcggctagggttttgggtgtttgctagttg

SEQ ID NO: 23977 - DNA, 1755 bp, Oryza sativa
  unsure (1)..(1755): unsure at all n locations
ggcttttgaataaattaaggaaattcaaataaaatcttaaaatagcaaatttgatatcaaaatgaagagttgaatttagatgaatttaggtccaagtttcactagaatcggatctacggtttaggagatatgtgcttctaaagaataggatttgaattaaatctagaaaatgagaaaagtcactgtgcaggggcccacctgtcagtctttctttttctttttcttctccttcttctttctcccgtcatcttcttcctctcttcttctttttcttgccggctacacaggagagggagagagtgggcgccggctctccggtggacgaaaggcggcgacgtcggcggccacacatgttcccgagaacgacgcacctggggtgggcggtggctggcggagagagtgagggagatggccggaacggcgagtagaagagcttatcttcggcggcaaagagaggtggcggtggtggttgctatggggtgggggagaagggggaaacaggaaaaatggaatcacctcgtcgaggcgaactcgatggcgcgatggtttggcttgcgaagctccggtgagggagatcgggtggtggcggccatggccggacatgggagagaaagagagagagatggagctctgattgtatgtagagaaagggagggatggccggctatttataggggaaaaaggcggtggtgaaaggcggttgtggaggagatcgagaagtgcacgggcgacaatggcgtgaagattcgaactacggcggccggcttcgtttccttagcggcgaaggaagaggagttggcggcggcgtgagccgtgcacaggaggagggggcggctcggttggggtgtgggctggtttgggccggctcggcttagctgggccggcagctcaagaaggaggaggaaaatagaagataaaagaaaagggattgggccaaaaaggaagaaagaatggagtttcggcccgatgacaaaaagaaagaagcctaatttgaatacttgatttggataactaggttttgcaaagaatttgaatttggaaagaattcacaaaagagatttcctaatttatttgagtgcaatatttagaggtggagtttgagggaatttatttggaagcactcaaataggaatggaaattaataatattcctcaaaatatttttgggaatatagaagggaattagttgaaggcaataaataggatttgaactctaaaattggtgttatgtatatttgtggctaaaaggggaagttgagtgaagaatataaattggaattttcttagcacaagagcaattattcacaatattgcaataatacaattcttgtgccgaagaggaaatcaagccacataaattaaattggtggctagatcaaaaggaggaatttggatatttggatcgagaatcaaaggatgggtttaagatcaaaggatgggctaacaattaattccaatgagattggaattactttggtctaggttcaaggacaaaaattggaggatttcttggaccataattcataataataaaaatggtttttaaactaaatttgaataaaagagttttagtcgaaagaaggtttaatatttgaaaatagaatttcaacaagaaataccaaatatgtttttaaatgaaaaacacaaaagggattaaataccagagaggttttatgcgagttagttttagnnnnnnnnnnnnnnnnnnnnnnnnnnnnnnnnnnnnnnnnnnnnnnnnnnnnnnnnnnnnnnnnnn

SEQ ID NO: 23978 - DNA, 1166 bp, Oryza sativa
ccaacaaaacaagacatgcatgcatgctactgtacacggtgacaagcaaaaatgagtttgcagattcatactcatttggggctgctccgtattaaacctccaagccatgaccaattcggctatcgcgttgatcattttacttttataatctaattccgatgcaattcctacctcgtcgggtcatccaagctacacaattccatacatgtcttcaacaacaatataaaccaacacatcgtccaaggccgatgaggctaaacagcagggcgggaggagtcgacatcaagacgacgtcaccaacaccggcgtgcggaccgacgaggccgcgaataccgccggcgcccactcacacacatctacaccatcatcaccatcatgcatggaggacgtgaagcgaagacggatgatgacgaccagcgtagcttaatcggaggtatctcacgggtttaactcgcgagagtaattaaccgggtgtcttccgagaccccgggaacaggagatcacaatcgccaagtcagatccaccttacctatgagccgtggaacgcatttgacaaaggattttgttttttttaattcttcaagaattataataaaatgcattttcctttgtccattttatttttgtgtacctagtacactggcacgcccgcgcatttttattttattttatttccctgggcggagggatgaaaatttaatttttctctccaaacaatatgattatcctcatttcggtgtaaaacatgtttttagatgctattgttcctattagcatattcatgtttatcactatcctagaatcactcttgtttagggcccctttgatttggaggaaaaacataagaattttggaggatttcaatcctataggaaaaattcatacagatggctttgaatcaatggattgaatcatatccaatcctttgaaattcttatggaatggacaatactatagagattttggagaaaaattagcaagagctcaaagctcttggaaaaatttctgagtctatctctctcatccatttcctgtgttttttttataatccaatcaaacggttattcctgtgttttgcaatcctctattttacacttcaaatcatgtgtttttcctattctttgttattttcattcctgtgattcaaatgggcccttattgtgtta

SEQ ID NO: 23979 - DNA, 667 bp, Oryza sativa
aacgagattctctccatgtttattcgttaccactaccctttcttcctgagcagctgtttagaaaccatataatagagttagagccccattgtttcgcttatgcttatgcatataagccaaattttaaaagttaaaacaacgagaggcccttaattattatatcggagtaacataatcttcttctccttttcttccccttcttttcgttggccaaaacatcattgaattatatacacacaaaaagaacgccctcttgtccgtcagctagcaatctaaacaatccacgttcaagtaaagaggatgaatccgggaggtaaaagaaaaaaagaaaaaaaatcaagggggactcacagggaaccgatgaaccctgggaagaggaggagagcggctccgccatggctgccgtatggcagcggcggcggcggtggcgtgctccggattggatcggaggattcccgggggtgccgcagcgaagagaggggggaagagggatcgccgaatctaatcggagagttggtttgggtagctaaagaactgtgttccactagtgactgacagggaggcaactgaaccctggagagggagagccaggttctacaattctgacaggcccttccgtttcggacactagcggaattcgaaatttcgtgaaatcaagtgaaaaacc

SEQ ID NO: 23980 - DNA, 663 bp, Oryza sativa
caattgatccgccgttcccgtgtggccgcctccagatgtgccggttccatcgatagcatacacgtcgcgcggtgtacttgtcgatgatgaggcctggtctttgagcagatgtaggatagatggcttgtggggatcaatatcgattaccctaacgaatcaatctgatgtagtcgccgcaccttgttccttgtcagcatctcgagaagagatttgaaactgctggaccttatggggtgatatcttcatggcgttgagaaggaccttgcagcttgagaggtcgtgagtctttgcctggtggataggacaatagatgtcacgagttggggaagtacgctgaattccgcactcttcgcaggcacggatttcagctcgtacattgaggaaaacgaaacaagcttgcaaggtgtgcttgctagtcctatggacgggacaccaagctcttgtcgcccaggaagctgtcctcgtcagctcgcatttcttgtggggaggacaagatctggccgcattaggatccttctcaggctcgggtattgtcgatgttctgttctccgcttccgcgggaggatctttcgacatggggttgtcgaccggggtcgtaaccacaccgttctcgctcccgataattgctgaaccagtcgagatcggcattgtggtgtagaccgg

SEQ ID NO: 23981 - DNA, 511 bp, Oryza sativa
attcttcggtgtgaaaggaggaatgtttggagaccgtgattcacggcgcgtccgtcggagccggggacgacgagccggagatcgtggcgagagtcgtgatgcctcccgccgctgacgacgacatggccgccggagcaaacgccggcggtggcggcggcggcggcgaccgatcggagaagaaagagcgggaggaggaggaggatgaggaggtggagaggctgaaggagctctggctgtcgctcatggagcgggagcagcggctgcagctgggggaggcggagctcgacgagctccgggagcaggacgccacggggcgtgagctcgatcgccgcgccgccgtcgtaaacgtcgtggaagcgcggatgctggagctgaaggccgcctcgctgcgggaggagaaccgtcgcctggaggaggcgcgggcgtttgagctcgacgccgtccgcggcaagctggcgcgcgccatggagaagctggcagagctcagggcgcgcgtggagcgcgagcggga

SEQ ID NO: 23982 - DNA, 2161 bp, Oryza sativa
acttataatccagtttatagtaatctggctcaataatctaggttataataattttaaactgaaacaaatacagtcttacttgtttatgacttttgcaattttgtggcaaaatggccttcgtcgtctccttttggtttggaataaaagtaggggctgaaaattgtgccaagtattcctttgataatgtcactatcacagctttaatttaactcaaaggttgtaaggttgttttagcgaattagccttcgacatccttgatgctaaggtcatcgactcatggttagagcttagaaccttcagcgattgaattattgcttgttactaacttattcagacaatagcgtgacacaattaaacaacaaggtaagcgattagtttatgttatggttttttaatttggttactataatttggttactataccaaacatatcagtccttcaattggttggtaggcaaaaaaaattggcataccaaattatttggcttagttgaattaggcccatatatggaaacacattttggcagtaaccaaacaagaatctagctattttttaccaaaataattggtagtaactactaattcttgccattgctaaaattttggtaaggataagattagcaaagtatcaacatgccctatgatccaagcaggaacatttagtcatctactcttgtaagaagcaaatttgattctttcacccaacctcttttttttttaactatcctggatttccgtttgttaaatcaatcagattgttttattttcatttttttttctattctgaatttgtgttgcttagctaaatgggattattgttttcttcctgatttcatttattaatgctatgctcaaactgataatccccaagataaatacttgatgtttatgataaaatttgattaaaactttatttttatattaaaagataagtattaactcaataagtgtaatggtaaggtcaaccaacgtatataatttattttgtttaaaaactaagcatgagtattatttctcggattttttttaagcaatatcgaatcttgtcttaaacattggaggaagtatattgcaaatgccagatcatatatttcaagttgtaaaatcttttggaaaaccgcctaaaaaaataaaccccatcttttcgcctacattattagattacaagctgtagcattaattagcgactgaaaaaccaataccgaaaataaactacagtaaaaaacatcaaaatcaaccgtaaaataagatttgaaatttaattgttagatgtggttgataaggtgaagagcaaacgatggagctccttgttatgattttcatgaattccttgttaccatttgacgaggtacctcaagctagcttgcctttttttcctaataagaaaatacgagtaactctagagagaaaaaaaaaggtaattctagtttattggtaaaaaaaatatagaactggtgccactgttggggaaaaaaacaacgcaaatatgccaccttttagaacaaatagaacatccgcgctctgcaaacttttgggacctcatcttttcgcatatgcttatgcttatcagccaattacttttcatttacaaatatgtcgtttcccttgctacacacacaatttttccaagaacttggtgatacactgccttttgcaactgtcaatttcaagccaaactctccaacaaaacaccagtatggcctctctaaaatagactctctaaacatccatatggccagctatccatcatttgatttagcaagtcaaagtcgttgctcgctccaacagcctctctatctaccctctattacaagtctattacaaatgagacccatttgtcaatctctactacccttcttcctcctcttccacccccattttccccacccatactactgccgacctcctccccacaccctctccgatgcaacgacggcggatggcggtgcaataagcggcggcggcggggaggcgggctgcagcgagcggaggcggcgggggcggtggactgcggcggtggcggctgcggcgagcggaggcggcgccgcgccggtgggctgctgcgagcggaggcagttggctgcggtggcgactgcggcgagcagaggcggcgggtgcaacaagcggaggcgggctacagcgagcgaaggccggcggctgc

SEQ ID NO: 23983 - DNA, 2310 bp, Oryza sativa
ccgctttttggcccagggtcttggtgcggtggccgttttttatcggagctttgcttgttggtgcccgggcgccgcaccattgaagtcaaagagagaggagagattggggtggggggagcaatgtggggcccaccactagcaactggtttggctaggcaggcaggatggccaaatttagctagctaaggagccaatttggccagctagatggcttggccagctggatagagtctgttagagtgctttttcctcctaaatttgctagaatgtcatctagccattctctcttggagatgctctaaaatagtactcaatcatggctatccttttaaaatgacaccaaagctcatgtctttttttcttctttttttttcacgtaggaggacgtggttaaggaggcaaaatacctgagagagaccaacgagaggctgacgcggcagatcgagcagctgcacgccgaccactgcgcccacgtcgaggagctcgtctacctcaagtgggtcaacgcctgcctccgctacgagctgcgcacccacgacggcgacgacggcgccggccggatttcggcgagggacctgagcaagagcatgagcttccggtccagcgagaaggccaaggagctcatgctcaagtacgggacccatggcctcgacggcttcgacccctccatcttctccccgctccacgagtccgtctacggcgacggcgacggcgacgacttcgagcagcgaagaccgaacggcgacgtcgtcgtcgacgaggcgccgcggagcccgagcacggcggtggcgatggccgccgcagctgcgggggccgagtcgccgtcgagacgtggcaacaagctcaagttcttggggaacatcaagaagctgctcccgaccagcaagaaggggcacggccgcggcgaccggaggagcagcaggaagcagtcggcggcggcggaggcggagccaccgcgggacgagcacctggagaaggcgctgcagtggctgtccagccacgacgtgctggacgactacctatagggcgaattcgagctcggtaccgtcgtgcgagcggacgccgctgagcagcgtcacgacggcgggctccacgcacgcccgcagcaccggcggcgccgccggcgagacggccgccgcggccgcgtcgaggctgctggaggcggagacggcgcgggcgaggagcgacgtcggcgcgtcgtcgtacgggcgggaggcgccgagccggtaccacgcgctccggccttaccaccccggcgccggcgcaggcaatgtcggcggcgacgggccccgcgcgtcgccggagaagcgggagctgaggcggcggtcggaggagctgagaagccccgcgtcgatgttcgcgggtgcaagggataatcgcatgcatcagctgcagagcaatgcttaattaaccactactactattactgaagtatttacagattaacagaaacctgctgcatatgcgagatgggatataatgcaagtttttttttctttttcccctgcttgtgtttatgcgtgtacgaactggtaattaatactggatgttagaagggtttgtgacttttgatcttggattggtgaagaaaatgatgcgttaggatttggtctacctaagtagtatttctcagcacacatccaactctaaataaatcgaccaattttcccataaattaattatttgtggacaaacgtatagtaaaatcgttagggatttaggattggagagggcaatggacaagtttggattggtaaatttggtatggatgaatgcctgaaatccaccggcccaccagaactggcccatcattaagtttccacagcctgtaatattaagtgggccggtggaaaggtaaacagaaacggtacctctccaattagtcttgatcagagacatccacgtgctagtactttagaagttttagttgctattaatccattgagcaagtaggggaaatattcctatcatctatgcttgaaataaaattttctcttaaattactcatccaatttataatccgattacaccgttgtgtttgtagttacgtccctcaagtaagcatcgactttcaatattagcatgcaagtgtgtcctgtagcaatacggtttcaatacttccaatattagagcagctaaaaccggtttcgatactgcctttttagtttaactatatttacgttgtttctataaagatgaggcatacattatatctggttttacgcctaggcgatacaattaaaattaactcaactacttatgtacgacccaaacccaacacccacctgcgtgggctaccgggtggcgaaa

SEQ ID NO: 23984 - DNA, 4984 bp, Oryza sativa
  unsure (1)..(4984): unsure at all n locations
nnnnnnnnnnnnnnnnnnnnnnnnnnnnnnnnnnnnnnnnnntaggcgatacaattaaaattaactcaactacttatgtacgacccaaacccaacacccacctgcgtgggctaccgggtggcgaaaaccctagccaccacttgcccaaaacacccccacccctggcctcgccgccaccagagctagccatcagcaagtcgtgtggcaactgacaagctaggaaggcggtggcgttggagcaacaccctagggcggcaatggccagtgcggcgcggtcggcgatgcgcgacaggccatgcgtggcaggaggcttgcgggaagtcgacacggtggtaggaatagtgcagcgcgggcgacggccaaccacagttggttggcgtggcacagttgatggtggcttctattttcaacaggcgacctcgacacatagggtagatagatatgggcgagagccgagcctcttcaggtcagcaatggcgacgcttgtagccgcggctttcccctcgaggtattgttgagtgatcttccctgccttacctgatggatttctttaggtgaaaactatgttgtaactacccagggagggcaatggtgtcactttcggtgctatatccttcctgaaggcgccgtttagaagattcattcccttaggcatatcgtgttcatgtttcttcaatagcgggatctagttataggcgcacgttgtgattgttttttttccctggctatagcttcctaaaaccgtagacttgtaaaatttttattgttgtatcaaatgttgtactgtcatgtgtgggttgtttaaaaaaaacgactaggtgagagaggaagtaccaaggtaaacaagagttcgtcgacccgctggcatgggcctgacaaagtaaccgacgaacgatggcaaggagcccaaattaggcctacaattcttgggccgatccataacctggacttagctttctaatttaatccagcacgacttgatcattcaccatcatcatgttaagggtcgtccattgtttgcccctgagctgagaagttcagaaatgaaaaagggaaatgtaggttggttgtgagatgatgagttcttcagacctttgttgggggtgaattcgcaggacagtagcagcactccttgctgaaaccttaggttgcagctttatcgaagcagacaactatcattctcagggcaagtgtgtgctgaattccctgacaacagcaaagatgagcaaggaccaagggcatccactgtgtgctgaataaatcatgccaaaaaccttatttataagccacagacaagtgcagccgccaagctagctcaccttcctcctcaccaccaagaacgcaagaacacagcaagagaggaggagattcaagaaccggaggaattgatgtcatcttcggctgtgattccgccgccgtcgccggagaggagggtgccgatggtggccgacaacggaggtggaggacatggggcgagatggtggcgtccgtctccatccactacttcatccgccacatgtgccgccacgccgccgcccggggctcgtcggccttctccgccgcgtcgtcggcgtcttcctctgttgcgccggtgcttcccgtcgtggtgcgtcccacgtcggcggggccgtgagggagcaggtggagaaggcgtcggcggagcacgcggcggagatggagcggctcaatctcggagctgccgctcttcacgctggtggtgctcccgaagtcgtcccgcgcccgctgccgccatcccctgcttctccgcgccgtcttcggcgaggaaagcgactgcccccgtcgaacagaggggtaaagatggaaacggtttttctgattgtattgcagcgtcaaacatttctagggtgagtttgagggatcagggatcgagaagattgaaaagatacgcaaaacgaggtgagccattagcacatgattaattgagtataaaccattttaaatttcaaaaatagattaatataattttttaaagtaactttcctatagaatttttttgccaaaaacacgtcgtttagtagtttgggaagcgcgtgcgcggactacgatgtgctctctcaccctaactcactagaacgaacactcctttagactccttttaaaatgaactgcaacgtcaaatattacacgatgaagggagtattatacaccgacgaaatgatttttgcgttcactaggcatggacggtcggctcaaagacaaacaagtttcttgagactgtgagagaccgcatgagaaaacataagacagacaagaattgaacaactgaacatgtacaaagactatatgttggtgcctacacacgattattcaactgataggatgcactagtcattaacaacaccaacacattagctactactgtactctcatcacaacaccacgtactatcaggtttacagaaccgtatgattatctgcgcaattttcgaaaccaaagatatatctcgtggtaactatacggttttcacggtaaccactggattactacaataaccgttaaaccgtggggtgacaataatcccacccaaaacagttgggagaaccctaagtcctacacgacaattgattcaaaccaaacaagtatacaacaccaacacattagctactactagtctactactgtactctcatcccagaaccatcacaaaaccacgtactaccatgtttacagaaaccatatgattatcacacgattattatacttttcgaaaccacgatatatctcacggtaaccacatagttaccgtgataaccacccaaccataagtgacgttaatcccacctaacacggttatttggggaaccctgcgtactacacgacgattgattcaaaccaaacaagtatacaaagttacaaaccccgattagcgcacgcgattttaatcacatcacaacaaaatataatccccaagtgcttaatcagctgaagagcttcttgacggcctggaacctagcggtcttgtcgccgaacttggtgccctggtagtagtccaggtagtcgccgtacctgtacggcccggggtacggcgccgccgccgtcgccggcgcgatcacggcgtcgggcccggggttgtagaacgtggcgacggacaggcggccggccctcggcgccggcggcgacgcggtgcacgacgctcttgtaggcgccgccgctgagcacctccacctggtcgccgatgttgacgaacagccggccgcgccgggtcgggccgacggggacccactcgcggccgccgcggtggaactcgagcccgccgacggcgtcgtcctggaggagcaggatgatgccgccggcgtcggtgtgggcgcggaggccccagacgaggtccgggcgcgggcacggtgggtacatggcgaacttggtgccgacgaacggcggcgcgaaggcgtccacgacgccggcggcgccggcgaggcccaggttggtgctgatgcagccggcgagcagctcggcgagggacaccgcctgcgcgatgtacgcgtccagggactccctcgccgccggcgggatgtccgggaagtcggcggcggtgttcttggggcggtgctggatgaagtaggtggcctcccagtcggcctggtcggcgaggtcgccgccgtcgacgaggacgtcgccgtcgtccttgttcaggtggaggttcttggcgaggtcggaggcgtagaatttcttctccaggtgctcgtcgtaatggcggtacacgaagctcttcacctcctccattaacgccgcctccacgccatggttttccacctgcattcgtagcgagcatttcaccgaagcagaattaattttgcgacagccaacatagaggtacacatttgtcagttttcacatttgaagaatcaaaatctgaccaacagttttttttaaaaaaaatataatctaattatttagcatcaaagttgtactactacatttataatttcaagtactttgctaacatgttacatttagacctgttcgattttgcattgctaaaaaaacagtggtgctcaaaactgttccactctcaaataatctctgaagtgttgtcacgtacccagaagaagccccagtccttacaggcctcgtggagctgggccatggtgcgctccctttcttcgtcgccgccggcgagccccttgagatcaatcactggaatctccatctctcccaaggttgggtagctacttctacttgtacgtacaactgtctagtagtactgtactagtgctgatgatgagctaacttgtatgcactaggaagatgatttgcttccgatgagcgagtggctatgtggcatgcagctgggctcctatttataggagacaatcaaccattctgccatgccggatagtatagaagatttctactaatatttttattcatcctgaaaatatagtaatcagtattaaacgagacacattcgtaatattataaatttgaatagaattttatctagatttatagaaacaaagctgaatagaagtttatccagattcgtaggattatccaattttagattactatattaatctaaaatttttttagattatccaattttactgtagtactccctcagtctggaaaaaaattaatctatgacgatgcatgtgatcccttctaatacaataattctaaataacttttatttgtctttgttgtattaggaggggtcggtcacatcccctcctagggcctgttcggctgcccgcgctgcggctgcgccggcacaaacagtgcttcacacactgtgcgcagccacagccgcagcaatttgcctgccgaacaggcccctagttgaagtatttttgagacggagattcgttgtactatggatcatatctcgtatctgggggtgtaaagttttgggcgtgtcaaattgggtattatatagggcgtcgcatggggtgttcgggcactaataaaaaactaattatagaatccgtcagtaaaccacgagacgaatttattaaacctaatt

SEQ ID NO: 23985 - DNA, 1687 bp, Oryza sativa
catgtggcagagggacggatcgatcagagatcgagcgagtcagtcaaatactagtttaatatgtggagctgcatatcatatcatgtggcgctaacggcctggagattgatttcgcggtctctcggggaattttgcttgcgagtaacacatattgcgttcccggcctgtacgcacggcgcggctgcagcacgtactccggcctaatgctaaggcgcccacgactgcaattcagtgcaaatgcaacataggacggtcacccctccgtaaatctttaagtgatttcgtgtttgcggagaaaagcgataacagtacctattaacctttatagcccttttataggatcgaacataaataaccaagcctaacaaatttggggtgggtgatgatagattacatcaatggaagtcaaataatcgaatcttgatagatcaaaacacataccaacctaaaaaaaaccaatggaacacacgtctagcggtctatccgacctactagcgtcggtctgaccataggtcacttggtggtctgaccgtcagcctaaaaaaacagtacgacaaacgcttatgtgaaaactcaatttctcttaaaccaacagttggattgacaatgatgatccaagtcagacttcattagccgtgtctcgctctagtgtggggctttaagctttttgtctgcaaggctcgtcaatctagctcgactgtgcatcaacaagattggtggtagtgaagtcggagctgcggcatcgacagggcatgatatttggcaacgatgacatgaacccttttaagttatgctttggcgcggactaggttgttgcctttgtgttagtgtttcctggtgaagtcggagtcaccagatcgcgagggtgatggtgtgatgatgataacgtcgcgtctttgccagtgtgcaggagtcttgttttcttatagtttattgcttgttcgtacagtgcacaacgtttgatgagtgttgtgctacgcttttttgttatcactgccttcgtagtttagtttaattggtggtgtgttgctgtagtagcattttttttctagttcttttctaattaattgtgtgttgtaaggtttggtcctattttttctctatgtaaaacgtaccgtttaaaatgaaccatgaccttcaaagacacattttccatggcagatgacaattccagtgcctggaagaagctcagccaattgcatacttgtattgtaaagccatgcgtattttatattgtcacgaataaatgaggtgaatgatagaaggatcttttctaatacgatactcccttcgttttgaaatgtataatactgttagttttttaacctacgtttaaccattcatcttattttaaaagttatataagtattatttgttttgccgtgacttgttttatcgttaaaggtacttcaagtctcacctatatttgaacatttccttttaaataagacttgtcggtgatatgggtctgagggtatcatatttagagggaggaggctgccccccaatgccacgtggccctcccccaaggggagtcaggcccgacgtgaggtggcggctactctttcccaaagactagtcggaggagactggccccaatgcctcgtggccctccctcggagggggatcgggcccgaggtcgggcggcagcccgcccctcccgtgactaggggtcgggctcccccga

SEQ ID NO: 23986 - DNA, 2686 bp, Oryza sativa
ggactaaagatcgatctttagtaaaaggttttttcacccgggactaaagatagcgatctttagtcccggattggtagtcccggttttcaaaccgggactataggggggttacaaaccgggactaaaaagcacttctccaccagtgatggtgagaggttctcatcctcttatcccagccggagtcggtcctcccgccctggtcaaagctaggctcccgtttcccggtgtaataggagctcagaagtcttcacccattaaaagcagctgacatgggcacccctcatgtcaggcggcaagatttgacaggccccatcatcaagatgacgtgcgcttgcttcccaagtcaagagacaagacatgcatttaatgcaaaaacacttctccaccggagctagatttttgggcccatgtggtaaccccttgaggtataaaaggaggtccaggcctagtagaagggaggagggatccgggacgatccattttgacgctctaagagcaatctctagccccggatgatcaacaccacattttacttcaacaaggggatcttgtaatccttcactaaaggagcatagcacaggagtaggtattacgcttcttagcggcccgaacctgtataaatcccttgtgtctcttttgcctcgaaaacctcggatctcacccgctgcccccggccgaaccaaaaaaggggatctcacgatctcccgctagagagctcctcgacaagactaatgatcaaacgtatatctaaaaattaataatattatacatttaaaaacgaagatagtagaaagcaacaaagtcatttgacctacttactgatacttacccacaaatctttcaaagataccttatgtttgagatcggagtagggagtcgtaaagaaatggagaagttggtgagaaacccgatcaagctgggaactagtgcgtgccagcgtgtgggtctaaagccgcacaagtgacaatttttccagcgcatattggccactcctatcttggtcatctctgctacgtacagtacatccatgtctcccatgaacattcctctcagcttcagaacgtctgtgtagcctatactgcgtcttttagtttcagaacgtgctcgacgctaatcctgtcaatcggtggtttgaaacaaattgttcaccggattatcacttcgaattagctatttattactataaagataaattaagtatttaaataaaaacttaaaaatagcttagaagaaatgatctatgcaatgccgcctaatgcgatagaaaaaaaaatgcccttttaatacaaaacgtggttttagagaagttagtcaaatgatctactgcctccgatctaaaatataataatattactaaattagacacatcctagtgctattaatcacacactaaaatgtgtctaatccggtactctttccgtttctcttagttctagattataagtcattttgactttggccaaagtcaaactatttcaagtttaaataagtttgtaaacaaatatagtataatatttatgatcccatattagtttcattgaatcgataattgaatacctttttatattatatttgtcttcagttaaaaatgttactattttcttttataaacttaatcaaatttaaaatagtttaactttgatcaaaatcaaaacgatttgtaatctaaaatagagggagtactttataatactatattttgaccaagggcggatctacagtgttatcaccggcgtcaggtgacaccgacgattttcgataaaagttatgcttaaaatacttatccatatattataacactatattctataatataattaacatggtacgacaccgatagatacgttattacaccaacaaatcaaatttctctggatccgccactgattttgatatggacagatataacgaaagagcatgaagatttctcgtttcgattgcgacgcggcgacccccatgcatgaaccagcgacatggaaaacatcaccgcatttcttcgcaccgagcacaaggcggcggcgctggattcgccggccggccggccggtcgccacctaccgctgatgagcccctgggttagccgcagaaaccgcgagcgccagcacatgcgtgcgtgcggccccggcgcggccaaaagcctctgtcggtaaaaatcgtcgatatgcagtgcaggtggcagagaacgatggtatgcagaaaaagccgatgcaattgctgcagaattttcgtagaaatttcacacgaaacagcttgctttagttttcataggagatggatttttcttttttttttctctcccacgttctaaatagtagtgcctaggtgcagcgggcccagctttttgaacttgcgtatttgaaatgggaggaggaaaaaaaatgttcatacacctaaaagcctaaaaattagcttgtggcataagatactaataagtataatatatagcgtatataatataaaattggtaaatatatcaaagtgtcaacatatggaataaaaaatgataggaaatgataaattgggaaaaaaatatagattaatttttcgacgcttgatattttgaaaataagcgatgatgtccttgtccttagcttgaaaaagaattccctttcaatgaatataactagacaatcattcaaatatttttgccccatcttgctttctcaacttttttttatgtagttcat

SEQ ID NO: 23987 - DNA, 6850 bp, Oryza sativa
aaggaggacgaaccggactaccggtgaaggaggttaggagcccaggaggggcttggctgcaggctgctcgcctgctcctcagcgctcggttcagctcagtgggcagtggcgctagcgccatggcggattggcgggccgacgtggccgtgcacaccgcagtcaatgtagtcgccgccgcacgcccgagccgtcgccgcgccgcacgtcctctcctcactcggttagggtttgcccgatttgggaattaaggattttgtttgctgtgcctaggcggggaggggaaatggactagttgcggtctaaactgagtgcaggctaagaagaaagtggaggggagtgggaaatttcggcccaatagagtataaatgatgaaacagggctcaagatgactaatttaagcgttcttttttaattttttgaatacatatacgaagtaaagagcacgtatacttatttttgtccaaaaatcttgggtatacatctgaatacccttgaatcactagtgggcccgcccctggctaggtaggtagccatgggtcttgtgaccataaggtcattaatacaacaaatgtataaatcacaatactaatctattactactaggtagtactagtagcgatcgcccacagatatatatacacggaagaaaatttgataagactgaagggtattaatacacggatatatatatatatatatagacacacacaacaaatgtattaatcaaaatgctaatttatctctatgccagccggcggcattgcacttttggatgatattgggccttaattttcatcgtaggtcaccgagttagcccatgcactgtttattgtgtcattaagggcctgttcactttaatgccattttcaaccttaccaagttttggtaaagttgtcaaaaaaaagggagtacctatacatctttcgaaagatttttatgatcgtatcacacagatttttaatctttggattaaaatccgatagatataataaaaagcaaaaagcaattaagaaacaccataatggacactaaattaccatatcctcaagaaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtgagaaaatcgagtgagagataagaaaaaaatctttcgagtgagatatagcaaaatcgaaaaaaaatggctgcatttagtttactgccaaattttggtaactatataagaaatcctgccaaaatttttggcaagttgccaaaatttcggcaactatgccaaaattttggcaatgccaaaaattggtaaggttttttttggcatcaaagtgaacaggccctaaaacaaacatgtgggcctcacaaacatttttactatttttttaactaacaccaattgacatgcagggtgctattgattttttgtcgtttactttttccttgtagtgccatgtaaacatcatatgggactaatatcaactaaacgagccacataggttaggactatacttgtatctttatatctctatttggtctattatgccactttgttccatgcattttatacttccaagacctcgccgatcaaaagtacatggactcatccatggcctatatgatttcggctaaccatctaattagatatatagggctagatgtccctggtctttgtagggccctgccccaaatggagacatttccatcgttagcaaccacacaagtattgagaggattatatatgagtaaaaaaaatatataggtgataaaatgatcgtgcatgcacacttcactacctcaaaaaaacttagtaaaacctatggatgggtgatcggtgaggaagatgttcctcattaaattatagaagagaattgctatctgatttattgtgggaaaataggaaaaacagtaaatttatgtgcatacttatattcgcaaaatgattgaaatacaatatgctttgaaaacaaaacgggcggagcacatgacaattggcatatcgtgccaaaccgaaccctccagaaagatgaagtcccaaagcatagaaagcactataaaagtcgacccacaatgtgcactaggagcaccgatggattgagcagcttctctagccttgatctcctagcgctcagttgttatacttaccctctaagggctactaggcctcaatcatctcttcctcttcgtgtatatttagccttttatgctacccgtggatctctttcgttattgatgagtatactgttcgtggttgataccagtgttataattatctatgggcaaagttgatacatgccatatatcgaaatgacaaggtaattttatcttctccttatgagtttttcaactcaaaagtttttttttgcaaccaataattagtctctaatattaatttactaattcaagtgatgttttttttataacatgagggtgaagattaggtcggggacgcaggaattttacaggaatatcacatgtaatagttcaactatagtaggaactagaaacatgaaaatttgtgggttacaaacaaggttccatctacatcatcttgcatgtatcgagccaaaggcaggatctacctatacccatgtaagtccctctagtttatgtgattttctccacccagaaagacttgatttctagcatttaaaatttattcaaaaaaagacttggtttcttttgtttttgcgggtaaagtacttgatttatagcccctagcttacctaccatcggtctataaattatgaagttttatttattccataccccttatactaatactacttttctatactttggcaatcatggatagatagctttatgtaaattttctgttttctgttttctccctctctcccttcctttgtaaatatctctctcttataatatatatatatatatatatatatatatatatatatatatatattgcagtaggagtctctcctgctattttcatgtcaaaaaaaaaatactacttttctattagtgaggggcactttttgtttttatccttaactactaaaatacttgggatgactaggaatcaagttttttggggaataaagggagtgctatatatgccttgaactatttcgtttatcttttattgtgtttcactatttatttgtatgtggtatggtactctttgttaagctagcaagttccatgagtttatttatcaatgtacaatttggagtggtatatttgattagcccgttttccttaggcgtcgcttgtagctaactgctaacatacaaaagtaattaagtatgtataaaattgaaaagatggcgagtcatgagagagagcaatgtggcaaacaaactctatattagcattcaaaagtaaagtactaacatacaaagcttgttagctagtggttgctgaataacatacaaaagtaataaagtattaagtacatggagtataagttatgtagctaggaccacaaacaacacatgatctatgcatggtatgcatgcaaaccatgcacttactgcaagcaagtaggccagccaaagtccatcatgcatatatgtatggacatcatggtttattattaaataggtcattagacaattgcttgcgttacacaatgtacaaaagaaatgtaggatattaagctaaaatacaaaattctccagcaggaaaggcgccgaaagtacacttagtttgctagcaatggatcgagtacttatctactgatctagtcatcaatccatgcatccatccatcattaaaccacgtagcatgtattggctggaatcaagctatcacatatatgcgtgaatctaaagcaaaacaaactcctcgatatatcttgcacacatctagagctaaccgtccgttgatcagctagctaacttagagatagattagcatgtatgacacatcaatttgaaatcatgatgcatatgcatggtataggagaggacaaacaaatatatgttcaattaacaagcaagtcaattcgtgacatgactaatatgttacgcaaataaactgcactactttatcttggttgtctttagcataagaagtgtggaatgcatggtttagccttgtgagccccacatatattaaagctagctgtttcactggaaaagatacacgcaaggctaaaagatttcaccaaacccacaagaaactaataaacctttttttctttcttcaactctttttcgtctcccttctcaacaatacagatatcatagaaaccagaatcttttaggcctatataaaccaccccaccttgcatactatgttcatcctcgtgtcatattgtgttcatcttcatactaccaaccaattagtgctaataggtagcattttctgtagttgcagctcaagtaaggtaatgcacctactagcttattattcttgtgcctagtattaattagtttttgtactggtacttgtgaaaatttgtgatttgagcaatgctatttgatttgtaattaagctagctatctctttttgttagactgcaatgtaacatcgttttgctaatttttgaactagaaaagtaagaaaaagaagtaacaaaagtgtgtgcttgctatgtaggtctattattcagagcaacgaagggaaggaatggagcaaactttggacgtacctagatcgttgagactactggcgccaaaagctcaacaacaaatggatgaattttggagggatcgacaaaaggagattgaaacaacaaaggactttagcgagcatgcgatccctatggcccgcttgaagaagatcgtatcttctcaaaagggtaacatgatgatgacctttgacatgccagcattcttatcgaagatgtgtgagctcttcgtacaagaacttgctgtgcgtgcatgggcatctgctcaatcccataatcgttgcatcatactagacacggatattgctaaagccattgcctccacagagtcttatgactttcttgttgatatcctccataatcatcgtgtgaaacacaaatccactccttgttctacacttactacaaagcgttgtaggttagtcgatcaaccttccacatctcacatgccctaccaacatcagctgccacaatttgctcctacatatactccggccatccctattactcctagtttaatgccaccaatttctcactatataccgttccaatatccatccttatcacaagaagtgtccccgatgatggcttctgcacccatagtgaatagatcaatgttgctcattcacaacatagcaaggggtctaggcttacaaggaaacaatatcagcacgttcgccaacaataatatcccagacaatattgttggttgtagtagccccacagttcttgcaagtatgatgagtcctgctttactagaagttgcagggacatcactaaatccaccaaactctcattccatctgcacaatgaacatgatcaactcgagtgatcctagtggatctagtattggtgacattaatgttgcaaatcaagcaagtcttgctccctctggacgttttaaccctgctatccttcgagagtcatcatgtccttcgttcttacatagtaacaatgacacaattgttgctataccggagggtgtagatattagtggcaccatggatgttgctagtgatgttgctgctatagttatcaatggtcaagaagaacatgagagggaaacaaatgttgagcatcatcagcaaaatgagatatatgaaagcattgatataggaataatcaatgcaagtgttgcggatgataataaatatagtattagctgggatgaattgggaatggctgatgattcattgctagacaaatttttggaggagtttcaagtaagaaatgacggtgttttgcgcactgggattgagttgcatgaagacccattccttggtgacgtgatgttagcaaacccaagtacaagcaatgccaataagtaatttagttggcaagttttgtttatatctcttttgtaagaatgaggttgtaactttttcttgttgaatataatgttgcagcggcggacctatgtggggtgccgggtgtgcaccggcataaaaatatagtatgtagtattagcagcgggccaaatcaatagattggtgcctcgttggatcaaaagcaaggcctacaaggcccaacgtgctagcagggaggcagcccaatctgctagccaatgtgccatgtgctgctagagtctgggagaaaattggattatattatcgtaaaagagtggtttcgttaaaatgctatcgcttcaaactgattcactggtatgttatgccatcctaaactgagaggtttcaccaaaatgctattttcattcttttgtgtgaatataaatattttttctcaattttatatttttcctagaccaaaatgcccctgacgcgggccccacctgtcatacactctcccctctctttcccctcttcctcccccaccatcccgatctctagcgaggtcgctccaccagcggccgcaccagaagccgccggcgaccgactcgcccaaaaccctcgcgccggcggccgggccacggcgcggcgtgcccgccctacccccatcctatcgcgggctcgccgccgccaccggtgtggccgcgccatgttccccggcccctcctcctcatccgccgccgccggccccgggttcaccgagaagaacgggctccatgtcgatcccatggccgccgctgcctggagcggtgggcgcaccaacggcaaggaggatgcggagatggtgcttgccgaccaggaggagctcgccactccgagcgcatcggccggtgttggcgga

SEQ ID NO: 23988 - DNA, 13190 bp, Oryza sativa
tcgttaaatcccctcctcgccggcgagactctcccttcaactcatcgatctctcgctctccacttcatctcgcactctctcagccaacgattcctcgcaaatccttgaagagatcgtgagaaagcttcttcttgcttgtgcttgcggcaatggcgggggtgcacacgcacagggcattcctgctctgcaactacttgcttcttggcgtttctggatcgattcgatctggtcaaagagataagagagagggtattttggtcaggacaaaaaaataaaatagagtaaaatcatttctattaaaaaaagaccaaaatagcattttagtgaacacttttaggattgcattatccagcgaaaccattttacgacagtagaatcgcaattttctcgtctctagggttcctcttttcccaatccctttctcagtttctcgtgcactgcggcggccggcggtggtgccgtggtggcgactggcaatgggcgccgggcggcggccggcgggtcggcgattcggcatgggttctgtggcgctggcaggccagcccggcagcaacaaggcagctgctcagcttggtagctcctagtcctcagctcagtcgctcagcagtccatccagctgcaggtatgtcatttcactaattcactttgagatttttgtattcgattcatcgattcaatttgcaaagttggaaactgaaattgagggtacattttttgtgatttgtattttgtaggcagtaggcacttaggcagaggtcaagttgaattaatttgtcagatataaaaaggaacaacagaaatatgggcatactttctttattgagcaaggtccctaattcagattctgcatctcctaggacagggcttcacatttctcatggggtaactataggaaggaagagtaactgaagaaactcgagaaaatgagactttgcaattggtgttgttttcttcttcttcaatcccaacagaggaatcaccacacgctcaggcttcaccaacaccaccaccagtacagccccaaaatgaagagcaagaagatataactgtaggtagtggtagagcatcaaattcaacttcaagagcatctaattcaattcggagtgaggagccccaaaatgaactaattgtactacatttggataatttaagatgtaactgtacttttgtgcttgaggtttttgttttggcttgctgtaggcacacccaggataaaaatcctgggttcgccactgctttaatcagtcaaaaatggggcaggaatgtgtatcagattaatcatcaagtgggcattgagatgaccacctgagagaattcattcacatacggttgaataacatacagcagatttatttataagctgaaaaggtagtacattgctaattagctaattaagaggacaatttaatacatcaatgatggaccctgcacattaccagcattacattgcagtagttttcagtgagcttaaaaatgaatcatcacatcacgtatgaaacagagttgatcctccaatccaatatgcaaaagccattgcgcatatggactcatgtatcagcagagtctcctatgcgcccttccccagccaaaaaccaatactgtccagaggaccatacatacagccccttggtttcccattcctgcactgcagagtcctgaatctttccttcccagtgaatttctatgtagaataatgtacatacactgatgcttcaattacaactaaattttctgtaacttctgacggtccgtgcgtcactgttgctgtgactttcacctcttgccagaaggtcggtaagccgaaaaccgtgtcgaaactaagatataggatgatttgggaggatctgagtttgcggttctcaaccgcatatagcctcaacaacagcccgtttcattgtccctgggcatggatctccaccaaatatttctggaacaacgcttaccccgcagcgttcttgaccgacgcagttctgcaacaggcatcaatacatgacataagttcatggtatagacagacagactaactttagcagtgctgctttagtcgacacagtgaacgcaaatcctttaccttccaaaatatgtcgtacgacttgtgcgcatggcagcctccttcggtgtagcttccacaggagccctgtggtgtgccaaagctagcaaattttatttcagttatcttctgtccattgtcacattggaggtggacttttgctttctcgtagtcttttgtatgccagttcttcattgatggctggcattcggacacatcagcgcagacacttccgatgcttcttttgaccattgagattccagtagggtcaccaccccactcctcgaatatgaccaaaaggtttcctgtgggactaagccatgaacgaggaacatggtacctgacagaccatgacattagatttataagagcttctcgtgtaaacagtactacaatgttatcatagaatgatacttttatggaatgcctaccatctctgagaagagtcaccacagttggtttgacacttcgtttcatcgtattcacctcgataatcacaggttccacagtttccagaagccttgtagccaggccaatatcgcccaataccttgtccatttatccagatttgccccttccccatactactcatgtccaaagctaatggctcatcaccatccggtgcattgaaaaaagcctaaacaggcgacataacaggattagtgtaatgatagacattattttattataggagcaagaattaataatttcttcattaccttgtaccatgttagaggctgcttctgcacaggttctccccactccactgttgagcttccactgagtgaatgaagactcatagactcacctttcagtcctacctgtacaaacacaacaatttctcatgtacactccagattatagataaacagttattacctcatcaaatggcaaacgatatatacctgataagtccatttctgccatgtcagatcccttcttccctcattcaggccatcaagcgtcactgggccaagaatcccagcattccaagtctcaaaatgttctcccacattttatgatagagaaaaatggtaactgagtctgaaatggatcaaacagcatataaccaagagtactatttgagcctgaggctgaacatctacttactgggaggccaactgctatacttaagcaggaaattgtattgctgcctgcccagagcttcacattcacagtataagtcagttttgggtcatctacgctgccataaacagttcctgccagcaaattgaaaagtgtattgaggatcaagaaacacctgcatatggcgggcatacagagtataggtttatctgttttacctttcagttgtccattaatgaaaatatgcaaagcatgaccagctgacatcacagtaagcttgagattctccccattgctaaggaactgctcatcctgggcaacatcgacactgaaagtgaaaaatgtttagtacatggtattgcacatcaccatgtatttgtatttttgggggttcagcttcttagtacttactatgtggtataccataagtagtctgtgttatccctcgtcacatttatttgttccagtaatcctactgttgtaagtggatcctcaccaaaggaatttatctcctcgttgtatgattgccatgcaaatcctccagcccattccattttcatctgtgaaatctgacttcccacctacatgataaatttatttaagattaatcacaatttaacattttcaattgatagatattaacaagatcacatgataaaaggatccaaattcagattggatgtggaataaatttataaaaaaaaatattgattttcattaacagttgtaccaaggatatgctacatgtattaaaatgcagcaacaaaaacccacttttgaacaagcaactcaagtatattaagaagaaaattatagcatggacaagacaaccaaaaaaaaaaaaactaaagtatctatctcaccctagcagtattgaagactgtcgttttgcagtctgggagaatacttatggaccacggaggcaggtcatagtgcatgccattaaatgctacccttgcataagatactttatccttgttctcaaggaaagctgcacaagctcctgtgcttgatctaaaaactgatgactgaacagcaaattaaggaggagtcagttcagaacaaaatattgtaggtctaagggacaatagagaacggaatgtgtaacgaaccttctgagcatttccaagtgaagttacaatggggtctcctgcaaccaaggcaggttcacaaagttttatggctttatgcaactgcttcaagtggccccattttggttctctcaacaaacctgaggtagcgaagggaagaaagttcatatcaatttggtaaacatgatgtagcacatagggaccatcctattcagcaggtatccagtttttccttcttatttttaactcacttttttcaataactagataaacatccaacagctcacatgtttattttgtcggggggtaaaatgaaaaatattttaactcaaataaattattaccgtttggtgaatccccataaattcaaaaacttcacaaaatcaaatctagacaaatttaaaagatgccttacaaatacaaaaacaaactacactaaaagtttcaataaagctctactagaatagttttgagtgaaatttcagtaacaaaaatatagtaaaacttttacatatttgcatagtatcagagatggtagaaaaaaaaggggaccttttacaacccatatctttttgttttgggtagagcatcaccgttgtgttgcaaaatatttaccagatgtaacatgtctgtaatgtttggatagcagaaatgcctacatgcaggaaacaggtgcaaagtatatacctcttactaatggatactgtatttcttaaggtttaataagcaatcatatgcaagatatgtaaagtgcttaactcaccatattcatcaataggagcatcatagtcataactagtgccaatgaatgggccaccagctgtgcgtcaaagtttgttccaccatgatactgaaaagcaacagtgtcacagcttgagactactcaataacatggtacatttcagctttaaagcgtattgatgggacttaccatgtaataattcacaaaagagccacccttctggataaacttggcgacaccatatgctagatcctctactggtctatgtggaactggaataccaaagcctgtatacctgcagagggaacagaagatatacgtaaggcgaaagctaagcacatagccatcataagaacctcaggaaaataaagaaaagggacactaccaagcagtccaggcttcagtccacatggtaggtttgtgaggtttatttggggagaaccaatcacagtaaaatccattgcatgtattaatctgtcatagataaatcgaagtaagacgtagctcagctgaaaccttctaccccaattggcatgtactgtatgagatgtgtcatgtaagagcggaggagattttattttaaaacaaaggaaattcaatgtatgatcgatcatatcctttcatttcttggacaacggtcacaaagaacattaaagaaatgaggaactgcttcccccagtacatgtactctgtattaaagagaagtggtacagtacatacaattggatcaggggcatcatcttctttgcacatgatccatggcacactggtgttgagcgcaactgccatgttagctgcccatgatgcatatgccttggcaggctcaccttgatcccactccaagggcccaaactcgttctctatctgcaggggacactcagaaaagtaggttgcattgaagagaatgccatcaacaaataccaagaatgcaccttcgattacaagcgtacctgggagaggattataggccctccttgccattcaaagagcccttccgacttcatcatttcgacgatctttgtggtgaacttctgcatctcagcctgtttggagaatcacgcaaaagtcaattcttttttttttacagagatcataggaaatttttacagaggggtcaaggagattagtaaaggttaaagttagtgctgtcaaaggattcttgccttgaacggctcattatcagtcctaaagctgatgccggggacatacttgagccaaacagggaacccactgcgaccaaaaggggttaaaggagcataaaattagcatatttcaaatcaactcaacatcaagaattctattctaattattcctcgtcagccaaactgcagccacaaacagcccccatcagcaacaatatcaacttaactaccttataaatagagcaatttgacacacccaccaaaaagaaaaagaaaaagacttctgccacttcccataacccccagattcagacatctcacagcaaacaccaattggctacttactgcaagtgcaggaaaactaagaacacaagatgttcttggtgctgttacccgaagttccactcggcgcagacgtaggggccaatgcggaggttcacgtagaggccggcctgcttcaccagcttgatgaagtgcaccagatcatacctcccctcgaagtagtactgcgagaaatcaaccaaaccaaaccaaccacatcaagaacacgaaaaacaacttgttttcacggttattgttgccggtaactacctggccgggggacggctcgtggccgttccagaagacgtacgtctgcaccacgtcgaggccgccgtccttggccttctctatcagatccggccacatctgcaacccaagcagtaagcaccaccccccacaaacaagttagcaagcatagcaaagccacgcaaccagccgcctcgccggcattcctccggcgagagagaggaggaggcgtcgccgtcggagaagcacggtgaggaggaggaaggggaagcgtgtgcgccttgcctcgggggtgctcctcgggtagtggatggagccggagatgaggatcctccgctgcccgttcaccaccacagccttccggtcgtacgtcacggccgcggacgccgccgcggccagcacggcggccaccgccacgacgaacgcgacggcgacggcggaggcggccatggatgggatgcgatgcgaggagtggagtggagtgtggggaagaacaagggagggaaaaaaagaagaaaaaaaggccgcgcttttcggtgcttttccctccaccggagagagtgagaggcttcctctctcactgacggcacatgaggacactctctctctctctccttggctctctttctctctcctcgcccaggttttcttgtctactcctgctctctatctccattaaaaaatatagcaaccttaagcggataagacgtattataatattataaatttgggcagtatttaaattcatagtaatactatgaatctagacatagtatcagaatgtgtccaataatctgaagagtatcaaattcttaatattaagatatatcttatctatacaaaggttactatattttaatacgttgatgatatttatagtagtgcttctatctccatttccatggcgcctcacgcgtcactggactcgtaagtcaagtcacagctggtgtcctctttgctctctgttagtggctaattgctttctctctctccctactaatctccacttcttcaggggcaaaggtgaacaccctctcctggtaattttgctgatgattttctctctctctctctaggtttgcttcttgggattggggagagaaaggctttaatctctaattaattaactgttaaaaagttgtgtttgggttggaggtggatgagagagggagagggaggcaccagattctaggagtgagactgtagagtgtgattagtggaagtgaggctgctactgttgctaatcaggagagaggagagagaaaagagtgtgtgtgggtgggggctgactggtggggcccacagggaagaccggtgccggccctatgttagctactttaggatagtggttggagcggtaataattaatgaaatggaaaatctggatgggagactgggagttgggatgatggatggtgggtcccacatgccaacccttttctgtctgttttatttttcctgctctgcaggtggggccgccctttgcttacgtggactgtcaaccagactagctggcgccgcatggaggagacatgtgttccaactttctttgttcaactgccttaacaaaacaaagtgttcccactgtactaaaatataatataattaaaattttatgtcatagtttaaatatttcttttattcttttatctcaactaaaaacagcctcatgttattaaattttttcactattttttccatctcaaccaatcacaattatttttcatcttataatttatattataactttcggaaaaacttatattttcaaacagatccaaattttaatgtataaactttggcttatgatatggagctgcctaattaattgcagcccttcttgtgatgaaaaatgtgagctcgaatgcagatggatcgatcgatgggttgcctcgtgtgtaagtaagcggcgcatctgaaagcatgaatatctactcgctgttgcgtggtagtacctgtgctgatcatcataaggctgataatgcacgtgtttgccacgttgcccatgcctaactttatttttcgcagccacgtaaaactgtaaaagcaatctcacttcgttgtcttgaagcaaagtgaacaactcgggtaaatggcgagtcatggccggtggttgaagaaattaattcctggttcattaccaattttaaattacttttcttacagcgagtaaatattgcaaaattttattagtagtgtacgagtaactgttacgggcggctgcaggctctgcagctgattcgtttgatcgagcagggcaatgcaatggcatatgatcacgtattcacgtgcagggggcgatttggtcggccgggccctttgtcctgttcagtactaacaagggttttttatgaccatgatcggtgtgatggctctgccttaactaccattcattcgttagttagctagctgcacgcacgcacgcacgtacgcggtggcggaggtggcggagcgctgttgagcccgaaccatagtggaaaaacccgaacctgaccgaaggttcaaccggacaaaaccgagccagaggtctacacggtacggttaagctgaatgaccggacatgtattcaactcggattgaaccggctgaaccggccgagttttgaataaacctagcattaaaccgtcttggtcggaccggacaaaggagataatgggctatatcaaggcccagtccaggcccacgtgactatttcgtctgtacaaaaataacataaataatgcttgtggcgcggggactcaaacctgggtctttgcactagaagcacttggctctagctatcctacactttttcacttgtgtaatagaggaaatacatattgcatatattagttattgaactgtggttcagccaacggttcctcggtcagaccgtcggaccggtgaaccgaggggtcgtccttgtcactcatcggtccagttttttccactaggacccaaaccatgattaatagtgttttttttatacaccggtgttttcatgatcgcccaatttgctcgggagctgtctccggcgttatgcgtacgccaatatgccatatacacaaaagaagttcctctgatgtgaacttttcagtgacgtggtcgatgacatgtgtgggtatcaaagtaaagcacatgttaacgacaatattacgttggaaggtttcactcccatgtacacatgcttctgcacagaactacagaagtactagtagcgtagtactagtacctgctgccatgctcccaaaaatcaaaatctgtacaaaacacagcaatacgtactacctaagctggcaatttgagaatggatgtagttccgttgtgctgcattttccctttttttttccccgttacaacatggtaactacttatgcgcattacacaagtattagctacaggtacgtacatgcatggctgtcagattaccattacgtacaactaacatatacaaaccatgttaatcctgtcatctagtaagttacatactttccttttttcaggaaaaatctagctacgcttaccgtctgcacctaactaacacccttgcgtgttcaggggatctcgtgtaatcgaggtgattttcttttcttgatgccgctggaggggaacgccagaaacgaacatgtggttttcgaggaaggaagtagcggggcttggccggatccggctttaatttggtgatacataaggcaattcacatccctccatatcatatagtgtccatagtattaaatacattatcacataagtaaaaatctgatgtggcaaaagagttaatgaggagagagataaaagatgaagaaaccgtctctacacgagaaccaagaagaatgaaacaagagaataggtcgataaaggagagagaagggagatgattggatgagaatttaatttgaagacaccatccattagatatatagtttctatgtatagtgtctatatgacatgacaagtatggaaactatttaatagtttctaggttgaggatggccgaagtatgtgctctttatgcccattgaagttactatcgagccactgtgagagagagcctccaccctacccattgctaccatcagtctctttaaatggtgggacaacgttgtgctgttggcacgggcgtcttgtccctcttcccgttgctagtcacctccatcattgtcgctaccgccactcgatgctgaggtcaagctcaaatcgccatagatctagggtcaatggagtattgacattggtgacgcatgtgaacggtgtaatggacattctcttttctgatattgccttatgtggagtcttcgaatgaaaaccagtccggatgattgaaatagcaaccgtgacaccgatcctatatgttgtggccttcttaaaagcgcttcattggaggtttcatgttgatatggcattgttagtgaccgcattttcattgaatcggctttgatggatatggtggtcgcaagatatgggtgaatgattgtttacagctaagtttttattcggtttatcttttcgctttggttcgacattagttgctggcagtgatgtgtgcttgattcgatcgaccgctgatttcggagattctatttttggtttaaggaatatagtgattacatctaacatgtaaggcattgtgaagaaacaatggatatgcagactctcactaaccatagatgaaaaatctttcttttgagtggtattttaagtagttttaaatcaacttatgattttataatccataacatttgtattgtaatatttataatatctggttatagcttttataaagtaaaagccagaataaattctacttcctctgtcccaaatgataaggcatatatttttcttacactgtcttcaatgacatgctttgaccagcattttatttcatgctactccctccgggttgataatacttgtcgtttggacaagtgtgaggtcaaactttagaatatttgattatgaatcatttttaaaatatttgtgtttcaaatatggtgactacatgtatagattagtcttaaaagtactttaataaaatcatatatttgttaacaattttatacatattataatgaaaaataatgatcaaaattattttttggagaccgtgctcttgtccaaaatgacaagtattatcaacctggagagagtatgtttccaacaaatatgaaattagcatcacaagaaagtatttcaaaatataaatctagtgatataacacttagtatagatatactcagtatgattattaggtaagttattgagattgatttttgttaaaatgggggcgccctataatttaggacgaagtgagtattatactgttgggataaaaaaacatatcatattagccggttcatgcgtacgtcgttgagtgtgattaaggtgaaattaattaactgcgtgccggggaggagggaaattaataatctcgtgaagaagaaagtgggtgggagatttggccgctcttcggtgacagatgacaaataaagcaggcgttaaggatagagatgcgtcaccaactcgatcatccagtacactgtacactagtatatgcacggttgtatatatatcgatcagagcctcacggaatttggggctatttatcactagtcgatacctgcaatggtagttgcatatagtacaaccttacaattagttagagcaacgaccagtccactccaagatcaaattaaaccacccttgtatgtattcaaaaaatggaaattaatttcagcatgttattttttttctacaaaaatgtgcacagtgaaacttcatctggcctaagttggtgttcttttctaataaaaatgaagatgaagttaggccatgttaaaaaagctattagcacataataaattaattttaattattataaacctagatttatttgatactttaacaacttctatatgaagagttttcgtacaaaatacaatgtcattggcggctccaagaaattcccgttgggtgtgcctacttcaccttctaaaaattctagcatatatacttgaatagcagcaccgcagccgagggacatgagatgagcacaacaactgcgcatgtatgacgcactcacgataaacctagaattgggcgtggtggaaaatggaataggttattactaggtcgagtatttgggataaatgagatacgttgagccaaaattcaggtggtccatagaccacctgaacacccacttggagccacctctgcacaatgtttagtagtttaaaaagtgtactaacgcaaattaaggtaaaatccactatctccatcccaatttaatcatcccttaagatattttcaaattattcatcatctaaccagttctatttgtttattcttgcagaattaaatgacatcgttgcgtgtttgttcgtttacgtgtgcagaataggaggagtaatgtcatcgttacatatctctttatttatctgtgcatgagtaaataccatcgttgcttatttacaaatatgatgataaattgagaagaaaagagcatatcttaattaaaagaaaacaccacctta

SEQ ID NO: 23989 - DNA, 1244 bp, Oryza sativa
  unsure (1)..(1244): unsure at all n locations
nnnnnnnnnnnnnnnnnnnnnnnnnnnnnnnnnnnnnnnnntgtccttgtgggttgggcagagtcgcagagacaaccttagaaattactacacgaagaaaaaaattgcgaccacacttctttgagaaataaagtatgctgtttctaaaaaaaagtctggatctttttttggaaaatacaggattagaaaaaaaaagtgttagaaatacaacgtgtaatgtaggagttctgaaaagtactggaagatagcccgctcatttacacgggaatgcatcacggctgcatttcatatcttataaggtataatattgaccacataatacaatttcttcacaattttttgtcaacattgcttagatattttttctatcatattagttagctttacatcgtcaatatttaattaatccctataagcaattatctataatcttcatcgtaggtaacctaagtttgtttagaagaatatgtaacaaattaagtgtaatttaaaagtatggtgtttttgtttatgaattggattcttatgggttaactttttctaatttttaagatgtgatatgattcgacttaaagatttttctaaaagtaaatttaaaggttgaaaataatattaataggtcattgatttatgggattgaggattgggtcccgactgggatgttcactggggacctcttcggcgacatggttcctcgcacctcactctccatcacggggtgctggagggcaagaagggccttgagctattggtcctattgtagccaagaaggtgttgttgaggtcggctattgtagaatgtatctatccgacccagtggtctgcctcagggaaaatgactggattgaacggagtttgtctcaatagcaagttgaccgcaataaggcgttcgacaggagttcgaacggggtccgagggttctctaagagcaccaagagctagatcacgcggtttatcccctgaacgaagttcaccatcttcgcgtctatcatgagtgactccggattaaaaatgacaaggtattataaccttgttcttacaataaaagaaacccaaagacatagcaacaaagaaaaggaggctctggatcaaaaaataccacaataccacaatagatataagcagacaagtatgcaaaattaaaattaaataaaaaggcattagcccccatctttattcctctcacaaatcaagaaacccaattagttaatcaatgacctgacatacgagcattttcaaaccttc

SEQ ID NO: 23990 - DNA, 513 bp, Oryza sativa
cggacgttggtgggaaaagctttccgacaagggtttttctggccgaacgccctcaaagacgcctgcgacatggtgcagcggtgtgaagcctgtcaattttacagcaaacacacaaaattgccagcgcaagcgctccagaccatccctcttacttggccattcacgtgctgggggctcgatatactcggaccattcccacgaggacagggcggctacaggttcctgttcgtggccatcgacaaattcaccaagtggattgaagcgacgcccacgggggaaatcaaggccgataaagctatcaagttcatcaaaggaatattctgcagatatggattgtctcaccgcatcataacagacaacggcttccagttcatcagtgccgacttctaagattacagcattggattgggagtcaagatttgcttcccctcggtttctcaccctcagagcaatggacaagtcgaagggcaaacggcataatgctacaaggaatcaaaaaccgcgtctatgaca

SEQ ID NO: 23991 - DNA, 1359 bp, Oryza sativa
aaaaagaaaggaaaggagaaatgtgggcccacactattttctctcacttacatgtgggccccacatatttatttaaatttttttgctgactaggatgcacgtcagcgaaacagggtggctatactgcctcgggaccttttttgacggttttacatagtttagggtacacatttctggttttgtgggtaagggacctgaaaaattctcggtgttaagtcgggggacctccagtgaacttattcttaagtttgaagaggtaattgggtctttttgtttaggttgagcacggagctctcgttccctcaacgtaaaaggaaaggttcgatttgagtccctcaattataggtcggatctaattcatatccctcaatgtaaagcataggtatgtcgtctctcccaaatttaaaacaggtgtaaaatgatttccttgaccattttgagagtggtttttgttaacatgcatccatgttacaaacacagtcataaaatatattaaaaaaaagtgggcttacatgttatcctctctctttcggtaccctttctctctccccccagtcttcttctcagctcgccgtcactaagccttgtacatctaagagggtcttaggtaaattggtaaaatttgctataggatatttaaagtttgtaatctttgctagtagacaccgcagaaacatggcatggtcaaggatactctaaagactttgtaattggctggaagacaccttaatgattattttattatttccaggctaaatggagagataaattatgttaaaaagacaaaaatgcccttaagtgctactagcatgtcaactggctctcccaatctttctcattgatcattgtaaaattttgcatggactttctttcctacgcggttggtggcggtgacactcgtcagaggtggagcagcgaatcgaaggatggagtcttcttcttgtgttggtgccgggtactttggtctgcgccaagcataggcggtggtggccagtggcgaacccagaacaaaaattaccgaaggtccaatacatactaattatctaattattgactaatatattaattaatatagtgtaatttagataggacaccgggtagtataacgtaggcacgcccctggtggtggccttgccgccttggagccctaggtggtgttccatgcagcgtcgtcggtggccttggttctccgggcgccgatgcgctttgcggtggcggctgttttggaattttgggcgatggccttggagctccgagcgctgctactccgtgtggtacccctgaagctccgagtgccggtgtttcgtgtgatggccttggagctctcggtgcacctgctctgtgcggcggcggtggccc

SEQ ID NO: 23992 - DNA, 9297 bp, Oryza sativa
  unsure (1)..(9297): unsure at all n locations
gtctaccgttcaggttgagcaaactctgctcctcagatctaacgacagaatccgtagaaccaatttgctgagtccagtgatacctaaactaaaatctagagcttagcatcaaaccttcgatctataccgttttcgtggtgacagctgtaggagtcttccagattgtcaagcgacgagcatgtcaatggaggccaaagtattcagtcgtcatggctttgtcgcagaactctatcgatctgatcctctattgttgtttactttcatcaggaaatttgcttccttagattggttagcctctaccctgttagagatggattattgccttaaatcatatcctttgtgatgtactggggtgtatcccctaaattctgtcttgtttaataaagttgttcctgttatccttaaaaaaaaaagacttcctttcctgtagaggtagatgtcagttaacaatctctctcctcccaagcaatttacatgctcgtggcctgagaggcattttcatctttttggcatgtttcttttttatatttagctcaaaagtaataaaataattgtgctaatagattagagtgacggtattggataaccacacctcctgtttagttccaaactttttcttcaaactttcaactttttcatcatatcgaaactttcctacacacataaacttccaacttttccatcacgtcgttctaatttcaaccaaactttcaattttgatgtaaactaaacacacccctaacactgctattcccttcgtttcaaaatgtttgataccgttgactttttagcacatctttgactgttcgtcttattcaaaaaagttggtgaaatatgtaaaactacatgtgtatatgaaagtatatttaacaataaatcaaatgatatgaaaagaataaataattatttaaattttttgaataagataaatggtcaaacacgtaaaaaagtcaacgatgtcaaacattttgaaacagagggagtataactcaatgcgtttttcgtcctcgatttaacaaaaaaattccaaaatcagagttccagtgactagtcaacctttcctattggtgaggtgggattattccacgatggcactgtagcactgctgccgccgcgctactgctgctgctggaagttttttcatttttaaatttatttcttttaatatttacagaaataatctatcgccggaaaaatttatagaaatagaccttgccgcctcagtggagggcggcaagctgacgtggcagacggcgacttgaccgcgccgtctgccgccgtctggaaaaattacatttagccccttgcggcaaggggctaaatacaattttcccagccctctagagcatttggctggtgcattttgcatctgggtcccttgccgccctctagtaggggtcccagatgcaaaacagccacatgcttctttccagatatgttgataataattaaagaattatttatttaaatgtaaatcaaccgtggaaaaaataaactcaaataaacgaaatgcgtgacttgtaaaattttctaaatctctaccgaaaatagacgtcattcgagtgtcatttattaaaacaggcgtaactttatcttacggactcggaatcaggcaaataatatatccacggatatctacagaaaaagttatatccgattcttccccgcttcaccgggttcggcgatattaaaacctccaaattccacttgcaagattgtgttttttaggagagaagtttttcggtagagctttggaaaattctacaggtcacatattttgtccgtttgagtttattttttctatggttggttcttgtgttcttctaagtgtgaaaaaaatatcaaaaaaataaaataaaaataaaaaagttgcacatctctctcctctacactagaggggagaggggttagaaaattccacgtcacatatttcgtccatttgagtttagtttttctatggttggttcttgtgtgctcctaatcgtgaaaaaaatatcaaaaaataaaataaaaataaaaaggttgcaactccgcggagagatacaaaattggatgcaaggggtgtggagggggctagcttttttgcattgaggtcccttgccgccctctgctagagcggcaagggacccagatgcaaaatttaccagccaaatgatttttctatgttacgttaataataattaaagaagtatttattggtaaaacttgttaataatgttataaaaatgtattgaagttggttgtttcgcaatttcatatgttaagtgaaatattattttgtaacttattcgacgtattagtgtgcgaaattgatataggcctattgcagtctcggtcgtagaaacattatatgcacttaaacaaggagaattatgtaacatgaagaaatagtagtcgaatttgaacatgatacatctatttccattgcggttacatagatgatattagattcgaactaggagggaggtagtgcaagagttgaacacaacgacgatgtagtaatgggacaaggaggtattacagtagtaatattgatattagcgtgcactctccagggacaacgatctttttccttaacacaccgaacttcatattgtggtcggttcgacttggcaacccaaaactctctatgaagtgacactgcaaaatgctttaccgcctccttcatatcttctgctctattataaatcgctctctgaataaccttattttctttgtactcccatctcacactattctcttcagatacgaccagaccagaaaaatcctgactagcccattcggctagattaatatccgtctcatcatctgacgaatcaccttcctccacacgctcgttgtcagaatcctctctctccatttcatccacaatggcaccgacagtctccccctcatcggccactccatcaccgggttgattgcccactggagctactacgcccccttcctctcggcgcccccttcctctcgtgcattgacctcttccacataactctcatttacttcagcacttggtccctcgccatcatccatgttcttctgcacacctggatccttcgggtgaacaaacggaaccatagctagaggccacccgcgttgcaatgcattctccacataccatctccacattcgagagttttgaactggcattagttcccaataaaaaccctcagttgtccgacttactataacattgattgttatgtcactagtctgtggatcaactctcaagccactcatcaaccatccttttatagaaggtacactcctctctgctggtctatcaattcccctttctgatacaataaattctgacagatctaccccagttggccagtaatggacgtttcctgggccatggtaaacttgaaatatttgtttgttcgacatatctgtcaatgaaataactagatcatattattttttcatgcaataaacacctacaacgtaatatcttctcatgtacaccaatgtaatggtaaagtattgatttcaaactagtagatctacgtatttaccgatatctacaatacgcagttctagattagtacaactaaaaccctaaaaatataatgcatttattcaaacaaagttttaaaaaatacacagtagttaacttaatagtcacatataggatctatgaatattatctgaaatcggtgtctgaatccagcagggcttcgccccttcttttcttctcctcccccttctcttttttttttaactggagttgtgaggggaggaatgagggctgggggcaggggcggcaggccttttataggcagcgaggcctgccgccctctgttggggcggcaagggttttcctgcaaaaaaccttccctccgtcaccgcccgtccctcccccgtctgccacgtcagcttaccgccctctgtaggggcgtcaaggtctattcttgtaatttttttcgccgacagattatttctgtaaatattaaaaaaaattaaaaatgaaaaaaattcctgctgctgttttgcttgtatgggccggccaaggcctgctgctgctgctggtctgctagctttgctcttttttttatctcttcttttcttttcttatttttcttttttctctaattatttgtggggcgttataattaccaagtttttaaagtgtgttaaagccgtgccacattcttacagagtccaccaacaaagatcataaattttagatatatatcttatagtaaattttgcctgaattttatttttatgctgagattcagattggtgcacaataaacttatctctcttaaatttatttcccaacaaatagtaccccgaggtcagtgtttacaaaacgatgtagtaatttctgtgtatgagctctatataattttggtacaattcatacattcgaaaaaaggccaagaaaactaaatttccaaatttaccaaaccagaaacgcaacacggatgaaattaaaaccgcaccaaaatccgaataaacaaaaaaactagtgcggtcatattagttatctgtccacacttatgacaaattcgcacgatcattgaacacgtaatgattatcggcttatagcaactactccctccatttcgggttataagatgttttgactttggtcgaagttaaactgcttcaagtttaacaaagtttatagaaaaaattaatattttttacccaagataaatttattataaaaatatatttaattattaatttaataaaactaatttggtaatataatattactatatgtgtctgtaaacttagttaaacttaacttagttaaacttagttaaacttaaagtagtttgactttaactaaaatcaaaacatcttataaccatcactttaactaaaatcaaaacatcttataacctgaaatggatctgaaatggagagagaacaaattttcatcattgacagagctatatactgaaaatgtttaagtgttgcaagtcaagagtagctcaagtttttttctcctaatggaaatagagaagatacttttatttcccggaataaaaagaagacacgttaattagtttggctaatgtcacatcttggttggaataagaatctacttgtaaattagcttgtcgactcagtaatgatgcgcacagtgctcattgacctcactatatatccaataaatactgcagtttgtgcaacacccatatctggtttattctctttttgagccgccaaatggttggtcatgtctggaaactttgaactgtctgtcacaagtgcaaataaaaaattcattaaaaaatagaaagaaaaatactagtattcgattctggaagaaaactttctacgtctagtctcatcaggggtgcatattggaacagacaaagtgagcttcaaaggagaaacgaccaatatctatacgacagagcagagagaaacaaagttaattaccaaattaagagactgagcactaattcttcatcctttctacaattccactatctccttttcttttctttccctttaaaaatttgcgctgcaaaccgaatgcatttcggatgaagccagtcctcttcccgttgctactaataacaacttcaacatgaccctacaatcgaattaatctcaaaacgaaatcgagtccctatttttgtcattatatacatcaacaatctaaagtacatacgctgtggcagttttgatgttatatgagaatgcaaaatcatcgtaaaatccttgggaaaaaatcatgatagcatccttgtttctttgtcatgtacgtttgtcggttggtttttctaaataacttatagtctgacctttgttgattgaatcatggcaacggctacacgttcacgtttatttaattttgaaggcgttgtttttgaagggtatttttatcataatttttagtgttgcttcggtggagtatgaggataaagatctctgttgattgtagctcactgtggcataacatgtgttgccatatcatttttttttaaaaaaaatttacgtcgtgcgtatcctagctatgcagagaccgaatgtaaccttaggctgtgttcttttctatgggttgagaatccatctcttgcgcacggaaaacagagcggtccattagcgcgtgattaattaagtattatctatttttttaaaaaaaaagatcaatatgattttttaaacaactttcgtataaaaacttttttgcaaaaaatacaccatttagcagtttaaaaagcgtgtgtacggaacacgagggagaggtgttgggaacactgaacaaagaacacaaccttagagtgattgtatcatcttgatataattatctaagatcaataaagattcctttattaaaaatataaaggaaggtgcagtggctcgatcggaaaattttcttgttgcatgagttatatgcatcttaaattgatttataagtaaattatttacttgtgtggtgtgtgctgatatgttaaaaaacaagcaagctagtttgtacaaacctgagcacaaatgatccatgcaagcaaaattgatttaacataacgcacactgatatgtaattattattacacgtcaaacttaggctgacaaaatatgcaataattactattcgcatgatatttttaagatttagactgaccataaaattcgatgaaaatggagtgtttatacataaaaatcaaaatgtttttcaagacttacttgtactgaggcatgataaaaattgtatcggtcttctacacaaaaatgagcatcggacaagttatatatgggatcagaattcccaaagtcataaaataattttattttattctctatccaaaacatgaaaaagaaacagttaatttatctttttattcgattctaaataagatcttcaaaacatggtcgtacctgccatgtcatcaatgttcacctagatcaattttgtgatgaccgtcttggcttatgctctcacggactagctaagttagccattgtatcggaataagtaatttgtaagttgtatatattgaaacccaccatatgcaagtttttataccaggagtgcgatttaattttgatttaaaatcaaaagtatagtttcgaaggatgacaagattaatgaaggaaaattgcataagcatgacgaaggcaacaacggctcatgcatgttgatatatttatgggctcccttggaatgaatacccttgcacaacctactcgatagaatttaattcacaaaatgctttcgagcgcgaatggttcgagcttgggaataaatgtgaaataattggggtatatgtgaatcttaatactatactagaaaaaaatacccgtacgttgtatcgagtgaatgctattttaatcttattattgttatacggcttagctaggatgaaattaactttgggaattcgcttggatatatattttttagaaaatcatgaactacaattaggaggccgactatcatctcaagttagcatacgagttttttaaagatatttcttatatgacttcttttatatttccaacagcaaataaatttaaaatccgactcaaacacgaatttgtatttccaaaagcgaacggacttaaaaactaactcaaatacggagggcgtatcaaaataccaaaaaaacatcttcaatttttataatagtaagatatagatatatatcaaaacataatcacacccaaccattactttagtactttaggaatgatgatgacttccgatgaccgttatatacttatatacttaaacaccactaattaatcctagagtcctagcatatgctatgtacaagttgaagactagtatatttgttgtcaaaaaaaagaagattagtattttaacaagaggacataaaagagaaataacttttctctagctatatataaaccccttcgatcatccatttataactaacaagctagacccctcaaatgtatgtctaaccatgcacatatggatatatagataggggaatgatgtagcacgggtgcaaggatatatagttccatgaaaggtttgatatatactcgtactaggagggtgacagaagagagtgagcacacgtggttggttccttgcataaatgatgcctatgcttggagctacccgtgctcacttctttctttgtcacctccaccccttttatctctctccctccctctcatactttatctaaattatatctaatttctttgtattggaataacataactacacccttcgtaattcctgactataaatctaggtatggactattgattttttttcttgacggaagagtatgatttatatcttcgtctctctctctcataactcctcctcccctctccgttggccaagtgagagacggcgggtggagcagcatccggtgggcggcattagcggcaggcggtggcggtgtcggctcccgtggcagatgcggtgtcggtggcgtcagcggtgggcagggcggtggtggcggctcccgcggcggatccagcagtggcaggaggcgcagtggcaggaggcgcggcgtcgacggcggttccttcggctgatcagggctcccgtggcgtgcagtttgggctatgtgatttggggatgtttttttggatcgatcgatttgtgctatgtgaaattgtgttttgtaatttgtgttgtgttgatggatggatcgatggtggtttgtgctgctttggggatgtttcgggatcgatggtggtatgggtgtaatgagaagcggctcaattcgagtcgatgcatcgagctgtttttttattcctagaatctcaaaggtgccagttcctagaccagcacctttgagtcctcgaaggtgtcgcctgttgggtgcttgttgggaaatccaatacccaataaccttttttgagtagtgtgataatcaaactagcctcaacaatgttgaaaattagggatctttcttcttatctcatgctcgcccctaaacaaaaataaacatcacctttaaattatcatccttgtttttatagtaaactgaagaaaaccccacattttatagtttaagttgcagaaaaccataggtatcactagaacggataccctcatctcaatcgggcggtaaaccccatctcaatcgggcatggcgtccgtcacaggctagaagtcactgatgtgaagagctatctcaatcgggcaaacggccgttacggatgattctatctcaatcgggccctaagtaaagcccgtcaccgatagttttgacccagacgaccagtcaaatctcaatcgggtcacaactagcgcatcatctgtacttcccgatcggtcacccatcccgaaattgnnnnnnnnnnnnnnnnnnnnnnnnnnnnnnnnnnnnnnnn

SEQ ID NO: 23993 - DNA, 1096 bp, Oryza sativa
tcgatggtggtatgggtgtaataagaacggctcaattcgagtcgatgcatcgagctgttttttattcctagatctcaaaggtgccagttcctagaccagcacctttgagtcctcgaaggtgtcgcctgttgggtgcttgttggaaatccaatacccaataaccttttttgagtagtgtgataatcaaactagcctcaacaatgttgaaaattagggatctttcttcttatctcatgctcgcccctaaacaaaaataaacatcacctttaaattatcatccttgtttttatagtaaactgaagaaaaccccacattttatagtttaagttgcagaaaaccataggtatcactagaacggataccctcatctcaatcgggcggtaaaccccatctcaatcgggcatggcgtccgtcacaggctagaagtcactgatgtgaagagctatctcaatcgggcaaacggccgttacggatgattctatctcaatcgggccctaagtaaagcccgtcaccgatagttttgacccagacgaccagtcaaatctcaatcgggtcacaactagcgcctcatctgtacttcccgatcggtcacccatcccgaaattgctcgagaccaagcacaccaagcacacttaacgtcaaagttctttagagattggcttccagaaaagtaattgtaacatgttagtatgagtattctattaatcctattatgccctaggccaggatgttaaattggggtaattaaatgatttcaaatggaaaagtcaccaaaaccaaagttgtagaactcatcgaggtgcaaaatttttattttggtcatttctccatctgactctatttaaacaatttgaaatttgaaattcaaagtttgaaaagttcaaatagaattttagatcagtgaacgacttcaactgaaaaagtcatcaacaacaaagttgtataactcatcaaaatctataacttttattttggtcatttttctatataacattttttgaaccatttgaatttgaatttggaaatatgacaacttcaaacaacatttttaaatactaaatgatatcaagtgaaaaagtcatcaacaacaaagttg

SEQ ID NO: 23994 - DNA, 10208 bp, Oryza sativa
aaactataacacatatatgtaaaatttatgaataatattactaacatttcgtcagatgaagaaataacaaaaataaaagttttagatcttgatgagttattcaactttgttgttgatgactttttcaattgaaatcatttagtatttgaaaatgttgtttgaagttgtcatatttttaaattcaaattcaaactgttcaaaaaaaatgttatattgaaaaatgaccaaactaaaagttctaaatattgataagttatacaactttgttgttgacattttttccatttgaaatcatttactacccgtaaaattattttgctatagtcaacttacaaatataaacatttcatatgaaaaatggaaaaatagtcatcggtgacgggctttagttaatgcccgatagagattaagtatatagcccgtcactgatgagtcatctgtgacgggcctagttgttatctcaaacaggcctcaagttggtgcacgtcacagatgatggtcatttgtgacgggccacaacttgaggcccatttaagatatggaatgttatctcaatcgggcctaaagttgtggcccgtcactgataggtgtcatccgtgacggacttaaattttatacacatctaacatgtctgtgcgaccatatctcaatcgggcacttttcggcccgattgagatgacttccttgtgacggcccactatttctaagcatattagagcccgtcacagatagaaggatctgtactagtgtattatgacgtgtgacacaaaaccatacgtttttatggtctaaacgtttcacaaaaccccacctttattgaaatcctgattaatttcagcatatcttaaacaattttttaaagtggtgaagatttaaactatcaaaccaagtcaagaacttaatgactacaaatttcatataaactctacgatttagaaattttgagtaaattcacgctcaaatacacaagggtgggggtttgtgaaattttaaaaccatatatattaatacctgaggtaagtctcatgtgtctaatacctgtggtttcttgtaactttgatcataaaaaaattatggatcgggcacccgattttaagctaaaaaatcaaataccaccttagccgctgtcacatgcgtagatgcccatcttagcctgtcacacacgcaggtatagatggctataaggctcgcccggcacgacctggcctagcccaggcacgggctaggcacggaccgaggcgatcgggccggcacggcacgatcggtactttaggtcaagccgtgccagcccacgggctgcacctcaggcccaggcacgacccaccagtagttggttgtgccattccagcccgaaggcacgggcggcccatcgtgccttctttgaaataagtctatttcccctccctcctttttgggctatgacatatataaagctaaataagtctattttacgtccctactctttgggccatgccatataatacgtctattttttctccctattctttgtattgtgccttacatatggttgaaaataagtttgttttgcatccctaaacttcgtgcagggccgtgccggcccagcgtgtcgaggtaggagcccaagcagggcacggctgttgggccgggctggcacggacacgacccgagtcgggccaaatcaccgggccttgcgccaggccatcgggcctcgagccatatggccatctatacgtgcaggcgctgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaaccaataaagatctaagcagcggaaaaataaaataaacggcgcagacggctccactccacaggcagcttgaccaaggctacacctaatcctccacaccatcagcctcattgtagaattcttcctctgatgaatgattgcaaggtgagtatatgacatactcagcaagccacgcagcaaatatgcaagtgcacaggataacaaaggatggcataatagggttgcatttgcaaaagcagcatttaacaaacatttgagaatttaataaaatagttaagtaattaaacaatattaatccaacgctatacaacataccctgttgtataggcccaaccattctgaacaaccaccccggctgcacagttctatctccaaaccaggaatgtaccattccaaaccaggagctaatcaaattattatcagtttaagcatcttttattataatgagaggtgtgagactaatcacgaaagacattgttcgacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataaatgtactaatatttctaagcagggctaagcaattatatctaatatctagttgaaccaatataaataaagctcaactagtcaaattgtaataacccaaggtatcaaggaataaggtaatcaagtacaaaagggctataacaatcaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcggctagggtttgggtggaccgggcgcacgggcggcggttcacgcgaacggacggccgagattcgatccaatccaaacggacggccgagatcgatcgggtccacggcggttcacggcaaacggccccgatggcgtcggcaatgacgtcaccgacggcggcggcggctcggcggagcgaacggctcgggcggcgcacgctcaccggcgaacggcggcgctacggcacgaacggaggacaccaacgggtagcggacggcacggcgaactcaccgacgaccaaagcgacggcggacgaccaacggacggcgacggcgacgaggttgaaacggcggcggtcttcggcttgacgacggcgacgatgctccggcggtctccgacggcagcgaaagagcggacgaggacggcgacgacttggcgacaacgacggcggccttcccgagcgacggcgatggctggaacgacggcggcgcacggctggagcggcggcggcgaaggcaaagctagggcacacggcgctagggctactccggcgacgagaggcgaaggcgagggtggcggcgagaagagaagagcacggggatccttttaaaggggctcggaggcgacgacggaggcccacggcgacggcaacggcgaaggaaactcgcggcttggagagaggaaagccgatccgattcgaactcgaatcaaactcattccaaaccgattgagccaaagattccaaaggagaaaaggtagaggagatcccggagattgtttcccctctaacaaatcggccggagaaggaaaggaacggccggatttggaaagcggcggcgacggcagctcggcggcgcgaaactagggtttcggcccgaggaggacgacgactctgacaggcaggacccacctgtcagcgacagcgagggcgcgcgcgcggcggactgggccggcttgggccgaggagagagaagagaggttttgggccgactttcggcccaaagccaaaagagactttttaaaacctttttcaattaaaattattccttaaatgcaattccatttattaaaaatacttccttagctcaaataaatcccagaaaaatctaggaattatagaattaagcaaagtatttaatgaaattttatctggccccattttatattggaatttattaattaaaattagattttcttttcaagacttttaaaattatttctaaaaattccaattaaacaacaatttatatattttgaattttcagggtgtgacaaacctaccccccttaaacagaatctcgtcctcgagattcggaagaactggcgaacagatgcggatgagctgacttcaattcatcttctcgttcccaagttgactcttcttccgagtgattactccactggactttgcaaaaacggataactcgattcctggttcttctctcacttatctggtcaagattagcttcttcggtaggtactcttaaacacttcttcaattgcgacacatggaacacattatggactcctgccaaagattgaggtaactccaactgataagcgacctctcctcttctactgacaatcttataaggtcccacaaaacgcggtgccaattttcccttggtgtgaaaacgatgaactcctcgaagaggcgtgacacgaagatacacatagtctccttcttcaaaactcaaatctctgcggcgattgtcggcataactcttatgtcgagactgagccacacgcaatctttcttgaatgatctttaccttttcttctgcttctcttaggatatccgtcccgaaaacctgacgttctcccgtttgatcccacaaaagcggagtgcgacacttccgaccatacagtgcttcgtaaggagccatctgaagactagcttgataactgttgttgtacgaaaattctgcataaggtagattcttatcccaacttccaccgaaatctaaagcacaagctctcaacatgtcttccaaaatttgattcaccctttcggtttgtccgtctgtctgcggatgataagcagtgctaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtctttaccggaataaaatgagccactttggtaagtctgtcgactattacccaaatagagtcatggcctgatgacgttctaggcaaaccagtgataaaatccataccgatttcttcccatttccatccaggaatcttcaaaggttgcagcaaaccggcgggtttctgatgttccgccttgactcgctgacaaacatcacatactgctacgtactctgcgatttcacgcttcatacttgcccaccaaaatctttccttgagatcctggtatatcttagtactaccagggtgaatggagtataaagtatcgtgagcttctttcagaattgcatcttttaaatctttgttgtcggggacacagattctctcacccaaccatacagttccttgctcatcttccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataaatccaatggcaactgtcgtccttctgtagcattgcaatagccttttctgctaagagcgtctgctactacattagtctttcccggatgataatgaattcccatgtcataatccttaattaattccaaccatctccgttgtctcatgttcagatctggctgagtaaagatatactttaaactcttgtgatcggtatacacttctgtacgagtaccgaaaagataatgacgccaaatcttcaatgcatgaacgactgcagctaactcaatatcatgagtagggtagttcttctcatgcggacgtaactgacgagatgcataggcaaccaccttcccatcttgcatcagaacacaacctaacccaagtttggacgcatcgcaatacacttgaaaacccttctttggatcaggcaaaatcaaaataggagctgatattaagcgactttttaactcttgaaaactccgctcacattctttcgaccacttgtactttacatctttctgaagcagttgtgtcatgggcttagcaatcttggaaaaattctctataaacctccggtaatatcctgcgaggcctaggaaactgcgaatctctgaaactgtctttggttgcttccaattggttacggattccacgttactaggatcgacggcaactcctccggctgagatgacgtgaccaaggaacttcacttcagacaaccaaaattcacacttgctaaacttagcatacagttgatgttctcgtagcttctccaatgcaaggcgaagatgttcctcatgctcttctttggttcgagagtagataagaatatcatctataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggaaaaaacagtggcacctttaagttgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctactttcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccaacattgctggtgagagttacttttttgttggcacagtctatcacacctttatgtctggttaaccagtccatccctaggatgacatcaaggtctttggattctaacaagataagattggccagaaatggtactccttgaatttctattctgacagaggggctacgttgcaaagaaagtgcttgatcacttagggtactaaccatcaaaggacgtctaaggtcttctacttccatcccatgatttcccgcaaaactcatagataggaatgaatgtgtagcaccagaatcgaaaagcactgttgcaggaactgagttaacagggaacatacccaaaatcacatctggagcatcttgagcttctgcagccgcaacatgattgacacgggcctttgatgctggtacagcagagttattctgggcagggacaaccttcacgcgacggggcttcggacacttgtcagcataatgtcctgggtctccacagttgaaacacaccacgggcttgttgccttgctccctcttggcaggttgttgctgtgctggagctgcaacaggacgtggagcttgattacggatgttgttgccagcattgttgttgaagaactgacgctgcggacgaacaacagacgaagaacctccatgtggcatggactggggtcctaaagtaagacgcggcttctgattatttccctgttgtgccttgaagtgagcaatccgacgtttcctctgctccatgcaattgtacttgtcctcctgacgtatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgagtaagcgacctgaactccttcttcttgagagacactactcctgatggtatatgcgtcttccggaaagcagcggtgaattcaagccaagtgataggttcagcagtagtcctgttaaggcggaaatgatcccaccattcagaggcagggccatgcaactgatgtgatgcaaatgataccttctcctgatcagtgcactgaagtaaatccaacttcttctctatggcatgcagccaatcactagcttcaacaggattagtggtactagagaaaacaggcggcctcacacgaagaaattctgctaacttgttctggggaggtgcatgattatttccttggttttgctgattctgaagttgttgcatcatcatgttcataagttgtgtctgttgagcaagaacttgagctagagtgggattctctccattgttgttgttattggggttgttgggaccaatcccgttgctgcgagtattcaccatctggcatggacagggcacaagaagagaaaacgggggaaactacttagaacagagaattactttaacttttattgatcttgactgagttttattattacaaactaaagactctcacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcgattgaaggctcgttcggctcgtcttcatcatcttgggttgctacccactcaatcttggaatggttgcgcttggattcttcttcttcatcactacttatgatgatgaccggaggatccgcttgagctggggcaacttctttctccaccacacgaacctttggcgccagttgatagcgagggacaaatagagctctcttccttgcggtgagacgaatcctggccttctgcggcggtgcttctcccttcaatgcggctaattccttttccaaacgatccaccttgtcttctaacttgcaaatcttaccacgattccggtcttcacgatcttgagctgctaacacaatctccgcacgactttcatccatagcccacaacatctcaaccaaatgcttcgtggtagcatcattctcaattccttcagtctcaaggtaactaccacggtcacttccctggggttgacgaggatgggaacgatactcagtgtcggccaattgatcactgtagcgatcacggagctctcctatggcgatccttgccacctcctgacatgcatggatgtagtttcttcctccagcttcaaacatcactgaggggatatcttcactattactgttcaaagtgactttgactcggcacttctcttcatgacgatcatgaggaatctgggcataaaaaggggcagtcccaaatccaatgacaaaggacattgtacgcaactcctggacaaaaccctcaacaccaaacaggtactcaggcttgtaacgcggcatctaaagacaagtgaaaggagggagttaagtcctttatccaa

SEQ ID NO: 23995 - DNA, 930 bp, Oryza sativa
  unsure (1)..(930): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnntccagcttcaaacatcactgaggggatatcttcactattactgttcaaagtgactttgactcggcacttctcttcatgacgatcatgaggaatctgggcataaaaaggggcagtcccaaatccaatgacaaaggacattgtacgcaactcctggacaaaaccctcaacaccaaacaggtactcaggcttgtaacgcggcatctaaagacaagtgaaaggagggagttaagtcctttatccaattaatagcacaagtttttggattaatttgaataaagttagaaaatcaaagtaaaaagggaagtaaataaggtaaaccaagcttgcaaaataagttgaaatagttggaaacaaggttacaattttagtacttttgaacaataggtttcaaaagaaataaaagaaaattataaaatcaacatgctaaatttattttattgcagcaagattaaataaaacagtattgtaaaacttttgctggtataatgagccattagtacagtaatagatgtacagtactaataacactggaataaattttgaatgagaaccattaaaagagattatgaagtgcatgtgccattagtttggtttaattaaaagagaaagggagaagaacagttctacttttccaatatttttagagggcttctatggataaccatttggcataacctagggtcaaagaggctctgataccaacttgtcacgcccggaatttctatccaaaattccaaacgcttacatgtgtgtgaacccttgtccaggaatcagccgaggcacacaataacaaattgataatagagtaaaaatattactctaattaataagcgaataaaatgtcatta

SEQ ID NO: 23996 - DNA, 1794 bp, Oryza sativa
tttcatatccctaatggagttacaaggcttattactcgggaaactcaaaacttcatggtgctgttttgcttttattggtgctctgaaggcatccattatgtaattctcccttcgttccaaattgatctacatatatccattatgtaattctcccttcgttccaaattgatctacatatagttttttctgaaattattcctaaatgatatacatatttgtgttaatttattaagtctattcgttatttatgcattggagtaaatgtacgttgatgcatgcagctatgcacacaagtatttataacccacatgcaatatcttgatttgctattggctaggaaatagtaggaatggtgcctgcattgagtttgttgctagaataaatataggatgagagagttatttgcttttcttggttttggtgtacctatgaaatatatatgtagatcaatttggaatggagggagtagtttttagaaagctagctctggtaggatttttagcagaggttttgggttttattgtatcaggtttttagaattgattattgggaagagaaaaactaggaagtttatctaagaagtcttggtgacttgtagtttacattgaactcatttaatatttctacagaaggtttttatgattttttgtacggaaagtctttagaggtttatttgatttcaaatcctcttctatatagaaagtattatgatctcaaataaaatctatatattattgttaacttatgcacgccaacaattgtttgccttttggcctagggatgaaaatggtcacatgaatttccaactggccgagcatcgtttacatataaattatatcattttcgattcttgacatatatatttttttaatctcttttagcatcgttattgacattatatatttaaattaataaatatgatcaattctctaccaacggggaattatttctgaagggatgttagtgttttcatccctattttagcgccaaccctagtaggcagtagtactataggatcaaaaacaaaaggaaagtttgcaaaaaaaccaaataaaaggatagttttcaagaggtttgatccctagcttattttcttatgaaatcgagccgtacacatgtttacactaacattttgttttctttcatgtgaactaaaatatgcagtatttagaagagtaccaatatcctccaaaaattaggtgccattttgttttgaaccaaaaacataggaattttatagaattgtgagtttataaggtttttttttctatatggccttttggaataaagggttcaaaactattgaatcttatgaaattcctaagaaatgccttaatttatacaagttttgaaggatttttaatatgagatctaaaaaatttcctatgagtctatctatctcatctagcatatgtttttcctgcggtccagtcaaagaattatttttgtatttttctgtgttttataatcctctagttagcatttaaatttctattaaaatcgtgtatatatatatatatatatatatatatatatatatatatataaaatccagagtttcgaagtagccctttttatctactcaatcctccattcaaaaggggtccttcgtgctctttttttacctggcgagaggtgtgcgtgtgggcgggaaaaaccaagacgaaggagtgcgggggaaaattgggttaatttgatccatgtctttgcaaatataccatattgaaaaaatattattactattagtgaaggggacatatccggtgaaaacaagctaagtgttggaaactcgtg

SEQ ID NO: 23997 - DNA, 725 bp, Oryza sativa
  unsure (1)..(725): unsure at all n locations
tctcctctcacggtacacatccaacccttttgttcctccatccatctaagaagctgcatgggtaagtaggcgatcaagattttgaagaccggttctttgcgcgactcctctcggcactgcatcctctacaccgcggtcttcttcctctgcatcaacatatcgtccaacccaatcacaggcagtggaggaggagacagcattggcaacgcagaaacagagaacgtcatcaacggaggcaacaacaataatacatcatcatcatgtcgagcgttttctgggtatatgtgttcgacgatattttgtacattttttttatatatgaaagaaatgaagtgtgtcaaagtattaatttcgggaatggcgatataataacgaaattggtgattaattaccactaatagcacaacctggcgtacatggcgtatacgtatgaataatgtgagacacttgccgtcggctgctctagtatatacgtactcacgacattttgatatagggtgatcgatccaatttcatggttggctggtggaaggaaaaaggtgtgaatgttttcatgggaatggaagcatgtgccactgtagcactgtcattagaggaagttaatcatatgatttgccggccgttaatctctcacgtcatatgcatggaaaccacgtacagtacatgnnnnnnnnnnnnnnnnnnnnnnnnnnnnnnnnnnnnnnnnnnnnnnnnnnnnnnnnnnn

SEQ ID NO: 23998 - DNA, 269 bp, Oryza sativa
ttgttgtcatccatgaaaatctacataaatttcattaggtagaatccacatgtactcgtgcccggatcctgacgtaagcaataagggtgggcccaaacctggaatgtatttgcacacggagcgtgtcaaatacacttattcttatacctcacaagtgccttattgagagtgtcaatgatgtattggaacttggcttgcggtttcctcagtccatcgaagacaactatcttggaatccatcatttaaatggatcgcaagaaggatccagt

SEQ ID NO: 23999 - DNA, 1294 bp, Oryza sativa
ttaaaagacgtttttttaaataagatatatttaagtgctataaatttagatagaaaatatgtttatattcgttatactataatatattccatccaaccaaaaccccatatattttaggatggagggattatgaaattatgaatcatttttccaatttagctattgttttttgaactgctaataaaaaaattgtatatagaaatttgttttaaaaatcaaataaatcttttttagttgtaataatagattatattcaattaattaattatttattatttttctcgttttacgtgtggctgaaaaagccaaactatttacctgtatccaatgaagtctttctttctagtggtggtggcctggtgggttaaactgagttagtttcagcttatgggctcagatttttttcctcgtactctatatatatatatatatatacttcacagtgtataaaacttttatatagaagtttctttaaaaaatcagcaaatattttttactatggtctttaatagttaatatatatcgaatttgtgctaataaaatgtctccttctacatacggtgataatccttatctacaacatgaatcgaacggccgaacgggaccttagtctgaccagaagaatcagtaagagggtaatatatatgcaagttgtggttaggccgatatatggtcggattatcacaagggatccgatcgaatcgcacgtgactccgacccccctccggccggccggcagcataaataacgtacggatcggaggcgacgagttgatcgaccgtacgtacgtacgttacgtgcagaggagagggatggacctcctgtgcgacaacatggtggaggagatcctcgtccgcctaccggaggagcagcacctccgccgcgccagcgccgcctgccgccgctacggcgacatcatccgccgccccggcttcgccacccgccaccgggagctgcactcgccgctcctctccggcggcgtcgtcctccacggcgtgcggcgccgctgcccccgcgtggacggcaccgcagcccacgtccccggatcctacgccttcttcctccccgccggcgccggcgacgcctccgcgtcttcctccttggagttggacctcgccggcctcttgcctagccccaccgacagggagctggcctacctgctcacaccggcgccgccgatccggacgccgcccgcaggagcgtcttcatcgtgcactcgtcgtcgtcggccggcctgctgctgtgctgccgaggctatgtcaacccggtgcattactacgtctgcgacccggtg

SEQ ID NO: 24000 - DNA, 4228 bp, Oryza sativa
caagctcatcggcttcgacccggtccacgacgacgacgtcttcttgttcggggcgaccaatggtagtggatgcgtcgccgcctactccctcacgctcggcaagctgagcctccgctgcaagattgacactgccgacggctcgtcctccttgtgcggctgtgacatgttcccgtacgtacgcgcgtccaccacctcgccccgtgcggacataccaggcatggtgtataccaatgcctagagtggaatatatatcatgcatgtttgtacaccagcgtgtaggttcataaacttgacataatgaacttctctttaaacttattatgcgcatgtttattttactaaaccttttataccaccaaattcgttgggtacaaatatagatggccataggcccaacggcctggcccacggcacaacattttgacccggcccaagcacagcacggcccgtgcctgcccccccccccaaccggcacgaccgggccggcagactaggcccgatacacaaagaatagggagtaaaagtagacatgttatatgccatggtccaaagaatagggacgtcaaatagacttattttagttatatatacatatatatatatacatatatatatatatatatacatatatacatatatacatatatacatatacatatacatatatacacacacatatacataacatatacatatatatacatatatatgtatatatacatatatatatacatatatacatatatatgtatatatacatatatatacatatatatacgtatatatacatatatatacgtatatatacatatatatacatacgtatatacgtatacatacgtatatatacatatatatacatacgtatatatacatatatatacatacgtatatatacatatatatacatatatatatatatatacatatatatacatatatatatatatatattggatcatccaatagaatccagtttaccggattgaaaaaacaaaataattaatacttgatgtaacaatcgatgcatgcatgcagctactaatttaaaaattactgttgcatgcaaattagttaggtatgcagtgtgcttttttttcttcataatattcggtatgtagctgatccaacgttgaaagaacatatgtcttttttgcaggatccagtatatactgttttttttgtatgacttagtatgtactagtacgtagtacatttttggttgctggactatgtgcttttttgttgtaatatccagtacgtatgtacttgatttctttatgtatggtatatacttttataagttagtaacagtatgcatctttttaaattagtagagcagtatataccttttttatgttaatagcggtatgtacttttttaaattagtagaacagtatataccttttttaagttagtagcagtatatacctttttatattattaaaacagtatatacctattttaagttagtagcggtatgtacctttttatattattagaaaggtatataccttttatattttttaagttagtagcggtatatatctttttaaattattagaacactatatattttttaagtcaagagcagagtatatacttcttttaaagttagtatcagtatatactgttctttttcttttcttaaggtagtggcagtatatacttaattataagttagtaggcaggatatgcatttttaagtacatgctattttaaaattaggagtagtaagtatatatatatatatatatatatatatatatatatatatatatatatatatatatatatatatatatatatatatatatatataaacaagagatgcaaaagtatcggtacattctctaagatgcagaagacagcatgtattgagatgggaatatgaagaatagaaaatgtttgaatgtgccattctaatctagatataaacgaaaccatatgctgactataaaccagagcatacaatccaggcagtatatcccattcacttcatgtataccgattctgtctaaacagaatatccaatacgagaagcacaaagctctgttttcttttcggagcaatatactcgactttcataatacttcaaaacaaaataatgccactaaatcacagtttccaaacaaaggctttttcccatggcgcagaccctctacgtagcttgttgcagggttgaggtaagcatttgagtcattggagttaacatgttctgacggcggttggcaaccatctgcatgcaacaaagggcacccacaatggttatctataggctctctacaagagatacatgtcagcatattttcctacttggaagagattaaatgaagagagagagagtaaagctatctactaacctggagatagtctatagagaaaaacgaggcaatgcattagagagctatagatatccatgtagacataccattgaagtggtttactattaatctagtctattgctgagatgtaaatgttttatagatagcaccttactttaccattgcgggtgctctgagaggcttaatcaatgaactaacagaagaataaaatggaattgccatagaaagaatgcataaaaaaaaatccctaccgttttgtgcagcatcgggctagctgccacatcaatcttgcctcatcaatgccgtggatgaaagattgattaacgttgtgacctatgaatcaccgcatcgacctgctgatgagaggtcgctgcctacgacgccatcatggtaaagcccaaagcttgcttgccaatgacgccgctggggggacgatcgtgtcgtcggttagatggacgatgggttgccccgtgagtatgccgccgcgccgccgccgccgatttcgttcgtatcaagcaaagcctcgtttgatctgcatgtgggatttggattaggacgggataacttgttcaagcaattaatctgattagaatcacaagcggattaataattgatctacaagagaggacttaccagcatcgttttagccgcccatcggtgcaacggatgtacatgatgctgcctctatctccctgttggacgctgaatcggaccaaccgtcgagccagtgcgctgcgcgccgcctaggaacgacgatctggagtcgatcttgccgccgcctagaaatgtcaaatggcagggcagtagagtgctgccgctggatttatgtgagttgttagttccagatccgagttgtatgggataattaaggatcatgtgaattcatttttcacgtaaaattgaaacgggttcgttcgatgggatccgatagtaaaatcgtgcaggctcattgagatgctttggatcgacggtggatatagcaggagtacgtactcccaggagtatataatcattttcgtatatatatatatatatatatatatatatatatgtatatatatatatgtatatatatatatatatgtatatatatatatatgtatatatatataggacactcatatggggcaccatggtgcccgggcaccatggtatctaatgcacaaaatcactcaaatttttcaaatttttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatgtatatatatatatatgtatatatatatatgtatatatatatatgtatatatatatatatatgtatatgtatatatatatatgtatatatgtcagcccaaagaggagggaaaatagacttattttaaaaaaaggcacgatgggctacccgtgccttcgggctggcacggcacggcaagtcctgactgctggttggccgtgcctaggccggaggtgcagcccatgggccggcatggcacggcccggtgtgttggtcggcccgacagattttggtccgagcacggctgtgcctgggccgtgccgggccaggccgcctgtttggccatctatagctacaaatataatgtggcaagttgggga

SEQ ID NO: 24001 - DNA, 3299 bp, Oryza sativa
  unsure (1)..(3299): unsure at all n locations
tactaagtgtgacaatgaactaagcactaggctaacttggtcaaagtgcctaaccacgagtttggcaaattgtggtattcaactaaagaacccttatatgtaccatgatagcgaagttagtatagctcaattggttaaattccccgtgctggaatgtacccatttgagtttttttttttttacaaactgcatcagacaatgcaaaataatgcaagttaaattctaatatagtaggaaaaatatcaagagctgtagtcaaaaccgctcggtcgctccgccccaggggcgacgcgggcggcgaaacccgccgccgccccacccttcccctcctccccccgcctagccgctgcccgagcagccgccggcaaagccgggcagctgcaaagacggcagcggcggggctccccatctccctcacttggtcaacgcggttggggcgacgacgagaccggaggcgggagcacggcaccggctacgatgttcggatctagagccggtgagctcggatccggccctcgcttggcggcagcgaacctacgaggggctggcgggatggtggcggcgttggcgtgagctacgcgacgacgtggccgggcggcggcgacggcgcgtgctacacgacaccaggccgggcggtggcgacggcgacgagcccaggccagcgcgtggtgagctcggatccggccctcccttggccggatctggtacttccaccggcagcggcgagccgacgagggactggcgagacggcggtgggcggcggccctcgatcccgcagcaacgtcgaggccgggcggcggcgacgatgggcttctccggcgcgggctcgtcggcgacgacggctgctctggcgccggctgccacggacccggccgggggctgccgacctgctgcggtttgccgacgatggggacgacgcctccatctccctccttccttttcctccagatccggctctcctgttcttcagntgttcttattccagtgctctgcggcggtgcggagcccgctcccctcatcttaaggactcctcccttcttaggctaggctgcttccagtcattgccgaggagctccttggtgtggtaggggtggcgtgcggagttggattcacgcgttctatctcgttgttcgtcggccgcgccgtaggtttgctgcagtggggttcctgtgtgtgaggtggtctctggtcaagctgcattgtgattgactgttgaggcagagtcggagctgcttgtcttgcaagctcggcaacgatgaccctcaacagacgtccaggcaacgcgacgagggtttggaggtggagcatttttgagagagtctcgggtgaaaaccttgcctagtgctttcctaggctgatgatatcgatgcctgtgggtgccgtttcctccttggaggtatcgtcatgatggctctctctcccttcaggtgaaaaccgggttccatttggggacgagcgttgacaacattcttaatgttgttttccttgttgaaggcttcgctcagaaggtttctgctccactagaggatgttgggtggttatggagaccttgttgaagctgcttgcctttggcaagctcggcaacgacgacttgtatgaggtctcaatagttgctttcttttccttttctgtataggtttttgccggtttcctgttcaattaaccgtgattgttcggtttttggacccggtttcccttattaactgggccatttctcttcttctataaattctgacaggagaaactcctatcatcggttcctcgaaaaaaaatatagtaggaaaaaaacaccaagactgcagacctaagaggctatctatagtcaagaaggaaagacgtcgtgccataagccaacaacacaagccactgaggaaggagcctagcaccaggtcggccacggctaagcacggcctattgtctctgggcctaaaccttcgcctggagcccgactgcctgccatcttatctgtggtggcctcatcatccatcaactcagctaccaccaaacaccatcacctacacatggtcgccacatggcccacaaaccaacacccctctgctggccaacccctgctcgacgatgggcttcaaggagtctccactcctgctgttaccctccgtcggcaaccctcattggccctcagaccaccacattcatcctcaccatggagctcctcgactagatcgagaaacggattggacatacgacggtaggagctccaaggagaaagtggggacccaaccctaaggaagatgatccttcgtcgatgtctgttccactatgctgaccacctctgtatccaggcgtagatcgccctaaatagcaccaggcaaggccaaccatctgatcaccagcttcccacttatcatatagagctccccgtgacctgatatggactgactaggtataggaggggaggagctacaaggtgaaagaagcttgactagacatggagctctgacaaatgacggggttggcaagtgggacaatgcggtgaaaagcatcaacattgtggccagtaggtgaaggaagacacttgtggtgatggagaactctatagatggccatatggcccgcggctcggcacaaggaacgccattttggcccagcccaagcacggcacggcccgactggggtcgttcccatgccgggccatgcctgggctgcaaccttggcacgatgggctggcccggcacgacacgatcgaagaaaaatagtatagggatgcaaaatagacttaaataaccatataaagcaaggccaagaagcacgatgggctgtcgtgcctgggccgtgtgtgcagcccgtgggctggcacgacatgtaggtcgggccgtgccgacccgactaacctcagccgaggcagggccgggcctgggccatgccgtgtcggatggcccatttggctatctatagagaactctactgcctgccgggagcgtccctagggaggaccaccgtggagagctagaggcaaggagtacagtggcaaggtgtaatagagggaggaggaagaaaaggaggagggtgaggggtatgttgcgcactacaatttttttttgttgtaatggatctttttttttatgctgcacatgatgttattttgaatgttttaatgagtattttattatgtttcactagttcattcataaatgttgcacctggcgtcattgggatgtttctataggtattatgtaatgtttcaacaattacaacttgatgttgcatgtgtgataaaaaatgtttagattaggattgaagggtggttcattttctctattattttttgtcagaatata

SEQ ID NO: 24002 - DNA, 5696 bp, Oryza sativa
acccccgtggaccgccgccaccctggtcatcctcgccgcgtcctgtcgcgtcgccgccatggtccttctcgctgcgcccttgccgcgcagccacagctggggatcgccgcccgagccacagccaccaccggggaccgccgccgacacacagccaccgccgaggaccgccgctgccgtggacctcctcgccatgtcctgccgctccgtcgccgtcctggtcctccttgccgcgtcctgccacgtcgtcgccgtggtcctcctcgctgcgccacccccgtggaccgccgtcgcgctgatccacctcgtcgcgtccttgccgcgccgccgcagcaggggaccaccgcagagccacagccaccgccggggaccaccgccaagccgccgtcgtcgagacgccgctggggagagcgctggatcgggatcgggatcggtagcggtagggttagggttggaaatttcaattttttctttgacagtgaaaactgggtatattttgcactgaggacaaaatgataattattaaaaaaaataacggttgtaacgatgtggagttgacggtgatggcatttttgggagaaagaggcttgtgcaatggcatttttgggaagtttcctttgtcgatggtatttctgggattagggtgcatgtcgatggcatttcatggattttctctctttttatttttattacgaacgacttttttttcgccgtgttaggggaatcggacttttctttttgggacctttttcgctcttttttcttttttttttccggacggttttttcacccctttttaagctgatttttttcacccttttttaaattacgggcgacagacacgttatcattgcgccgaagggcgcacgcatctcggatagggcgtgcggcaagggacgggcccaatcgctgatacggaaacatattgaattagaaccgattcagataaggaaaaaaaccaaaatacagataaaatcaaaattctgatacggaaacatattcaattaaaaccgatttaaacacgaatgacgacgtaccaaattttcaggcaaaaacaccttgaatttttataatagtagagatatatattgttctagtgcctctataaacttaatatatatttttaaagttattgataattaaattataaaattttaacctcaatactatccaaaacatgaaagaactatgaaatcgaagggagcaagtgtatatctatattctataggcttagttaatgtaacccagtactcgcaaaaaaattaacctacttaatatgtattgagtccacgatgcaattaattttattgctttttcataacagcgccgatccatgttggtgttgctctatctatcagaactaaagcctgatctgccagcaacttgtttaaagaaagttacaagagaaaaacaaagaaaaaggctaattaaattctatcggggcagataaaaatttcgatcttgtactgcatcggacatgtgtgccagcggtgttcgtcgtcttccacgatcacttgtctagttgcctgcatgcacacaaaataaagtcgcattcaaattaaaattaaaaacgtactatatatataactccgtttaaatccgagagcacactataagctgctgggcattaagaatttaaatgtcctaaaatataaacattttttttagtctgacacggtctccgatatgctacttacgaccaagcaatatctatatctataaaagtataagatgttttaaataaaaaaagttgcataatataatagtttgtttaataataaatatagtaacatcaattttacataattgatttttatttattttattactattaatagtcaaaattaaatgttaatctgccactatacttaaaaatgtttatattttagaatgaaggaagtatatataaaaatgtttatattttagaatggagggagtatatatagaggagtaaattcagctatacctctcccggccatgatccgatcaacgtcagctttggcaacgtcgaacctgtactccacagccgccgtcagcttggccgcggccgcctgcacgtcggcgctgtcgacggtggccgccgactcggtgatgcgccggacgatcgtatccttggtcgactccatggactgcaccaacgtcgccgactcaagacgatcgcccgtcggctgctgcccgtagccggacattatcttcttcttcttcgatttggtatataaagctagctagctaggagctaattaggagttgaaactgagatcactgtctacgcatcatatatatcagaatgcaaatcgatcgattatatatagcacatggagagatagaggtgcagatcgatcgagcaggtaagtgcacacacgctgatgctgctgtgcttaggttttccatctcgccgccggtgaattcagcatggggcgtctgggcagatacgtggcgccgtatgcatgagtgaaatctgcatgctctggctaggctctagctgtgtagtgatttctaagacggatgggagcactacactgtattgttgttttcagtctccttaattttcttttggttcactttcatatatagttgaagagtatatcactcttccatttaattaaggagaattcaatcccgatgattttacatgggccaatattttaattcaatctcctaacttatacatgtgaatgggccaggattaaggcccccatcgaaagagggtctcaggatggcaaataagatttcgttttttttaagagaagggtatttttttacctggcctttacatgcatccaatcggatatatgcagcctttttaaattatgaacttaatccctcaagcctaatctgaaattcgctcctatatatggagatttgaaattatgacctttaggtgctacttaggtcactgcaaccactagaatacatgccttttttaggacgactataagaatactagctcagtttttagatggcctacatatttttatcaagtggaattctactaattttttgttagggtaactacagttaggataggggtgctatttaactgtgggggcttaattccctacagtggtcttggtaaaaagggataggagtgctagagtgtgctacactgctacctatccacaatacagatgctttggtgcttaacaaaaagaaacttaatggttgtctagggcaacactatcataggcttgcaccagagtgaggctattattcttgttccttgtcatggacattggacaattaatctgcggtccggagcctcctcaaccttttaccaaactgaaggagagtgttggtgcctttttgggttaacacggacttatctaaagatttacggtgttaacagagtcaccaaccaccttgatctagaaaactcccaatcaagatgggtttaggaaagagcaaaaccagccagtggagccgatttaatttagagatcaaatcagcctctaggctgatttagatagatatggtagtaaacacccgtctcgtgggtgaatcggaaggtttacgggacagacctacaaagggtatcgggctctcgcagcgtaggcgaacaatttatgacgtaaatcgataaagatggacgaaactagggtaaagtagaaaacattactgaaaagtaaaaggaacgatttgataaattgtgtaggggattatggtcggtgttagaatataattggccataacccttatgaaggggttggtgttacctccatagggttttttccacgttctattaagtgagatcaattaggactcaaagaaaccttggacggaagctacgaaacacgagaattgccttagctagactcagactcggggctttcggtctgactggccacctacagtcagactacagttcaccctccgatctgatgacggtcagctcatcctcctcgggaaagctccggtctattccaactctggcccaaacttgctataaatttgtcctagtactaaattttgttgttaacacatgtctgacccctgtcattttagcaaacttgtgagctgaaaagcatagaacacgtggtctcagggtgatgatttctatcggccatatgtgctttcaaatgcctagtaattaaatcattctctttatagcgtcccaacaaatcaacaatcttctaagaacaattcacacatttcggtatagacatttccaactagatgattacccatcaagccttttgcatctagaccataatggtaaaatcatctattcatgtcaatttttaatcttgaaacgattctaccccagttctgttattatgggctttgtctataacttcatatcatccgttaaacctctttctaatcttcaaaaatttcttggtcactttatcactattagtgtcccataacaattgaccgataaatcacctcaccaaacataggagaatcaaccggctaaatgatttatctcgcaaaccaattgataaatttcacaatgccttataaacacttcatccatagcaattttagattgagcggcatccaaacatatactttgaaagcactattatatgattcggcaatgtaactctttattaaacaaggtgtattggatgcttacgccaaactctccaatatatcttcttcaatcaactatcttgcttatatctttgaaaagttccactagtggaatcctcctattggtaccttgaattcataatagatcaaccgaatttcataggttcaattcggttatataatcaaatttgagctcatgcccctggctacataccacggctgcaatccctagttggactgatgttagagctatggtcattggtcatactggccaagaaaccgcggttagattggcattgaagcatcgaccagaccagccatgaggttgtggttagatcgacctgatatgcaattatctcacacaatttctatgcaatataccaaaattctgatttttcaaaagacatctaagctaaaattcggtaataaatttttcaaaaattgttggttagaacttagaaactaaagaaaaaattcagtacgacatgaataccatccttttaccctaccaccttaactaagtgtggcatattgtcagagttacggataaggtataccctctatccttggatgtatactgtatactgatacggtatacccgcgcgtatacggacagtttccgtatacattaaggaaatctatcacgtaatagggatggtatctacatatggaaggagttctactcggaaaagattgggtcttagccatatcgtgaggggtccaatgtcttcgagtcctacttggagatcaactgacccgcggtatataagggaccccctgggcaggacctaaggcattgaatcttactgccaacacaaccaccacagcctacggagcgcgcaggagccaagtcgtcgggagacctagtcgaaccaactcgactacgatctcgtcggcatcattgagttctgctattccctttgtaatctatggtttccatcatataatcccataccaactggattagggctattacctatcaaggggtctgaaccagtaaaatccttgtcttttatctgcctgatgtcatattatgtatatcctcgtatcaacggaccccaataccctctatatccggtctgcgggtatcccccgtcgacagtggcgcgccaggtaggggaacttggtgctcaaggttctactactatgacttcaagccttcc

SEQ ID NO: 24003 - DNA, 10655 bp, Oryza sativa
  unsure (1)..(10655): unsure at all n locations
cgctggcccaacatatcaaaactctcaatgcgatattgaacaaaagcccttttgatcccgtcctgtacgctgatctcgatcactgggcagaatgactacgggaatcagtggctaatctcaataacgcgttcgcagaggccgccgccagggcaccactagaacaaccgcggatcgatggcgctaatagggaacaacgagatggagacctgcccgaggacagtgatccaactcagcggtcgccacctcgtcaacctactcctccaccccgcggcactagtgatctccgcgagcacctaaatggccgccgagaagcacgactcgctcgagataatgaaaaccgttgccgacatcgtgcctcttcacgacattgcaagaacgaagaacaaggaggacgtccgagccagaaccgagaccgtgatgattgccacaaccgccgcgaacatgctaatcgtgaacagcggatgccgagtgataccagtcgaggtcgacgccgtgacgacagtgacaacagagatcgacaccgggacaacaacgatggacgacgacgaggttcacgagaacccgagcatcgtccttgaagccgtgcctcggaaccaagtgacccatcgtcgtcatcatcatcttcatcatcggacagacatccacgatgagcgcgtgatcgccaacaacctactacccctggcggtgggtgcagggctttcactcgtaccctgcgagatgttcgatggcttgagaagttccgaccgggagcaatagagaaatacgatggaagcaccgaccctgaagaatttctccaggtctactccacggtcctctaggctgctggagcagacgacaacgcactggcaaactatttgtcggctgcgttgaagggatctgcacgttcatggctggttcacctcccgccctactcaatttcttcatgaacagatttgtggcaacagttcatcgccaacttccaaggaacatacaagcgccacgtgatcgaggacgacttgcacgcgttgacgcagaaaccgggcgaatcattgagggaatatattcggcgctttaatgagtgtagaaatacgatccccgagatcaccgatgcttctgtaatccgtgccttcaagtccggtgtccgagatcgctacacaacccaggagttagcgacaagacggatcacaactactcgcaaggtgttcgaaattgtcgactgatgcgctcacgcgaacgacgccctgagacgcaaggaaggcaagtcgaagataggagaggagtggaaaccagccaaggacgcacctgagtcaagcaagaaaaagagccgcaggagtgggaaacggaaagctcaagcggaggtcctcgcaacagaacatgttgacccgcccaagaacccagacccacaaggcgacgatacgaataaaatatggtgccttatacacaagacggacaagcactctctggagacttgtttcatcttcgaaaaggcactcacaaagaaactagcgttggagaggggcaagcgagtacatgtagtcgagaaggccgcagaagcgactacttaggtctcagattcagcttacccggactccgacctccatgtttcgcacatcttcgtaggttccacggcgtactcctcaaagagagagtacaagaaagtggagcacgaagtttgttcgacatcacagggggctgcatccaagatgaattggtcagagcagaagatcgagttctcagaagtcgaccacccaaagactaccgtcacaccagggcgatatccgatcgtggtcgagcccactattcggaatatcaacgtagcacgggttctcatcgacggcggcaactccatcaacttactcttcgccagcaccttggacgcgatggggattccacgaagcgagttgatgcccactgatcaacccttccatggaattactcctgagtcatcgtccaagccattgggcaagatcacgctactcatgactttcggccaagcaaacaacttccgaacggagcaaatcacctttgatgtcgctgagttcgacacggcatataacaccatcatcaggaggactgctctcgcgaagttcatggccgcatctcactacgcgtatcaagtgcttaagatgcctggaccgaagagaacaatcactattcagggaaacgcgaagctggcggtgcagtgcaacaagcgaagcctcgacatggtcgagcacactcccaacccacccgccgcagctgagccgcccaggaaagtgaacaaaaccaacaagacgccgaagtcagacggcgcaatcaagattgttccgctctccagtgccaaccccgataagaccatcaagatcggggcttcactggacgaaaaataggaactcgtgctcatcatcttcctccgcgataatgcagacgtgttcgcttggcagccgtctgacatgccgggggtccccagggaggtgattgagcacaaactcatggtgcgacccgatgccaagccagtaaaccaaaaactgcagagatttgcaccggatcgaaaacaagccatacgggaagagctcgatgagcttctcaaagctggcttcatcagagaggttctacatcgagagtggctagccaacctagtcatggtgcgcaaggccaacgggaagtagaggatgtgtgtcgacttcactgatctcaacaaggcgtgtcccaagggtcacttccctcttcctcgaatagaccaattagtggactcaacggccggttgtgagttgttaagttttcttgatgcctactccggctaccaccagatcagcatggcaaaagaggacgaggagaaaacatcattcatcatgccattcggtgtattctgctacgtcaagatgccgtttggactgataaccgtaggaaatactttccagcgcacggttcaaggggcactcaacgaccaacttgggcaaaatgtcgaggcttacgtcgatgacatcgttgtcaaaacgaagacaagcgactcattgatcgacgacctccgggaaacgttcgacaacctccgacgataccgcctcatgctcaacccagagaagtgcacgttcggagtaccgtcgggcaagctcctcggattcctcgtctccggaagagggatcgaagcaaaatcccgagaagatcaaggcgatcgagaacatgaagtagccgacaagactaaaggaggtccagaagttaactggatgcatggcagcactgagcagattcgtcgctaagatgggagagcgatgacaactcttcttcgccctcctgaagaaacaagacaaatatgtgtggacacaggaagccaaagacgcatttatcgcgctcaaacgctacctgtcaaatccccctatacttgttgctccccaacctaatgaagaattgttcctttatatcgttgccacgccatattctgtgagtactgtcattgttgtcgagagagagaaggtgcaaagaccggtttactacatcagcaaagctctccacgacgcaaagacaagataccaacagatctaaaagctgctttacgcagtagttatgacatcaagaaagctacgccactactttcaagcccacagagtcacagttgtttcctccttcccccttggagaagtcgtgagaaacaaagacgttgtcggccgcattgcgaaatgggtagtcgagctaagccagtttgatgtccactttgtgccacgaatagctatcaattcccaggttctcgctgattttatagctgactggactatgtctgagaacaggccaaacagtcaaacagacagcgaaacgtggacaatggcgttcgacggcgcacccaatagccaaggagcaagggcatggttcatcttgacatcaccttcgggagatcagttcagcaagcacgcaattcacctcaacttcagggcaaccaacaacacagccgagtacgaaggactactcgccagcataagagcagctgccacactcggagtcaagcgactaattgtgaagggggattcagaactagtcacgaaccaggtgcacaaagactacaagtgctccagccccgagttatccaagtacctcgcagaagtcaggaagctggagaagaggtttgatgggatcgaggtccgacacgtataccgtaaggacaatatcgaaccagacgacctcgcacggcgtgtgtcccgacgagagccactcgaacctggcacttttctagacgtcctgacaaagccatcggtgaagaaggtacacgacgaaggtagcacggtagtccccgacattagctagggggctacagaggcggtacacgtcgttgccgatatcgagactacagacgactggtgaaccccgctgatcaagttcctgagtagcgacgagttgcccgaggatgatgcagaagctgagaagattactcgacaagccaagatctattgtatgatcgataatgatctgtacaaaaaaagagccaaattgagtacttctcaaatgcatctcgtccgatgacggcaaacatctcctcctggacatacacgaagggatctgcaggtcacacgccagcggacggacgttggtgggaaaagctttccgacaagggtttttctggccgaacgccctcaaagacgcctgcgacatggtgcagcggtgtgaagcctgtcaattttacagcaaacacacaaaattgccagcgcaagcgctccagaccatccctcttacttggccattcacgtgctgggggctcgatatactcggaccattcccacgaggacagggcggctacaggttcctgttcgtggccatcgacaaattcaccaagtggattgaagcgacgcccacgggggaaatcaaggccgataaagctatcaagttcatcaaaggaatattctgcagatatggattgtctcaccgcatcataacagacaacggctcccagttcatcagtgccgacttctaggattacagcattggattgggagtcaagatttgcttcgcctcggtttctcaccctcagagcaatggacaagtcgaaagggcaaacggcatagtgctacaagggatcaagacccgcgtctatgacagactcatgtcacacgacaagaagtgggtcgaagaacttccctctgtcctatgggccgtgtgtaccacaccgataacatccaataaggagacacctttcttcctcgtgtatggctcggaggctatgctccccacagagctacgacatcagagcacatgagtacagaagtactccaacgaggagcaggaggagcggtgaagcgatgatgtgaatctactcgaggaacatcgagaaagagttgccgtcagagcagccagctaccagcaggccctttgccaatatcacgagaagcgcaccagagcacgtacactttcgatcggcgattacgtcctccgacgggttcaaagccaaacagggcgcaacaagctctcacccaaatgggaaggaccatacacgatcacgcaagtcttgcggccgggcgcattcaagattgcagacggcgatggccgcaagttagcaaattcttggaacattgatcaattacgtaaattttatgtataaatcaatagtatccatatttgtaagatatcttacgatttcaataaagttgatttcaggtaaagaatattgccaaagtgttcctttccaacgatcccttaccacgacgacacctagagttgaaacctatccttttgtccctttacgccgtcctggcaaggcctctgaggaacctaagggaacttcggctggggacgcccagagcggataaggccttgtcaggttatgcagagacaaacgaccatgtaagatctggtcatgtaagagttctcagttctcaccgtgcgtattaaccaagccgtgtaatcggaaattgagttttccaacttcacggctgggggctaaggtcagcgctttttcaaccaaggtaggtcaagggtccaagagtcttatcctcccaaaacaattctctgacgacaaggctggggtctagggagagtgtatggctcaagtgactgatcgaggtcgcaaagtgagaaaacactcgtacacaacatacccagagaaataaaaactaccaatatggccaacgccaatccatggagtagaagaccttctcggcaagtggcgccatcgactgcgcaagactgtcgatttcccaggcgtcctccgagaacgagagaacccttcacgaaagaactcgaggtgcagctgcgggctgtgatctcggatgcaggctagcacgtgtcctccgcgcgtagcggctcgctcgacggcactcctgcttcagggcctcgtcgatgcgcttgccaatcccatcgagttcggcacaggcccccttcatccacgagatgtaaccagcagcggactcctcgggatcttcacggggaactcggagctccctacaaactcacgccatggctgtgcagcaactcttgaggtatgagttgaaccacacctcgtgaactcggagagcttctatgccctggtccttcttcgcttccacaacggctctttcgagttcagccacctcgaatttcgtcttccaatactgcattcgacgatctcggtcagccaacgcgttctcgaaatctacccaacacggaaaggactaagtcaagctactcctctctttcgagaacacagctaattaagtcaatccaaatacgaggagcgaaagaaatcaagacacaaacctaaagaagtcatcgccatgttcgcccccgtggacggaacctgatcgacttcgacctccggcacgtgcggctcaggcgtgagcgccggaacaactaccggcgtatcgggctgcccgcactgctggacatcctcgacatcaacatatctacaataaagaaggtactcggaatcacacgctgaggaaacaagggaaacggttgtttaaataaaaacagtgtcgacccacagaaagttttacagcatgaagattaaggagtacaagggaaagtaaaaaccctactcttcaaaaaggggaggacatactcccccaagtcgccgacttcctccatcgtacccttgcgcgcgttatcggtggctccccgatccaacgcctctttgaggttcaagtcgggatgcgccagccttatgcacgcaaggacttggcacgccccggtgtatataccgttggacgtctcctcgctgatcctagccgcgtggcgggaggggatcgcctccatcaccttagccaacttggtgagcgatgacgtcaatgaccactcgtcagggtgcgccgggattgaaatcacgacgccacattccctggcaagttggtgcaggccagtgaatgatgtccgcagcgatccccggatgtctgtcagatggtccttgagctccgacatctggtgctcgagcctgcgccactgcgtctcgttgctagctaccagctccttcatcttttggaggtcctcgcgggcctccgccaatcacgcgccagctgatcggcgcgctggtttgccgacgacgccgccgcccgggcttcttcgatctcgcggcccacgccgcgggcgcccgcttggaggatgcgctccatctcagcctggagctctccccaagtgagggcatcggcggacagaggctgggcggtcacgaggctggcgataggactatgtggtgccgcctcctggtccttggtagcgaccacggctcccgtcgaggtcgccacaggggacacactggaagcagcatcagccccattgtgcgcatctttcgcccgcgccatcctgcgaagatttttctcttctctgtgaggataggtgatcaagactttgagaacgaaaaaacctcaaagacatttacttacttctcaccgatcgtcaccaacctctgccttcgcggaggcggtggagacgcacccgagtcctaagttggatgatatgatgtgaggttaagtcgttctgattatgtactctaggacgaaagagaagcttaccgccgggtccgtcgccttccggtgggtcccgagcacacaggagaactctcttcccctcttcggaacattgctgccactcgtggtggcagcagcagcgtctaatgcttccttggcggcgccctccttcagcgacgtcacagcctggtgatccacgagtggtccgatgacgtccgtcagagggagagcctgcacaacatgaagtcacgacgcgatctcgagaagaaagatgaaaaggaatcatcgagtacactcacgttaatcgcggcagcgcgttcggctgagcccttgtcgcagagtgggacagggatgttacccacctccgagggtccactgatcattatctggatgacgcggcgctgcacagtgtcactgtccagacctgtaaatcgagaatgagaactcgataagtcaggagaaacagatgcacttaaaacaaaattggaaatgcgaggataaataccccgagaagagacccgggtcacgtcatttggccctgagtaatcgaaggccggatgggtgcaggcctgtagcggctaaatccaccgacctatgaagtcggtagcgacttcatatcccgacaacccccgttctcggaggtcatcgatgatgtcgataaaggattggagggagggagccagggcgggtttagcagtccactctgggatcttttctgactggtcctcaggaataacaaggacggggtccgagttctctatctggagatagaaccatctcgtccgccacttgctgcgagaagaagggcactggaaggggatgtaacgcgactttaggccatcccgaagtcggaatccgacgcatccagataccctgttggattccatccaacgcagctcgtaataaaaatggaagaggtcaagaaaaggctctaccccaatgtaggcctcgcaaagatgagaaaagatgctcagaaaggcgatggagttggggttcaagtggagtaaagaaaggccgtagaaattcaagacaagaagaagaaactcggaaggtggaggcagaaaaccgcaagaaacataatcttcaactacaaccatgcggcccaaggtgggttcaggttctatacctccagcctccctctgcatggtcccgtgaccggggagggcaccatcgtcctgtagcttcttcatggacgcggtgtttgaggaagacttctcgaggtccatcgtcgccggaggatcgccggagaataggactaaggaagtgagttatggtttttgcggtgagcggagaagacgaagagcgctagaaggcaggagagttttctggcaagcggacttcaagtgaatccccaaaattcccttaaataagcgcactaccgacggtgcgtattccaaggaaaggagagagattgccgccggaaaattctgggtctgttgcgcatggtagtttctcagacttcaatttaaattcactcatgaccgttgaacttcatgcggtgttgtcgatggctctttgtctttatgatttttacaccgggatcgaccagatgagaacggcaacaattccgaaatcagaagtcgcgatcgataacatgagttcatttaagtagaagtcgggggctactgtcagggttacggataaggtataccctctatccttggatgtataccgtatactaatacggtatacctgcgcgtatatggacagtttccgtatacattaaggaaatctatcacgtgataggggtggtatctacagatggaaggagttctactcggacaagattgggttttagccatatcgtgaggggtccgatgtcttcgagtcctacttggagatcaactgacccgtggtatataagggaccccctgggcaggacctaaggcattgaatcttactgccaacacaaccaccacagcctgcggagcgcgcaggagccaagtcgccgggagacctagtcgaaccaactcgactacgatcttgtcggtatcatcgagttctgctattccctttgtaatctgtggtttccatcatataatcccataccaactggattagggctattacccatcaatgggcctgaaccagtataattcttgtcttttatctgcctgatgtcgtcttacatagatcctcgtatcaacggaccccaataccctatatatccggtctgcgggtatcccccgtcgacacatatatcattgcacttcccatttgtactttaagatgttgattgctctctctccttgtatgtaggccccactggatccttcttgcgatccatttaaacgatggattccaagatagttgtcttcgatggactgaggaccccgcaagccaagttccaatacatcattgacactctcaataaggcacttgtgaggtataagaataagtgtatttgacacgctccgtgtgcaaatacattccaggtttgggcccacccttattgcttacgccaggatccgggcacgagtacatgtggattctacctaatgaaatttatgtagattttcatggatgacaacaacnnnnnnnnnnnnnnnnnnnnnnnnnnncatcctcttaagacgtaaatccaaatttctaaacacacaatacgttttcacatcttcaatccttccatttgcaaaaattaaagctcccaacaagtaaattgctaccacatgcttgctttggccttgctgaacaactatgtggattcatctccaatcatatcatctcgtcaagacggcttatacaacattttcaaagcttctattgggctcgtgggtt

SEQ ID NO: 24004 - DNA, 3610 bp, Oryza sativa
tcctattgggctcgtgggtttcattgaggctggttgccatagtgacattttagatagccgttcaacaaccaaggatacgcagacttataattagtgggcataatgtaccctttaaaacctgcagtttgttaacaagctagtaaactgttcttccttttttctagggtgaactgaggcttacctgtatttttgttttcaccataagtagattacaagtaaactgttcttcctttttttctagggtgaacgaggatttgagcaactgaggcttactgaagtttgagcagagtgaactgagaaacaccatgctggtaagaaccattttttcttctaatggaatcatgcggagatggaattgatgtacgataacttgaatgtggagatgaattgcatttatgtgtgtatgtttggaaatttttggatgtgggatgacgtgaatttgtgaattgatgtttggagatgaattacatatattgtgaatggataatctgtgaactagcttttttttctacaagattataggtgccggctataaacttagaaccgacatgtattatactaatcctacataggtgccggttggtgttaataacggtacatataggcttgcgagggcatccattatttgctggttctttaaaagaaccagtacctataatacctcttaggtgtcagctcatactaattggtgccggtgtcgaaaccgacattaataggcccttccgaaccaacagctatggtaattcaccgttccgtttcacggaccaaaggaatgtttcctaaccccctcaaaagaaacggggcctagtacaggctgcaaaacgcatcatccggttctagaatctgcagtattagctagtagtatctccattctataatataaatatttttagagttggacacagttactaaaaaaatggtaaaagtgaatgatggatagttgtgattggttgaatagtggaggtaggtgaaaaaagtgaatggtggaggattgtaattggttgggaaaagaatgttggcgaagaagttgttatattttaggacaaatctttaggactaaaaattgttatattttggaaaggatggagtacaaacttatgatgctgattgtctacctgcaacgcaatcataaaaaggaagaaaaagctttttttacagtatggactgtactactctataaaaaataaactctagctactaatctagacatatatctagattcgtactactctgttccaaaaaatataaaccctagctacgaatctagatacgtatatatctaggttcatagctaggattaggtttttttttttacggaggagtagctatgattagacttttttttgcgatagaggggtatggtagttgacgtgtgatgtgcttttacactgaggtctggtttagttcccaactttttcttcgaactttcaacttttccatcacatcaaaactttcctagacacacaaacttccaactttcaacttttccgttacatcgttccaatttcaatcaaaattctaattttgacgtgtactaaacacaccctgagtgcgtccaattgtactaataaaaaaaaatcagctgatcaatctgcctcactctacaaggctctacaaggtaggctgtacgatgtttctgttgaacaacattgccacttcgtactgcatctcctgtaacctgacagggctcatacctgcacccctaacctaacatgattgtactttgtacctttgccattgatcatgagagagtggacaccccctaagacatccctcgttatttgaaagttatttaaatacataaaattttctttccctcgtaaaaaggaaaaaacaattataaaagaatttaaaaacatttgagaaggtagattaatatgtgatatatcatgatcaatcctcaaacatacaagttaaaatttaacttctataaagtataaaaaggaacaaattaaattataactaatattcaccatcaaatttattttaaaaaattgcagaagttaaatttgctattgtatgttggtggggtattaatatgtcttgttgatttttgaaataaaactataactattttataactatttaagtgccatacaaataacgagaagtatccttaagagtgtagaatcgttttcatgatcattgcatatcactatagacgtaacaagtgtaacctattagggtttcccttactgtcagtgttggggttaccgtacctggcgacaagcacagttaccatgcggtaaccatgacaaaccatacaaaatttatcaaaaatttaaattatttttaaaatttatttggatttaatagggttaccacagttttatctttaacttatcccagcagtaagaatgattgctgctataaccgtgccggttttttaaaccctgtaacctactagtgacgatagatttgcatgttcctaatgtcgacagtttcagattttacctcggttttcgttagcacgtttttcaaactattaaacggtgagtccagtgtgaaaacattctatataaaagttgttttaaaataccaaaaatattcatgtgttaagttctaataattaaaacttaattaatcatgtgccaatgattttttttcattttacgtgcgtcaacttgatcatcttcgtcttcatccgtttcatcaatcagattcgcaggttacaagaaacggtccacatcttgctgggttcaggaacctcatcatgatattccctccatcccattttaaggctgtgtttggagggaacccctcctcccggcacgcaaaacgaagtttattttattgcataattaattaagtattttttaaaacaacttttatatagaaatttttcgtataaatcacaccgtttagcagtttgaaaagcgtgcgcgcggaaaacgagagaggtgggttgagaaaatggaggaaagaacacagcctaagtgtagctatggttttccgcacataagtttgaccatccatcttatttaaattttttttaaaaaaaaagttaaaaacataagtcaagagtaaagtactattcatgttttatcatctgacaacaacaaagatactaattataaaaaattttcaaataagacatacggtcaaagttaggcgcgaaaagttatggttgcatttaaaatgggacggatggagtagtaaaaattgagcgctatttgaattttgaaaagcaaaagtttcaccccaagctgtttgatttacgtactattgcaaactaggaaacccgtactctaaattggccctacttttgtcgctaaattaggctgtgtttagttcacgataaaattagaagtttggttgaattggaacgatgtgatggaaaagttaaaagtttatgtgtgtagaaaaattttgatgtgatggaaaagttggaagtttgaagaaatatttttgaaactaaacacggcgttaatgtatggccactagtgcaaaaacccctgtaggcaatagataccggttttccagccggcaccaatgactaggtcatagaaccgacactttgtgctctctcggatttacaaaaaaatgaagccgtgtgctctctcggatttaaaaaaaaaaaagaagccggctccaagcatggagccgagcc

SEQ ID NO: 24005 - DNA, 1364 bp, Oryza sativa
  unsure (1)..(1364): unsure at all n locations
nnnnnnnnnnnnnnnnnnnnnnnnnnnnnnnnnnnnnnnnnnnnnnnnnnnnnnnagaagcagcataagggatgatcatcctgaacagttgttgtaatcatatctgataagaatatcctcacaactaggcattaccaaccttgcatcgtgccgtgaatcatataggtttctgcaaatacaccacagggtattttttttgtctctgattttttctatgttatatacaatatgttgctgggtttgccaagttctaatatgccattgcatttttctgaatttttatgatatactatagtcgtctggtttgtctttgttaaaattgtacaattttattataatgaccaaaataccgcttggatgaaaaattccaaatatcagacgaacaacttttttgcatagtttataatatgatatttaagttgagcgtatgattgaaatcatcagtgagaaaatcagggaaatttctttttcgtgcggtttgagtttcgacaaatggttttgaaatccccctgtgatcgtagcggggggtgtaagtgattaacccaacaaactcaactaattagatcaaaataaaataaagtgattttggtttatttgaagaatttatagtcactccccacctgtatgtacccttggtacggagcgttatgcagccactggtgagcacatccgccgcagcagctgcgattcccttcccttcttctcccgcgctcactcttccgccttcacgccgggaattccccccgcccctcaccgccggagccctcctctgcaaccgcaccggctccggccacgccagcccgcggggaagacgacccctaccaccgccggcgatgtcccacccgctctcctcagaacctcgtaagcgccgcccctcccctccatgcgccgtgtcgtgtcaggcatccttcaacaatcaaaagcaagcaagagattagttgatatatggggcatatcatatatatggcctcaactagcaaaactttggcagttgattgctatcaggtttcggctgattttggtcacaactgatattcagttcagtcagagttgctgaaatatgtgctgtccactcttttgctgtgagatttggtaatttaacacttcttaaaatgggtttcgattgtttgattatcaaatcttttcttttggtcagatgctttggaacaaagggcagtggtagtaaccaacaagcatggggagaagctcgtgggagtgctgcatcacacgggttcaagcaagatcgtcgtattgtgtcatggttttatatctaccaaggtaacatttggaaaaatgcgtttgtaataagtttaaagtgagatgcgnnnnnnnnnnnnnnnnnnnnnnnnnnnnnnnnnnnnnnn

SEQ ID NO: 24006 - DNA, 738 bp, Oryza sativa
  unsure (1)..(738): unsure at all n locations
aggtgcaagagcgggaaaccgtataccgggtacgttccccggtccggggttttggaaattcatttagttcgcaagcaccgacccaggtgtcgggttttccaagtcttttgtaaaacccaagttttacccaagaagtttttcagattttaagtttgaaggcgcccgtcgatactcgcacagggtgcacgaatatcgagacgcaactagatggttacaaggggacacgatataacaattatcaaaggaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagatttttggatttttggtctaaaggaaaaaggatttaattaaattctttttggaaaagaaaaagaaaagaaaagnnnnnnnnnnnnnnnnnnnnnnnnnnnnnnnnnnnnnnnnnnnnnnnnnnnnn

SEQ ID NO: 24007 - DNA, 1099 bp, Oryza sativa
  unsure (1)..(1099): unsure at all n locations
nnnnnnnnnnnnnnnnnnnnnnnnnnnnnnnnnnnnnnnnnnnnnnnnnnnnnnnaaaaaaaaagagcagcctctggttgcccatgcttgctgctgcctgccatatctctgtggagcttggactattctccatgtctcctgtaatgggagctcacgtcgtcgcctgtacaaaaggtgttaattaggggataagttaagagtatctcatactgttctcaactcaactgctgactaattacaccttcggatgcaacttggaacgtactgttgcattaattattgtctgcttgcaaatttctcagagatgttgaatttgatgaagtgtacgtgcgtcgcatttgcagtccaacatcacacctttgacttgatgtgattcaagcaacaagtgaagtgctaggctaaacacaagcacagttccccgaaatcatgccatttattcttgacacatggacatcctggaaattgttcaaagtttctagactgctaggaatgcgaataacttgtactgaacttttgaaacatttttgtcagcccaatcaggattttttttagtttatttcctgaaactctgcattggaacgaataaataaatggtgtctcaagaaaataaagcacgtgctctgaatctttgtgtgcagctgctgcccatacccgatgaaaattcagttcttgatttggtcatcattggctgcggtccagctggcttatccctagcagcagagtcagctaagaaagggctcaatgttggtctcattggccctgatcttccattcacgaacaactacggtgtgtgggaggatgaattcaaaggtagcatactattttcagcactgaataacattgttgccatcataatttggtacatgatggacttatggctcttgatcttttgctatccagacctgggcctggagagctgcattgaacatgtctggaaggatactatcgtgtacctagacggtaacaagccaataatgattggccgtgcgtatggcagggttcacagggacttgctgcacgaggagttgctgagacggtaaattttcagttagcaatcttgagagtaaacagagtcaggcaaagtgatacaaaattattg

SEQ ID NO: 24008 - DNA, 5619 bp, Oryza sativa
aaattttcaggtggaaaacaatccatatgatcccagcttaatggttttcatggactacagagattgcttcaaagacaaattctcacatcctgagcaaggaaatccaacgttcctctatgccatgcccatgtcatccacacgaattttctttgaggtccatatgagaaactttatcacaatttattcctccgactagtattttcccatgcttttgtgttgctgatgataattatttcaagacaggaaacatgcctagcttctaaagaagcaatgccctttgacctccttaaaaagcggttgatgtctcggttggatgcaatgggagttcatattcgaaaagtatacgaggaggtaacaagttatggcttggtgtcactagttgtttctcttgcataggtgaagtggaaacttaacctaaatgctgaactcttgatttcaggaatggtcctacattcctgttggagggtccttaccaaatacagaccagaaaaatctcgcatttggtgcggcagcaagtatggtgcatcctgcaaccggtactaacaaatcctcaatccgtactttcaatttctcttgtatttacaggcaataatataatatttatctgtcaaaaacataggatactcggtggttagatcattgtctgaagctccaagatatgcatctgtgatatctgatatcttgagaaaccgtgtctaccctggagaatatttgcctggaacctctcaaagttccagtccatcaatgcttggtaagcattcttctgatatttattcaattttattgacaagcacaccagtattacaaattggagtacattgcttcagatgagggcagtattttagtataattttggaaatgtcaggaacattttctggtactaattgctatgcggtgttgcagcatggagaacattatggccccaagaacggaaacgtcaacgatcattcttcctttttgggctggctttgataatccaactgaataacgaaggcattcagacattctttgaaacctttttccggttgcccaaatggtaattctactcttgattgcatttgcctctgttttcagtctatttacaaataccattatgtatgacctgaagattgccacccaacaaagtgttcatcactgttctttgttactatcaggatgtggcgaggattccttggttcgacgctttcttcagtggatctcatactctttgcattctacatgttcacaattgcgccgaaccaaatgcgaatgaaccttgtcagacatctcctctctgatccgaccggctcaacgatgatcaagacctacctgaccttgtaaaaccatttcagcagtctacaagaatattaggaaatgtacagttttgtagtttgtacataacatagtgagagccagaggatatgggggttggggggttacttatcatgctagaacaacaaaacactgcaagaattttatgcatgaatttggcaaatggaatagattatgcagaatgggaacacgtgaatacgtgatgcgtgtgctggaacaacaagtaggaggaataaaacccatggattatggatcttgtagtgagttgcattatagccattcttaggtcttatcatctctctcccctttccatttttacctctatccggttttcgacatgccggattacacaccctattttagatagctcggccaaaatgttccacaaacattttagaaaaggaacaaaatggaaaagaggagagaaaaaaaagagatggtgcaagaatagtctgaggctatccttgctccattgccatggcatttaggtcccaaaaaaaggggggagggaagaagaagcgccattgcagagtttgaaaagaaggttggaggcaaggaagagagacagaggagaaggaagggcaggaggggagggaaaaggaaaaccctttctctctctctctttcagcctctctctccctctctcttcttctccttccttgcaccaccgtcctactcaccgtcgcatcatccactgatccggccggcgatatcacctccatccatccatcacattacggtcggcgtcggcggcggcgacgacgaaggcgggtgagatctcaccggaaaagtgcaggcgggcaggatgcaaggaggagggccactcagccccgacgagcaccgggccacctcgccgccggggataatgcaccaccagccggcgatgacgatcgtcgtcgccgtggaccgtgaccggaacagccagctcgccgtgaagtgggtcgtcgaccacctcctcaccggcgcctccaacatcatcctcctccacatcgccgtccacccccctgccgccaaccgtacgtcgatcgccggatcagccattgccatgcgtctctctgctgcaactgcaagagatcgtaaaactgatgtgcattttttgtttttttttttggtgacgtagatggattcgccatggccgaggcgacgcatggcgcgttggaggccgagatgagggagatctttgtccccttcagaggattctgcaccaggaatggggtaatcaaatatttagtttcagatcaacacaagaaattaattctttcagatcaaagacatgaacaaaaaaaaatacttaattacgagaacgcattttgttttccattgttgatcgatcaggtgcatgtatcggagttggtactggaagaggcagacgtgtcaaaggccttaatagagttcatcaccgtgaacaagatccagagcatcgcgctcggcgcatccaacagaaatgcattcaccaagtaaatcaatcaaagatcaataattagtttcgttttgattttgatccgatttcgatccaattttaaggtgttgttcttggtggtgatggtggtgctgcattgtttgatggtcaggaaattcaagaacgccgacgtgccgtccagcctgatgaagggcgcgccggactactgcaacatctacgtggtggcgaagggcaagtcggtgaacgtgaggctcgccaagtgcggcgtcaatggcggttgcggcggtggcggtggctacgagggcgactcatcgatcaggagcctgtacacgaggaggtgctcgagggggaagctgccgccggcgacgccgtcgccggactcgtcgaggcggtcggtggacagtcgcaccctgccggagctcaccacgcggtcgccgttccgcgagcgctcgctcccgtcctcgtcgtccaagcccgtcgtgctgtccagcagggcggcgcccgactgcggcggcggcggcgtcgacgggtcgtaccgctccacgaggcggtccgtgtcgaacgagtccttcgtgggcgacctcgacttcggccagagctcgcgcttctcctccatggacttctgcgacagcctcgacatgtcgtcgctctccgccagcccacgggagagcagctcgcctctctccgccgtgcgttcttggaccacttcgactgcgacgccattgctgcgacgccattgctgacgtgggtgtgtgtgcagccgcagcgcgaggtggaggtggagatgcggcggctgaggctggagctgaagcagacgatggacatgtacaacgcggcgtgccgggaggcgatcaacgcgaagcagcggaccaaggagctgcagctgctgaagctggaggaggcgcggcggctggaggaggcgcggcacgcggaggaggcggcgctggcgatggcggagatggagaagaccaagtgccgcgcggccatggaggcggccgaggcggcgcagcgactggccgacctggaggcccagcggcgtcgcaacgccgaggtgcgcgcccgccgcgaggccgacgagaaggtccgcgccctgtacgccatctccagccacgacttccgctaccgccgctacaacatcgacgacatcgagctcgccaccgagcgcttctccgacgagctcaagatcggcgagggcggctacggccccgtctaccgcgcctccctcgaccacaccccggtggccatcaaggtgctccgccccgacgcgcagcagggccggaagcagttccaccaggaggtggaggtgctcaactgcatccgccacccaaacatggtgcctctcctcggcgcctgcccggactacggttgcctcgtctacgagtacatggacaacggcagcctcgaggaccgcctgttccgccgcggggggcagcgcccgcccgattccccgtgtgagacccagcgggttcaaggatatcttgggcgggagaattgcccaacccgggcttgcttggttccttccaccagaaaccaagccggagccgctggtgcaccgcgacctgagcccggccacaattcttgttcgaaccgaactacttcagcaagatcaagcgacgtcgggctggcgcgcctcgtgccgccggcggtggcggacagcgtgacgcagtaccggctgacggcgacggcggggaccttctgctacatcgacccggagtaccagcagacggggaagctgggcgtcaagtccgacatctactccctcggcgtgctgctgctgcaggtgctcaccgcgcggccgcccatgggcctcacccaccacgtcgagaaggccatcgacgccggcaccttcgcccagatgctcgacgtcaccgtcaaggactggcccgtcgacgacgccatcggcttcgccaagctcgccctcaagtgcaccgaaatgcgccggagggaccgcccggacctcgccaccgtcatcctgccggagctcaaccgcctcaggaacctcggacacgcctacgaggcgcgcatgagcgccgccgccgccgacgccgccgcgcacgcccaggacaacgtcggctcgccgacggtggtgggcgcgtcgtggagaacggcggagagctaagctagcgggaggccgtgtcagttattttagagtcacaggagagggtggagttcacacggtacatttacggtctttttttgtcggtgtaaatccttaaataccttggtgtttgtacagttgacaaaaaaaattaacatgttctgcggtggttggctcaaaattttgaggtgtccgaatgattcttttttcctggttatacagcagaaagattaaaaaaaaattacggtaatgacatacacagagaggtacaaccttatattttgaaccatcgagactttatttggtaattgggattgggaaataatatcccaccatcaaaagggcaatatcaactactaaaaaagatctattaaatttttggattgatagaaatatagtcgtaattcagcatattttaatctagaaattaatataacacaataagggcccatttgaatcacaggaatgaaaataacaaagaataggaaaaacacatgatttgaagtgtaaaatagaggattgcaaaacacaggaataaccgtttgattggattataaaaaaaacacaggaaatggatgagagagatagactcagaaatttttccaagagctttgagctcttgctaatttttctccaaaatctctatagtattgtccattccataagaatttcaaaggattggatatgattcaatccattgattcaaagccatctgtatgaatttttcctataggattgaaatcctccaaaattcttatgtttttcctccaaatcaaaggggccctaaaca

SEQ ID NO: 24009 - DNA, 3610 bp, Oryza sativa
cccgacgaggtaggaattgcatcggaattagattataaaagtaaaatgatcaacgcgatagccgaattggtcatggcttggaggtttaatacggagcagccccaaatgagtatgaatctgcaaactcatttttgcttgtcaccgtgtacagtagcatgcatgcatgtcttgttttgttggtttgtcaccgtatacaatagcatgcacaagacaatcagcatccgcgacatgggagggctctgcggcgtagtgccctggcggctgcctcaactccctttggcgtgctccggtgaggcaaaatgacaaaaaccttctccggcaagcagcggatgatgacgagcatcgcttggcagcgttgcgtcgtctacggactcaggcggctcgacgacgtccccgcaactccgacgagatggcttgcgacgtagctggagctggagacgccttgcgggcaccgagtagtggcgctccggtcggcgttctcctcgagcaaccagccgatgagttcgaagaagatggtaacgtcgacgagagcgagcggacgtcagtgatgtcgcgaagaggaggcttgcgaccggcaaggcgacaacgtccagcgtctcggcgacatcacatcgccaggtaaaggcgtcgtgggatagaggttgcggccggcgaggcaaggacgtcgcggcagcaggtagttgtgtcaccggcgactgacgtctccgatgacgcgatctccggccggcggtgcgtccgacaggcggagaggacgctatatccagcgggccgggcagcaccagaaactcgcctcgtcgccgtgttgtgcatgcatgacgatctgagcagaaagagcaggaaaaataaaagaaagctaataagctgtacccatggcaatggctgggtacgtgctccggcgaccgtctcctcctccgcgcgcctcctcgccggacgccgaggcactgcggccaacgtgttctcgctggacgccgagattctccggccaaaaatggtgtgtgtctctctctctctcactttcgtatgcgtgtgtgttctgtctgtgtgtgttcctccgtctctgtgtctgtcctgtctccctgtaaaatgaaatggacaatcttttataggggtgataagtcggttcacaggctagctcatacatggattagtatctgcacagccagccagccgcttccatctataagccaaatttccatttagcaaatatcatgattatgataattccgttgtattgtgatatgattattgaagcttctctatggtgatacggagagtagtatttccatgtgaaatctcaggtgcttgctgctattatctgtttcgtttccaatctgacgtgatatggatcaattttccttgtatacgtatacgctcacgccctgctcatggaaagaaactttcatataaagctatcttgcccttttgatttcctaggtttccatgcaagcatgtactgtacgtggtttccatgcatatgacgtgagagattaacggccggcaaatcatatgattaacttcctctaatgacagtgctacagtggcacatgcttccattcccatgaaaacattcacacctttttccttccaccagccaaccatgaaattggatcgatcaccctatatcaaaatgtcgtgagtacgtatatactagagcagccgacggcaagtgtctcacattattcatacgtatacgccatgtacgccaggttgtgctattagtggtaattaatcaccaatttcgttattatatcgccattcccgaaattaatactttgacacacttcatttctttcatatataaaaaaaatgtacaaaatatcgtcgaacacatatacccagaaaacgctcgacatgatgatgatgtattattgttgttgcctccgttgatgacgttctctgtttctgcgttgccaatgctgtctcctcctccactgcctgtgattgggttggacgatatgttgatgcagaggaagaagaccgcggtgtagaggatgcagtgccgagaggagtcgcgcaaagaaccgctctccaaaatcttgatcgcctacttacccatgcagcttcttagatggatggaggaacaaaagggtgggatgtgtaccgtgagaggagaggaatacgagaaggacgaataaagaaaagagttcttatctctgtatatcccggtgatggaaggttaacagagagacgtttcggcagtaattgagacgcttaattgctccatacattagagccgtaatgactgtccatcagttattttttcaggagtacttgagacgcttaattgctccatatgttacagtcgtaatggctccccatcagttatatcatctttactcacaataatgcaatgctcggaaggggaggagagcagccagcccaacccccgccccgccacggccagcttggctcggcgcgcgcaggcatggcagtcccatgaccacctcaaacgctcagcatgtgctctcaattagtaagctatttaaatcaaggtcccccatgttggttttcaaaatggtattaatctcttaacattaattatggctcatgaaatttcctaggattaaattgagcctagcccatttaattctagcaacttcttatggagcataagggcagtcccaacccataacactagacactactaaaaaaaggtctttgcacacgggcaggagagattttcgcatgcggttggcgcaaccacatgcgggaaattgtctgtgaaaatcgccaactttgcatgtggccacggcacccgcattttcgcatgcgggcgcttaagccgaccgcatgcaaagagaaaaaatcgccaaaaaaaaataaaattccaaaaaaaaaacctagcccgcaggcggcgatgccgccgcccgagctcgcctgccgctcccgtgccacctgcccccgctcccaccgccgatcgccccggtcccgccgcagcctgctcccgctcccgctcccaccgccggccacccccgctcttgccggatccgagcgggacaaggcccgccaccgccggatctggacgggatgaggcccgccgccgccggatccgggagggacgaggcccgcgtcaccgccccgtcgctgcccaatcgtcgttgtcgtcgggatcgtcgttggggtcgtcgtcacgccgctctcggccgccttcgcccaccggatccgggcacccactcgtcgtcggggtcgtcgtcgtcgtcgcgccgctctctgctgcctccgcccgccagatccgggcgcccagtcgtcgtcgccgcccagtcgtcgtcggggttgtccgcatcgaggtcgtcgtcgtcgtcgcacagctatcggccgcctccacgcgccacgcgccacgccgctcccacccgacgccaccgcgcgccttccaccgccgctcaccgtgcgccacgccgctctcggccgccggcgccaccgctcaccatacgcctctgtaacgcccgttccgtcgtggcgcctagcggaaaaattatctcctaaaaaccctaattgcgaaatttgtttcttcgcttgtcgtctagtgtccgtgccatctcaagatctcaaatccccgatctatcgtcgagttcaattccgaatccaaatccttcccaaatcaattcctccg

SEQ ID NO: 24010 - DNA, 2391 bp, Oryza sativa
gttgcgacccgcgcgcgcgtgccgtggtggccgaccgcccggtcgccgccgccgtcagcccctgcacgggcctgtcgcccgtgtcgtcgcgccgctccaaaccgccccgccgtcatcgccgtcgtcatcgcctcggccccgccactcccgcgcaagccgccaagggacagaggcagagcctccctcctccctctgccgcgacgcccccgctccctcctccttttcccgaagaggcaaggggacaagcccctttctccccctcctttttcccctttttcctcccgccggcgtcatcctccctccctcctgtcgccgttttggccgctagccggagcgccagctcgcgccttgaccgccaaagtcggtttcgaaaccgacattgccgccccctataaacccgagctcccccccccctttttctttcttctcccattcgcctccgcgctattgccgccgcctcccgtgctctgttcgccgtcgccgttcgtcgttgcgcgtgtcggaggagccggcacgagcaaggacacggaaggggactccgggcgcgccctcttcttcctcttcctcagcccgaggccggagagatcactcccgcgccgtcggcctctcgtcacagcgcccctcctcatctcggtagtgcctctctccgtttttcctcctcgctccatctcccccccttagttttcggtggtagcacgagtagcctccccgtagctagccggcgccgccccgaccgttgccgtcgctcgccgtgtgctcgccgccgtcgccgctcgagctccgtagcacccgctcgtcgccagcctcgctcggcgtagctccgcccaatccaacgctagcatcggattcccgtggccgcgtagatgctctcaccgccgggaatcgacccctcgtgacctcgtcgccgtttccctcttccctccccgccggttgccgccgccgcgattcgccgccgtcaagcttcctacggcgaatccgagccgttggctcgtctcccctcgtctcgtgcaaccacccggtgtgctcgctttcgcctgtatcgccgtggttcgctccgccgctcgccgctgttgtccaccgtctgttccggccggcgtcgtcgtctacctcccgccagcccacgtggcagccacgtaggcgccacgtcggcgccagctcagccgaggtcgggacgggccgaccgcggtcagcccctccccgtgcgcgcgttccaccgcgagccgtgaggctgcgcgtgggcccgccgcaccgcttccaccgctaatcgcacgcgtgcaccatgtcccttccccgcccgcgcgcgtacgccgcgtgctccctccgcacggtgagccgagccgctgacaagcgggtcccacccgggaccgcgcacggtgagcccggtccaccggccctctctctcctcccctcccgcgcgcgcgcacttgggccgccttgggccggccggcccatttagctcggtcggtccgctccttttcccttgggccacgccctagccgcccgaggaaaagtctataatccctccctctttccttttcttttctttttcttttccaaaaagaatttaattaaatcctttttcctttagaccaaaaatccaaaaatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttgttgcatttgatccttcctttgataattgttatatcgtgtccccttgtaaccatctagttgcgtctcgatattcgtgcaccctgtgcgagtatcgacgggcgccttcaaacttaaaatctgaaaaacttcttgggtaaaacttgggttttacaaaagacttggaaaacccgacacctgggtcggtgcttgcgaactaaatgaatttccaaaaccgcggaccggggaacgtaccgggtatacggtttcccgctcttgcacctaaggaccgtttccttggaatttcatccaaacataagacaagtacgaccacatgggtggaatgggacacccctagctgagtaactagcttatcaggggagccttgatgccgagagacatgtggattcgccggggtggtgtcggggaggacccctgggcttcctggccagtaaggt

SEQ ID NO: 24011 - DNA, 921 bp, Oryza sativa
  unsure (1)..(921): unsure at all n locations
nnnnnnnnnnnnnnnnnnnnnnnnnnnnnnnnnnnnnnnnnnnnnnnnnnnnnnnnnnnttaccatatcctcaagaaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtgagaaaatcgagtgagagataagaaaaaaatctttcgagtgagatatagcaaaatcgaaaaaaaatggctgcatttagtttactgccaaattttggtaactatataagaaatcctgccaaaatttttggcaagttgccaaaatttcggcaactatgccaaaattttggcaatgccaaaaattggtaaggttttttttggcatcaaagtgaacaggccctaaaacaaacatgtgggcctcacaaacatttttactatttttttaactaacaccaattgacatgcagggtgctattgattttttgtcgtttactttttccttgtagtgccatgtaaacatcatatgggactaatatcaactaaacgagccacataggttaggactatacttgtatctttatatctctatttggtctattatgccactttgttccatgcattttatacttccaagacctcgccgatcaaaagtacatggactcatccatggcctatatgatttcggctaaccatctaattagatatatagggctagatgtccctggtctttgtagggccctgccccaaatggagacatttccatcgttagcaaccacacaagtattgagaggattatatatgagtaaaaaaaatatataggtgataaaatgatcgtgcatgcacacttcactacctcaaaaaaacttagtaaaacctatggatgggtgatcgg

SEQ ID NO: 24012 - DNA, 680 bp, Oryza sativa
gaggatccccttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgttagtctactcacagctttaaacttagggttatgagattgctgaatgtaatgttcaaaagcaggggactccccaaagtt

SEQ ID NO: 24013 - DNA, 1436 bp, Oryza sativa
tagtttgaaaagcgtgccacgagtatccaaaatttaatccaattttagttggagaaaataacagggccatagtctccaagtggaaaagaagataattttgagttgtgcccacacatggcatatggtgtggtgctcgctttcatttatcactttcctcgattagtagtgcccatcttatgggaaagcggaagtacgtacctacatagccgatcctgtgggagaaaataactttttgtcgtgtttttctcgactggtttctgcttttattcgaacgagtagtcaagtaggagtatatatagcatccttgtattgttacacgctacacgggtgacacagagaaatagttttttttagccggcccggcctaagaaagacggaccaaatttacttaataaaaggagtatttccacatatacaagtttcagtatcgaagtgaaaggatgttgccaccgcagcaacttcctaaaagaaaaaacaagttacagaaggttgttactctcctaaaacattgaaaaccccagcttctttccagattaccgcttcatctttaattgcgccaaacaggaaccccgttgttcggctctgattctggaatactcgcgcgttttgcagcaaatagttacacacaacacagattacattaagcattctattgcaaaaagaaaaaaaagtaccgtatgtaaccaaattgagaaatgttatgggccttcagcaataggagaattatcacgagtcattagtttatttgatttcatttacctgatacattctgcaattccatagcaaagatacagtatacatgatgcaaatgaggaaattatatacccccagaaaactgctccatgacttgtggtaactaaaagaaggtcgttcttggcaggtatttcggtgtgcgctattctgctgcttagctgcatttttgcacaaatgatcgaatgccagaaaagaaagctgatgaaagaaaaaaggaaaggttctttcaacaaaatggggatctgctgctgtatgagcaaatccggtcaaagcaagttgatactgtgagaatattcacaaaagaagaactagagaatgcaacagacaattttgactcaagcagagaactaggggcctgtttagttggtgaaatgaaaatttttggatatcacatcggacgtttgaccggatgtcggaaggggtttttggacacaaatgaaaaaactaatttcataactcgcctggaaaccgcgagacgaatcttttgaacctaattaattcgtcattaacacgtgtgggttaccgtagcacttatggctaatcatggcctaattaggctcaaaagattcgtctcgcgatttacatacaaactgtgcaattggtttttctttttatctatatttaatgttccatatatgtgtctaaagattcgatgtgatgtttttgataaaagtttttgggaa

SEQ ID NO: 24014 - DNA, 6177 bp, Oryza sativa
catgtctgcttattgactatgggcacttaattaaacgcacatgagctagctacacgacgagacatgatctgtttagttggtcgtgctgaaattaaacatcacctgaacctagcctgacagtgcttggattccgtccatgatttatgcagaagtttttcccttgaccgttgctgcagccaaagattcgtgctacgttcattcttggctcgagtagagttcattactactagtacgacattaccaacagcacacggacttaatttgtcccaggatggcgccggtggttttgagtacgtgagatcagttcttttcttcctttgtttttttttctagtttttgggtgtcaatgcatccactataactgtgtttgagaggagacaatagaagattgagaagatacgtaaaataagactagtctttaacacatgatcaattgagtattaattatttttaacttaaaaatatattaatataattttttaaacaacttttctgtagaatatttttgtgaaaaatgtaccgtttagcagtttaagaagcgtgtgcgcagatttctttttcacaataaatctttttctatctttgaacgcagccaacatctccaaagcgcttttccaaagttgtagggtagagacaagaggaagctacggctatatgtgcgtcttttgtggccgtattcatgtgacctttttttcctcctccccggcccaagtaggaacggaatacatggccttcttttcctcgtcgatggccaccgccaacgtgaggggcacgtgacacacggccgttgttgcctagatgcccatgatttgatatgattttgtgtgtgcctgccatactgcaatgctatagcatatgatgcgtggcactgaaagctacgaaaagcacgagcggtatacgagcaagtttaatagtatagcctattatcagctccaattcatttatagccaatccaataaacaattcatataatagttgcttactatactattaatatatgctcccacctgttatacacatatcgtgtcttggagtccgcgctgcagctggctacatatctgtaacccgcttctcttctctctcatattttatcttattaaaatatgtttatagctggctaatagtacctgctctacgtgttcttcgataggagaaaaaaaaaagagaggaaaagatgtaaaaaggctatgaatatgattacgatggcagcccgaattgtggctccagattttaaaacggaagattttcttgactttaaaatcgatttggaaaaaggaaaagagaagatgcgtgtgaccatctccatttgggcccctttaaagtttaccccaaacagggcagagatttgatcgtttttatattgggccgagaattagctttgcaaaggaagagcctaatttgctcggatgcctcgatgctagagaaagttttagacccatcaaaagtatagtggggctccaacatcacatgtcacactggctggcccagggtggatctgtgcttagaacatctgggccttcggacctatgcattggtttattaacccttataaattttcattttttttacttaaaagcaatgtgacaaaattgaagaggaataagttcattttagatcccttgggtacgagttcgattgttgtacttgaaccgcaataatagatagaatggatccctcaactatcaaagccggtgcaatattagttccatggcaatatagcgggtggttttgtatattgtggcaatttgacccgagtcaacagtgttgaatcagcatgggccccacatgtaagggcctcttcactcttcaccactctctcttcacttggacagggagggcgtccatgtcggtaaggagggcgataaaggggggggggcgggggcaaaccagaaccgacgtcgatgtgcgaactgtgaggttgagccgcttggcctcacatgcaagcaacacatccctcttctctcttctccctcttcgcctcgaagccgacgcggtggttatttgcctcgacgctgccgatgcggcagtgatgtgtgtacgcgctcgcttgagcgcggcggcgagcgcgttggagagcggcgcccgtggtaatgctggtgctccgtgcatgtcaggaggcgatcgagggccacgatgaagcagaggttgagcatgcggcactagagcgggtgcggctactcaagccctgccactcaggcgtccctgaggagcgacggctagttggatagcagcacggtcaccgcgtgcagcggcacaacgtgcggcgtgctcgatggcggtggtggaggaggctagtgagcagcttgatggaagggcgaggaagaggaatgccaccgccacctcaaagctccttgccaactcagacaactctcctgcgaagcgcgattccaacaccttgccctcctcctcccctttgcctccacctttgtatcgcacggccatggcggtgatgacaacaacagcaaggacacacattgctcctcccctctcccagctcagggttcacggtgcgccgaggcacctcatgcacggactagaagcaagcagataggcacgctgcctgcgggcttatcggtggcggcaagtgcagcgcgcgaagaggccaggccggtgaccaggggcagagctatagtatgtaggagggggggtgcccaagggccgatcaataaaagtttttagctatacgtcacctatttttatcatgtgtgcactcccgtaatacaaacataggcattggcattggcttaaactggatctaaagtagagtaaattaagtaagtggcaccgctctctatttcgttctatctccgcccttgccggtgacgctccgattcagccttcgttgtgcttcccttctccttcgtgagctccgcctagcctcctcctcttcagctactccctcgttgacgttggagcctccttctcgccggtcgcccacagcagccaccgccggccaccaccagagtcatgcgcagccaagggagagggaggggttgttctcgagggagacggtgacgacactcgagcttgaaatccgctgctagccgcatctggaaaggaagtgccaccggccacatctggggaaggtgaatgggaggagatagagaagagtgaggattcatcttggagccaattatgcttagcaagctactcctcgcaacatatctttagacattacatggaagacttatttccgcgtacacacaattgattttctgattggattgcgttaacatccatgatgcactccttaacatacgcttttaaaaaagatcagtgatactactggagaaatatctttgatgggtcacgtaaaaatcacattagtcccggtttgagtaaaaaccgggagtaaaaatatttttagtcccggtttaaaaacccgcagatactttattgatctttagtcccggtactaaatataatttttagtcctggttcaaaaatatgtcagacccttattatgggactaaagattcatttttagtcccggttatttataccaaccaggaaaaaaaataaaaaaaatcgcgaaaatcccttcaccgacgcgcgcgctgcctcgtgctccccgcgcctcgtccttatcacggcctcctcctctcctcctccactctcttgttctctcctccccttcccctctcctctccctcccccctcctggcctcctccgatgacggcgatggagacagcgggtggcggcccgacagaagctgccgacgaggctgcgggcggcggcctcccctgcggcggttgggaggggaggcagcgcacggtcaggcggccttccctccgccagatccggcgggaggggaggccgggcggcggtggcgacttgcgatttttttttaatttttggaatgagttgtaaattttattatacattgttttagatttgggggatgattttgtggatgattctatgaatgactttgtggattggcatgtgaattgtggatgatttgttgcgcatgatttgtagatttgttgtgcatgatttgtggatgctttgtggggatttgagggtgacgataaatgcaagcaaaaaaaaaacaaagaaagaaaagaaaaaaaaaagcctaaccggactaaagttagtcctggttggtaccaaccgggactaaagatccatctttactctcggttattttaattgggtatctttagtcccggaatagttgtcccggttcgtaattaacctagggctaaatggggctatgaaccgggacttaaaaaaactgttctccagtagtcgactatctaaaatacttaagggatggagtcatgtatcactgaccccagcaccatactttttgtgcttcctctacctgtgacattattttaatcaagttatacgtgcaactcgccgcaagtctgcagaaagttccaaaaattacagatttgtataacatgtcctcttgtcatcggagctttttatttttcatctgagggttttatgttacatatgtaaacttaactgtaccagttaataaattcatttcatccccttagcataaaaaactgtatattgtgacctgaatgaactatataacttataaaatttggtcaattctatactaatcaatactgtggatgccatatatgataaaaatctctcaatatatatatatatatgataaaaagatcggggtgccacgaaaatgattcagtccgtgcgccggatcaaacgaaaaaaaaaaaatcggacactggcttcgctctttcctaaccagtatattatcagtgagtcagcttctctctcactatttttctccttttctcattcacggtgcatgtggcaaatgcatgtcatgtcatgtcttgctggctcatttgcaacttttctctcttcttcaaatgttttttttcttccaaagtaattatccgttctatgacccgtttacaccatcgtactatttacaatttctttgtaacaagatatcacatgattacattctgataaaaaaaattgaacgttgtttcaccccttaaaaaaaattgtttttgttcactatataaaatatttcacataaatacaacattagaaaatatcaactgcaacacctaaccacctatatgaaacattgagtctcaaagagtgaacaagaaaagtcatatgagagatataatatattttaaaaacttgatattgttgaaatatttttatatcacatatgaatatcaaattgtaactattgaaatattataaaatacttgctgaaacattccaagaaaaccatgtacaacattacattccaagaaaaccatgtacaacatttataaattaactagtaaaacatcatgtgtactagctgaaacattaaatagaacatgtgcaacatttgaaataaatctatttaaaaagctaaatattcttttcatcaaaatataaccatgtgtggtcttttttaaaaagatttaattgcaacgaattaaatggtgtaattgcatcataaattggagaaacaatttaagagaaatttaaaaattacttaaaaagacttatacataccatactaatattgtactagacgcatgcatatgcatgtagacttagctatgtggctaactagttgcttcacgtttctgtgtctgctgcgcctgtcacaccctgaaaattcaaaatatataaattgttgtttaattggaatttttagaaataattttaaaagtcttgaaaagaaaatctaattttaattaataaattccaatataaaatggggccagataaaatttcattaaatactttgcttaattctataattcctagatttttctgggatttatttgagctaaggaagtatttttaataaatggaattgcatttaaggaataattttaattgaaaaaggttttaaaaagtctcttttggctttgggccgaaagtcggcccaaaacctcttttctctctcttaggcccaagccggcccagtccgccgcgcgagagccctcgctgtcgttgacaggtgggtcccgcctgtcggagtcgtcgtcctcctcgggccgaaaccctagtttcgcgccgccgagctgccgtcgccgccgctttccaaatccggccgttcctttccttctccggccgatttgttagaggggaaacaatctccgggatctcctctaccttttctcctttggaatctttggctcaatcggtttggaatgagtttgattcgagtt

SEQ ID NO: 24015 - DNA, 519 bp, Oryza sativa
  unsure (1)..(519): unsure at all n locations
nnnnnnnnnnnnnnnnnnnnnnnnnnnnnnnnnnnnnnnnnnnnnnnnnnnnnnnnnntatgcatatcatcaaatcaaaccccaaatccacatcacaactccacagcacgattcacagattcaccacaaattcattcacaatatccattcacatattcattcacaacatcacaaatatattcacaatattgattcaaaggttcattgacaacatcgagtcacatactcattcacaacatcacagattcattcacaatatcgattcatagattcattcacagatcaaaacatccaaaccacaaattaaaaaaaatcaaaaaaaaatcgactcaccggccggcctcccatcccgccgccggccggccacccatctcgccgcttcccctccggccggatctgggggaggggagggcgaggccgccggcgaccggcctccattccgccggcccgcgccgggccgccgccggccgtcctccatcccgccgcttcccctctggccggatctggaggaggggaggg

SEQ ID NO: 24016 - DNA, 718 bp, Oryza sativa
cggaggcggtggagacgcacccgagtcctaagttggatgatatgatgtgaggttaagtcgttctgattatgtactctaggacgaaagagaagcttaccgccgggtccgtcgccttccggtgggtcccgagcacacaggagaactctcttcccctcttcggaacattgctgccactcgtggtggcagcagcagcgtctaatgcttccttggcggcgccctccttcagcgacgtcacagcctggtgatccacgagtggtccgatgacgtccgtcagagggagagcctgcacaacatgaagtcacgacgcgatctcgagaagaaagatgaaaaggaatcatcgagtacactcacgttaatcgcggcagcgcgttcggctgagcccttgtcgcagagtgggacagggatgttacccacctccgagggtccactgatcattatctggatgacgcggcgctgcacagtgtcactgtccagacctgtaaatcgagaatgagaactcgataagtcaggagaaacagatgcacttaaaacaaaattggaaatgcgaggataaataccccgagaagagacccgggtcacgtcatttggccctgagtaatcgaatgcccgatgggtgcaaggcctgtaacggctaaatccaccgacctatgaagtcggtagcgacttcatatcccggcaacccccgttctcggaggtcatcgatgatgtcgataaagga

SEQ ID NO: 24017 - DNA, 631 bp, Oryza sativa
ccaatcaactgccagcgggtccgccagcttgagaaggattgatcagccgcgcgcgcgcgttgacgttgtgagttttaggcccataaggcccatgcataacctgcggtggcgcgtatacgtgaggcggacggcgcccacgtcctgtattttttttccggaaaagctaacatatgtgtttttttcgtttctttttgccatgtttttcgtgattttttttattttagaagttgaacctttcatgttgaaattttgaatttgagttgaaattttgaattttgagatgaaaattttcaaatttgagttaaatgttttgaatttttagatgaaagttttcaaatccaagttgaaagttttcaaatcttgacttgaaaattttcaaaactagatatggaagtttcaaaatgtaagttgatttttttaaaaaaataaattgaaagtattcacttgaaaattttcaaatctaagttaaaagttttttaaaaaatcttgacttgaaagttttcaagtctaagtcgatagtttttaaatctaagttgaaagttttcaaatttgagttgaaagtttttaaatctggattgaatgttttcaaagctgggttaaaagtttcaaatccaagttgaaagttttctaa

SEQ ID NO: 24018 - DNA, 11557 bp, Oryza sativa
  unsure (1)..(11557): unsure at all n locations
nnnnnnnnnnnnnnnnnnnnnnnnnnnnnnnnnnnnnnnncagggagcaagatcatgaagggagagagaggtgcaaggctaagggtgatgaggtccatcaggaacagcggcggcgacggtagccgctcgcgtgtactgagcctcggcgacgacggcggcgatggcggcagcggcggcggcggcggtggcggcacgaggaagaagctccagctcaccaaggagcagtcgaccttgctcgaggacagcttccgcgtccacaacattctttctcatgtacgtttacgtgcacatcatatcgagtaatctgttactaattctttgggattttaacacaactgtcgatcgattcatgcatatgatccatgtagttagtaagaaattaactgatgatttcttggtcaactgagatcaagagatcgagccgtatgagtttctgcttcttctagggctacctgatgaacgtatctcatggttgtttcatatatgacaggctcagaagcacgagctcgctcgtcagctgaaactgaagccgagacaggtcgaagtgtggttccaaaatagaagagccaggttcgtagaattaaattaattacattcagtttggagattacaaaattctgcaattagtgttatgattaacatctgtgaaaaattaaatcaaaacgcaggacgaagctgaagcagactgaggtggactgcgagttcttgaagcgatgctgcgagagcctgaccgaggagaacaagcagctcaagcatgagctcatggagctgcgtcggctggcttcgccggcggcggcggcggccggctcgcagctctacgtccagttcccgagggcggcggcggcggcgatggtgaacgtctgcccgtcctgcgagaaggtcaccgtgatgggcggcggcggcggcgagacgggaaagagctcctccagctatagctcttaataatataaattaatttaactattagtttgtactcggagtttgaacaaacacctgatgaatatggaggtgtgatgatcgatcgacttcgtgtagatgatcaactagctaggtgtgccaatatatatataactcttagtaattgatttgacgcccttatgtaaggttttgcatgcggtgttgcagcatgcaacctagctaggcttttttatggacttgttgctgtgaaactcaacaagaaagcctcttgagaacaaactgcctgatcaccagcaccctcttgtgggccggactggacatgcaactgcctactggtactgattgggctgcacacattaaccatgcacacttattattttcatattcctgaatcctgagctgatttaagcttttactcatactcatcagtgattgacgtgtgacgatttttttttgaacaaatctggttttcttcataccaatcaatatatgttatagtacggaatatatatgatctcagatattgagagagagtataaggccatgcaagttatcttggagagaagagagaggggggggggggggttgttgaaattatcatgcagtatatgtttgatcctgtgtcatttgtaaggttgatgtttgaaatgttaccatttttttttggcaagattgactagttttaacatcggtgccgttttttggttccaaccaaataggtgacaaaattttggcattgccagatcttaccattgccaaaaaaaattggatataaccaaacaagcccttacatcctattaattgggaaaataatcctatgagaactacttggtgcagaggtcagatgttttcattgtttagtgaaccttctattatcgtaaacaatcgcagagaactggtctcatgctcatgagtgatcaaaagttcaaaacacagagcaaagtttaagtgttaaccaactttgttatgattgaaacagagtaaaatgctaggatctcatttatcttcatttctcttcaatatatatgaacaaacaaatagtgctccttgccgctgccgaggaaactatgaaacaaaagacaaaatacaagtatcttcccagatttttagtatatctgtaactataactataacaaaagacaaaatacaagtatcttcccacaacatttcctatcatcaattcttttcagagtttttttttacaactgtcataagcatttcagaagggaggacacgtagcaagactatccgagcagtgattggatccatatagaagtgcatgggttagctgacccagtggcggagccagaaaatttccacgtctaaggctgagctaacgagatctcaaatattttcataagttacataacatttttcatgattataatgggaattatggagctaggcatggggctcaagccctaactgccccatgcctgattccgcccctgagctgaccccatagctttttcaaaccatttatatcaactttaatttatatgggtttaaagttatcatcactcaagtatcaaatgaaactgatcggtaaaattcttgcctccgccacaataggtggaatacaaatccgtgcaccaattgtacccgggagtaataatgaactaccctcctatatttttatatgaaattttcttttgaagataactaaagttataggaaaaataaaaacttagactccttatcaagcctattgtacaagacagccagtgtaaacaagatatcagcaggagagaatcttcaacccgatcaactagtaatacgacaatatgtatgacaacatcacgtacgtgcaaagcagcaaaggggagagcgacagatggtgcttttcaccacagccaaattagctacaggacttagcttttctcgtcgaccgttcgttttcctactcacatttcagccacagtgatgtagactcgcttgttcctttcgaaatcacttttatccctactaatttagtattaagggtgtgtttagttcacgctaaaattagaaacttgtttgaaattgtagcaatgtgataaaaaaagttaaaagtttaaagaaaaattttgcaactaaacacggcctaaaacaataaactaaatgtattgttgctgtaaattttggtaattctatataaattaccactcttaaaaacttaatttagcgaatttggtaacaccgtcaacaaacacacatcctacgctatctagtaatgccgaaatagcaatattaatgaaaacaataaaaatgtgaatctgacatattttgttattgagtactccccttaaaaaaaataaatttaaaattggacatgacacatcccgagggagtaggtaaagaacaaattgagcacgcgtgcagctcgtacatcggtacatgttgattagagcttgaaaaggcacgccgtgatgaacatctgagcagatactaaattgtgtggtagaatcatgacttgggatgcaaagtccagttgctacaggacaagcctaacttaacaacaggataatcaccgagctgatcaacatgagggaccagcctaattaatagtacaatccggtctagtcttcttgtcctaagcatgggtcaaataaaaattagttttcctaatgaccaataggaaatattacgtaggaaattggcgagaaactttcggctgattattggcaggatgagaagtagacatggcggaagcaaatccagaattttggacggctcttgactctttgtcaacacgagatttccgggaactttcacacaaaagcctgtaaacgcttcagagagtcgcactctcaccatctgtttattggcttatcagttttatcttcaaattaaattttagagttttttattatcgtttttgcttttaacattgtatttgaaaccacaaattatacagatatactttcgccgtgtttagtttcaaaatatttcttcaaacttccaactttttcattacatcaaaacttttctacacacataaacttccaacttttctgtcacatcgttccaatttcaaccaaactttcaattttagcgtgaactaaacatagcctttgtattttaacattgtaaaagttttactatgtagaattcttttattcgtccatgtggataagccgaagccaaacgatcagagcctgcctatgcctatccactcgaaaaagcctttttctgttgagcaattctacggtacctgggaaagtaccttgagtaccaaaaatttagtgtaaaatttggtatctcataatacctatctaggttattatgtacagtagaaaaaatggtatatcatggtacctccttaaggacagtaaaattactataatctattgttggtaccaccaactccaaaaattcctgcaggataataccaaatcacactgtactactacggctgaaacaagccgatcgactgcaaacaaaaaagctggagaaaggaagcagctgcgaaacagaatgcaacgcgtgtgtctgttgtgtccttgagtttctgcgcaaatgtgcttgtcgtttgcacgtagcagtacgaaggaaaaagtacgaattacccgtcaaactatcgcggtcgtctgaattacccccctaaccataaaaccggacattcttcacctataactatgcaaaccagacgaattacccccctcgacccaatccacggtggttttggtttacgtggcgtacacatggcagtctagttagcgttttttttaattaaaatattgtggacccggatgtcatacacttcttgctctctctctattctctctctcactcttttctctctcgcacggcgaggacgaacgcagggacgggcggtcggcgtgtgcggtcagcgaggtgaggcgagtgcggcggcgcggacgtcggcgcagacggcggagctgtgtggcggcggaggagcggaggtggcggaggagcgtggcggcggagctgtgtggcagcggaggagatgaggcggcagaggcggcggaggagcgtggcgccgaggaagttggcggcgcccttggcctcgcgattgtgggcgagcaccttggcgcgcccttggacgccgccgcgtagttgtactccgcgccgcttggctcgagccggtgggccgccgcgccgtcggggatgcggccgttcgcggccttgccctgcaggatccggctccggaactcgtcgagctcatcgagcgccgcgtccgtggacgatttgctgccggttgtgttgttgaacggctccaggctccggtggtcggtttcttgctacggctccggcgggtgcaacgatggctggcacgtcggcgcggccgcggaggcgttatactcagtcgggaaaatgtaggcctccagcggcattaccttgcagtagttttcacgcattccgtcctcgacatcgtcgtagaaatctacaaagaagagatcaatcaaacgccagggtgacatgacattgatcgatccatgacactgggagcgaaggaggaggaggcaccagacggagaagaccacggagagggacacctcgcggaggccgctgtccatggatagcgcatcggtcaccggcgggtcgcagccgccgtttcctccgccgcctccttctctcctcttcttgctcatgcatgcacttgcgcgtgccttcctccctgctgctgtgccaaagcgctaaccacgccgctgcacgctctcaccacaaaccttgcctttgcctctgccacaactgactccgccgcctccgctcctccgccgccacacagctccgccgccacgctcctccgccatcagcgccgcctccgcctccgcgccgacgtccgcaccgtccgtgccgccgcgctcgcctcgcctcgccgaccgcacacgccgaccgcccgtccccgcgctcgtccccgccgtgcgagagagaaaagattgagagagaatagagagagagtaagaagtgtatgacatgcgggtcccataattttttaattaaaaaacgctgactggactgccacgtagaccaaaaccaccgtggattgggtcgagggggtaattcatccggtttgcatagttacgggtgaagaatgtccggttttgtatttcagggggataattcagacgaccgcaatagttcgaggggtaattcgtactttttcctagtacgaaatgcacacaaaaaaggtggctttcgcttttgagaagtactacctctgtccaaaaaaaggcaaaccatgggtttccgtgtccaattttgactgtccgtcttatatgaaatttttttataattcgtattttcattgttgctagatgataaaacatgattaatattttatgcgtgacttgtctttttaatttttttcataatttttaaataagacggacggtcaaacgctgttcacggaaactagggtttgtctttttttgggacggatggagtaggtcaagtcatcgagattccgtcgtttgatcccttcaggcttcagcttcagcgagatcaaaatacaagccgccctctgcctctccacttatctctttcagctttagcaggatcggtttgccattgtggaaaattggaaatcatacaaacattctcttgtgcagcctcgggtcatgcatgacgtgcatatgcgagtgaccgtaaaggacttgcattcaactgtaaaggaaaaaagaaaaggatattgcttcgcaacataagaagaaagcaccggtggtgatggtggagtcgtgagtggaaccagagatttgctatcagtctcttctttgagtgtgtgttagggaactcactcatcatgggtttgtgagtgtgccaagtagcagagccaccgcccggttagtccgggctcgccggcgaaaactccattaaattttaatattaactagcataatgcccgtgcaacgcccgtgcgttgcacggataacagatgatagtgggtggttgaagtttgatcaaagtcgagtcgtgttgttcttgacaattaatcttctttatatttgcgggatatatatttctaagcagataagccttaaaaaaatgagagaactataggaatatacccgtgcgttgatatgtgaagaaaatgtgtggagttgaaaaatattgctcccttcataaaacatgagctgaaaattgtgaagatatggagaaattaactcatcctctgtgtaacaaaaccaaataggcaaattttgctacaggacatcgtgacttcacggctttaattagctgtgggacactacacagattaactttttgggatgtaaaagttggatatttgctagtgcaggggtggaaaaaaagctcgggctcgtgagctcaactcgggcttggtcgagcttggttggcttggctcagctcgtaagccaaataagccaagcccaagcctcctttgcagctcattgctgaaatgagccaagccgagctagctcgcgagccgcttgctttgacttgcgagcctaggccatcatgtatttatatcgattattttactttttgtggcgttattatttgtcaaattgaaatttatcattaagattttgaagaattgaatatataaacttatttaaattttacatgttaatgatttatttttgattttttaataattacaaaatatatatgaagaggtgtttcaacaggaaggcttgcaagacagctcgagctggctcgagccagaaaacgagccgagtcgagctcaagttttagcttgtttccctgactgagccgagctaagccaagcctagtttgttgcgagccactgcaagccgagacgagctaggcttggttcggcttgtttccacccttatgctagtgacaccatgctcattaaaataataatttccggctattgagaaaagagaaattgtcaaaaattcccctagacccccatgtttgctctcctttatctcctccttatccggttccagctccttgggcagcctcaccgcgtccaccccggccaccttgccgcctaccccggacaccttgccgaacacgtgaacgaaaacagatccgtcaactccgccggccatgccacgtccaattcccactcctctgtgagcttctccatcacctcgtgcgcaccgacgcaggccaccgtgacgcgcctgttgcgcaggaatgtgaggagccgcgccatccttccgccgtcctcatggaaaggaagcacgctgacggtatactcggactggttgcagtcgggctggtacacaaggcatgggagccgctgatgtagatcgcgacgtagcggatcagggtgccgaggtcccgaggatggccgcgcacgcccttctcgcccctatgggcaccagttgttgcgcggcgcatggccacagagcacgatgaggccgaggacgaagggtgcggagtggcggtggccacggtatagcagtgtgatttcccggaaccactgcatgttgtccacgtcacgcttggggtaggtgatgtcgacgagggcgaggtcatcatcatcgtagccgatgcagaggacaacctcccttctggtcactggcaccagatctgtagtcgcacatcgacacacaatgatttcacatcacaagaacacatctcacatcaacaaatgaactctcacatcacaagaacacatctcacagcagcaaatgaactccaagaacgcatctcacaaataacaaagaatcacaaataacaaagagaggagggggagagatagatccgccggtcgccgacgccgttgcctcacctccacaccggccgctgacgcatgccgccgctccactgggcccccatgcctcccctccgccagatctgcaaggggagggaggggaggggttgcgcgccgccggatccgccgcccccctccgccggatctgcaaggggaaggaggggagggggtgcgcgccgccggatccgccgcccctccgcaggatccgcaaggggagagaggggaggggccgccatggtcgcccgctgccacctgctctcgcagcccttcttcccacccgcagttgagggagggggagggaggggccgcgcgccgccgcatgctgtcgcaccgccggccggccgggagagaggggaaaagaggagagtgggaggagaggaggagatgagtggagtgggaaagagggaggtgggaggagaggagcgggcggaggaggagatgtgtgcgggcgcggttaaaagcggtgggcccgtgctattgaaaattcgtgtgcggttggcttaagtcgcccacgcgggataatgtattttcccgtgcgggcgacagcccggcacctgtccccctctttttccatgcggttctacttacggaccgcatggaaacaaaagtgggtggcgtccaagaaaatatatcatgtagcagtgtcgcagattgaaaatagttttgcatatttactcatagtctctagtagtcatgcatgctttctcgatctgtcaactcaaaattatacgtggactcgcgtggagacaggtcatgtgacatgtggatgatagcgcgaatactctaatttggcttatctcgtggaaactttttactttttttcaatcgatatttttttgtctcaaacaaatattttgtatttactgaaactttaagtgattttgatgtcaacaatataagtaataaagaaaaatcatcattagttgtgaagtactcttacgtgtatctaaaaaaactttttttcagcgaaaatcaatatcacaataaagaaaggaactttgaccggtcatagttttttttaatgaaaaaactgaagctcgtacctcattaccgaggaggttgccagctccaagaggtcttctgctcaaagagctctaggctcttctcaatcccagtctctttgtctctctccctcctcactcgttcggtcgttccccattcacatcgcacgtcgtcatccaggcatccagcgcctccaccagcgtgcgccctcacatcctcccatactcagcccttgcgcctcctccctgtagtagcggcgccttcttccgcctaccggctgcagcagcggccagcggcgcctcctctccttgatgcggcaaaagatggagaagcgcgacagcgagaagatgaagaagcgcagtggctgactgggggtgacgacaaggcctcctcatgcaacggttccaagccattgatgctgctcgtgcggatccaccaccgacgcctggatcccgtcgtctcttcgtctccctctcgcgcggatcagccatcggcggcgacaggaggggcggatccggcgacctcttcccctcccgcacggatcccgtcatctctccgccctcctctcgtgcggatccgccatcggcggcgatgggaggggtggatccagcgacctcttcccttcccgcatggatccgtcgtctcttcgcccccacgctcacacgggtccatggatttggaggtgcgtggtgagggggtggaccgtgcgcactgggctgcgtctcctcctccccattgcctcgccaagccggccaatacttgatttttttttgcaattttttccttttttttttggccccggtgatttaatttttgggatggttttgctttattgttgttggatttctgattcagtttctttcgtttccgtgcattagttctgggcttctacgaacgtacgagacaggagcgatgcggtctctcgatctcgcatgtacgatgcggtctctcgatctcgcatgtactgacgaaccaaaattttgggaggagatcgtacacggacaagtggaaaaaattgcacatacggacgaaaaatactaatactaattttggtgacgattggaaaaatactaatcttttaattagttaagataagtaaattgatgatgaaatttttatagtaaatattagttatattaaattttgttcagcctcaaagatcttattggctccgctactaggtgtgcttggtgtgagatccgcttgtggctgtgtgagtatggtccatatgcgtctgtcttttatgtaacagttacggaaatatgctagagttaaaaagaaattattttctctctctgaactcctcactaacttggattttaggttgtagtccctccaaacaccctcttcgactcgggttaagttgcactagctgcaaacaccaaataaagagcaatgcatccaatgaatgaagaccatgggtggcgcgttttccgagcttttaaatagtgtgaattttttaaatgtcctataagtttctaagcattttccgcaataaattttaaatttacaaggaaaaagtacgaattaccctcgaactatcgcagtcgaccgaattacccccctaaactagaaaaccagacattgctcactctgaacttttaatgccggacatattaccccctcgatccaatccagagcggttttgtcctatgtggcatacccgtggcaatgtagtcaggattttcttttttaaaaatagtgggacccacatgtcataccccatttcctctctctctcgggcacaaaataggcatggcggcgcagggacgggaggtggccggcggcgtgaggggacgggcgggggcagacaggtggaggcagtgccgattgcagtggcgacgagaaggaggaggggcccgcggtggcggtggcggtggcggtggcggcccgcggcgccacaaggggctgagcacaacaagggaatgtcacacggcaacatggtggctcgaggaggaggaggaggaggagggctgcagg

SEQ ID NO: 24019 - DNA, 11697 bp, Oryza sativa
tggtggagggggacaacgagggggtggagagcgactagtcgatgatggacttgacggtggcggaggagaaagacgcctcccgctcccccaggcgctccagatgatgaaggcctctagatccacgcgccgacgtcgctcccgaggatcaggggcggcggatcctcgcgccaccgtcgctcctgctgcacctgcgcccacttgagcaccgccccatgcaccgccgcggcaacctcatccatggcagcggcgtcaagaagcgcggcagcaacatgcaacaacgtggtctggcgatggtggcggcgtccatcctcatccatggccctcctcgtcttacgttgccgtcgtccgccgcccgcccctctgcgcagagagaggtgaaggggagaaatgacaggtgggtcccaccaattttttaaaagaaaatgttgactggattgacacgcgtacgctatgtaggaaaaaatcgctctggattgggtctaaggggggataattcgtccgatattaaaagttcagggtgaacaatgtctggtttcagattcaggggggtaattcgatcgaccgcgatagttcagggggtaatttgtactttttccaatttacaataattaatttattgttaactctcgagtattatcacaaaattagataatatatatccgacatccatttatccgaactggtccttaggacaggagcaatagcatcctctatttctcttcagtgaattttggagatatccatacacattactcgcaaagtcacaaggtgagctccattattggacgcattccgtcagcatcaactgcctcatccacggtactctctccagcgcatgaaaagcaaacattgtacacgatgtaacatatgaattttaacaaagttatatctaaattcatataaaataagttacatcttatattgatttatttttcattcggaatgcggaagtatggggtagcatgttgggatcaagatcctctaccgtcgaagtcacgtgacttttatcactgacacgtggatccgacgatgtctggactcacatgttaatgataaaaacaccgtgtatttaaaggtacaggagctcaatctagcatgttgtgtactaatcatgttcacttgactcgatcgatcgctccgatcgactacaccccgccgcgccgcgcgcacgcataaaacccccaccacctgaacctccacctccactccacctccacttccacactcgagtagcgagcgagaggtcgtcgtcgtcgtcgtctcgtcgccgccatggagatggtgctggactggcgctcggtgggctcgctcctcgccaccatcatggtgttccggaccgccatgcgcgacttcctcccgcccgaggccgagatcttcctccgccgcctcctcacccgcctcgccgccgccttccgtccccacgtcggcaccatcctcatcgacgaggccgacggcgccagcggcggcgccaacgacctctacgacgcctcccagctctacctcggcgcccgctgcctcgccaccgcccccaccgtccgcctccacaagccccaccaagctccccgccccgtcgcctccctccccgacgcccacaccacccacgacgtcttccgcggcgtcctcgtcaagtggaccgctcgccccgtcgagcgcggcgcctccgccggcggcggcggcggcggagtgttcaacccttacaacccttatggccgaggtggcggcggcggcgagccgcgcagactcgagctgcagttcccgcgccagcatcgggagctcatccacggccactacatccagcacgtcatcgacgaggccaccaagatgcggctcaggtcgagggagcggcggctctacaccaaccgcgccgccgcccccggcgacgaccaccaccgcctctggacgtcgcacgccttctcccacccttccacgttcgacacgctcgccgtcgacccggcgctgcgcgacgacatccgcgccgacctgctgcgcttcgcggcgcggcgcgagcactacgcgcgcgtcggccgcgcgtggaagcgcgggtacctgctccacggcccgcccggcaccggcaagaccagcctcgtcgccgccatcgccaacctcctcgagttcgacgtctacgacctggagctcaccaccgtgcccaccaactcccacctccgccgcctgctcgtctccaccacgcccaagtcggtcgtcgtcgtcgaggacatcgactgctccctcgacctctccgaccgcaagaacaaggcgagcgacgacgagaacgcggcgcagctctcgatcatctccccggccgctgcggcggccatggcggcgatggggcgggaatccatcagcctctccggcgtgctcaacttcgtcgacggcctctggtcatcctgcgtcggcgagcgcctcatggtgttcaccaccaaccacccggagcggctcgacccggcgctgctccgccccggccgcatggaccgcaagatcgagctcggctactgctcgccgcccgcgctccgcgtgctcgccaagaactacctcggcgtcggcgtcggcgacgaaggatgcgaggacgccgccgacgatccggacacggtgagcggcctcatggccgacgccgagggcctcctcgcagccggggtgctcatcacgcccgccgacatcgccgaggtgttcatgggctgcgacggcgcgggcgccaccgccgcgctgaggaagctcgccgacgagctgcggcggaggagggacgcgccggcggtgcctgtcacagaggaggcggccatgacgacagagtaaaaagcagacgagccgccattgcggattgcttgaacttgaacagcatcatgatcaatatataattaataattttcatggtgatttggtttcgagttaggtattaattaggtcggttgtgatcgtgtcatggttgcgccatggatggaggatttgaggatttgctgcattttgcaatggtgtgtggctttctgaatttttcagcaattttctttgcgttttatgagaagttgcaccatgtcgtctcctctgcttttgttttgatctccggatatacgtcgacgtggacgtttgatggcaacgaacattggccgtccgtactggctggctgctgttgataacgcaaattcacagtagtcattagcacaaggttaaatttctgcaattacttgcgcgcatctcaatttgattttatatgtggctattcatttatatttgattgtttttcatattaaaagttcaaaaggtatttttgtaaaactacaatagaattaggtagagtttttaattctactctgcgtgccgtccgccgcttccctcttcgcacgcgacacgtgtccaatcatccggggaagacgcgcacaactggttgcggattagcattctcgacataaaagaagtaacagcaatgggcaaaataagagtaggttaacaagtcatgtatggagcttttgactaacggtagggttaaactaagctagaggagccgaaaaatcagagcacaggcttaccttatccaatatttcgagatgagtcaggccactaatacactttacgacttccataggtcataggtgactcgaattcttgaaactggctcggcatttggtgatatgatctatctttctacgtgtacataactttaaccttacttcttgtttacaaggacaaagctgtcgttttcggaacaatgcgaaaacaattgacaagaacaacactggctcagatataaccatgtttatgttacacttcaacaagctaaagatgcatagattctatataggtttacttattatacgtttgaacaaatattactgcaccataagttttatatcttctcgtttgaagaaatattagcatgggtgaaggaaatgagagcgggctcacgaagtgcttggatgatcaaataaattggtcggggaccaaactaagattttcctaaagactgctcatacatcaccatatcacttttagtctatagaagagaggaaattatgcacattttggattcggattcaagtctcctaatagcattaatttcaaacggacctagccaatgatctagaaggaatctcggagcccatgattatttattggaaagcttatggaatctactttcatatagttctgatcacacatcaaaattccttctaatctattggtaatctacaaaacaagccatgtacctcatccagtccaagtccgatttgaactttgggctttgtaattgtgtcgtgactcgtgggctaagcccaagggggtgtgcgccctagctataacaaccctaggtcgaccctagaatctatttaatcagttaccgtcatcaaattagggttggattttgcagttttgctgctagtttggtctgtggaacaccaacttatgagctccatcttaaattcgcaatatattcaaattgcatcttctactctcttacttgtgttctcgattcgcttacggaatatagtctttttggcgagatcaaccatgtttcggctcgggtgataactaacagaggggtggtgtagtgattgcacggggttcggtcattctgatcggagcttttgaatcatcaacatcaagtctccacaattaacctatctagtacctaacggaagattcagaaccttagtcctcatcaacaatactccccacggtaaagaaaatatgatatttaacctattttaaggtcagtgagatgccgtcctgaccataatacacacactctctttctcgggtataaataaataattaacatttagaacaagacttgtggtctagttatccttatacttattcatattacttattagtaaaaacattatttatgggtaaaacgttattcttagcggtaaaagacgagtgccataaaataaaccatgataaaaagaacacaaaaataacttaaaatcaagtttaaaaaatttaaattttggtttataagcataagcaaaacaatgggatcatttgtcaaacttttatagcattgatcatcaactttgcattgtaaaaaagaaattataaaattgaatgacttcacgatattacgatagtactgaaaagtgaaaacctacctacatatatgccatttgtttaacaactaagaacttaataaactattgatggtcaaaatttcaaaaaattgataatattttgtgttaaagtaaaatatttatgacctgagagatattttttttaaaaaaagttaaacatgtattggtggatcctacatgaattgcatattattactcagggtgcatatacgaagaaccaccacatgcatcttttctgctttagccaatggcaaagaacttgtagcaatctttgatgtcatgtcatcatcaactggtagaaaatttggaaaaagattaatccacccatccgaccagtaaaagacttgaccgaagcgtgccaaactcaacttttggatttcttgctaaatagtaccttcatattttaatgtatgacgccgttgacttttaagtagtattcaataatacgaaaacaataggaaaatgcatactgaaacagaacgagttgggcttaaagcttatgaagcccataaagtcatttaggcccattcatttttcctttcctagcgttgagctcgtccacgagcttctgcagcgcgacgtgggctccgtcgtcgccgtcgcatcccatgaacacctcggcgacgtccgccggcgtcacctgcacctcatcgagcagcctccccgcctcacccatgatctcgtcgtggtcgtcggcgtcgtcgtcgtcgccgaggtagttcttggccagcacacgcagcgccggggccttgcagtagccgagctcgaccttgcggtccatgcggccgggccggagcagcgccgggtcgagcctgtccgtgtggttggtggtgaacaccaccagcctctcgccgacgcacgacgaccagaggccgtcgacgaagttgagcacgccggagaggctgatcgtctcccgccgcatggccgcctcgaccgccggcggcagaagggttagcgcgtgttgcagcatcgcacggttgcgctgctcgtcggcgtcggcgtcggcgtcgtcttgggacgacggcggcgccggcgcgcgcgtccggtcgaacagtccgagggagcagtcgacgtcctcgacgacgatgaccgacttgggccgcgtcgaggccagcagcctccggaggtcgtagttggaggtcactgtggtgagctccaggtcgtagatgtcgaactcgaggaggttggcgatggcggcgacgaggctggtcttgccggtgccgggcgggccatggagcaggtacccgcgcttccacgcgcggccggcgcgcgcgtagtgctcgcggctgcgcacgaaccggagcaggtccgctcggatgtcgtcgcgcagcgccgggtcgatggcgagcgagtcgaacgtggacgggtgcgagaacttgtgcgccttccagagcatctggtgatcgtccatggcgccgccgtcgccgtagtaacagccgccaccaccgccgttgttggtgtagagcttcctctcccgcaactttgcccgcagcgccgccgcctcctcgagaacgaaggggatgtacgcgtcgcgcacgacgtcgcggtcgcgtcgccggaactcgagccgcaggcaccgttgccagccgtcgatcgggggcggcgcccaccggcgggaggaggaggaggagaagcttcccccgaacgacgagctcgcgttcccgtcgagctgcgacgtccacagcacgcggacgccgcggaaggcgtcgcgcgtggcgtgggagcccggcagcgacgccacggcggccgccgcgccgtgcgccttgtggaggtgcatcgcgggcgccgtggcgaggcagcgcgcgccgaggtagagctgcgccgcctcgtacagctcgttgggcacgccgttggcgtcggtctcgtggacgatgatggcgtcgcacggcgtcacgagggcggcggcggcgcgcgacagcagcgcgcggagcaggccgtgcgcctccggcgggaggaagtcgcgcgccgccgtgcgcaccagaacggcggtggcgaacagcgagccgagcgaggcccaggtcagcttcagaggcgcccccatgtgtgtttgcaagctagatagatggcttcgtgttcgaatggaactcgaattgccatggccatgtcgaggctatgtatatataaggagctcgggacacttgctacggaaccgacctagccccgttcttacttgattaagatacagaatttaccttgaatttcattagcatgtttatcagggaaagtgatttcatcccttgaggggatatcctcttgtttcgtgcatatataaactttttttttaaaaaaaatagtaagatagattagtacgaaatatatcaatccacaaaaatacaagttaaaattcaatttctacaagttataacaaatatagctatgaatgtacgataactattttcagtttagtttgttctttttgttgcaacttgtagaagttgaatttggtcttacatattgttcgagtgaaatattttatattaatctatgttgtcaaggagggacatcccctcgagggatgaaaatccatatcttatttatcaaacattatattagttattacgtggagttatggagggtattatgatttgtttaggtttgtattgatttggctgaaatatgaaaagaaaaagggtctttttaagacagaggtgataatgaaaagatcgggttgattactccatacgatgcttagtatacctccataatgattaatgagtttggttgagtgggataggtttagatgggtgatggccgtcggttttattttcaagtatttggatggccatatgcatctaacctcgtctttgaaccatagcattagcaggtagtacacttttcacgctaccatttgtagttatttttgttgatttcttcatatgccaaatcactgaatatcgtatgatcttttcttatggttagtaaaaaaaagaacaattttgctatatctcactcgaaagattttttttcttatctctcactcgattttctcactcaaatttacagtgcattttcttataagttacagtgtaatttataaaacttacactgtaacttttgtaagttgcactgtaatttttgaatctacgcatgtaaattttaaattttgtattggatttggtctttttcttgaggatatggtaatttagtgtccattatggtgtttcttaattgctttttgctttttattatatctatcggattttaatccaaagattaaaaatctgtgtgatacgaccatagaaatctttcgaaagatgtataggtactcccaaaaaagaattccaaatacagatgctggggttaggccaagcatcatgggcttagcccacagtagccaaaccgacatagaggtacgaatagagatgattagttgacttgactcttgactcttgagagttaatcattgcagatcgacgctgtttccctcgatcatcttttagtaattaagtagtacggcaataacgttaattcgtagccttggcgaccaaggaagctttgactaaagagcacttaacaattaagctagagaaataaactactccaccgtgcatgatacccacgcgaacagatcagcagcatataggaccataggagtatactcaagtggaggaccataggagtatactcaagtgggaaactcaggactttcagcatagaatggacaagagcataattcgtccccttccattcccaacaaaacacaccctagagcataatcgaaggtcatcataagagattcccaacaatgtaaatcattcaagcatttctcacattcatattgatgttcattcaagcatctctctaatatgaatgtgggaaatgctagaatgaattacattgtgaaacggaggaagtacatagtttagttgtgctcatctttcagtacagtataataatttgataatgacttgcatactgttttaggacaacaattttacactataacataaattcttgtgctttacattgttattgaaaagattgaccttttctattcgtgcttgactttacagacttattttgttgtgctgaccagtaattccctgataacaagtccattaaccaacttgaatgaaggatacaagaatggctatataggacaagatatagtttaaaattatattttatgatcaatttgaaccacgaattacagttcgttaattaacttgcatgaaggatacaagagcgatcatacacagcacaagatggtttaaaaagatattttatgatcagtttgaacaatcaactaatagttcattaaccaatgtgcttggaaagttggaagaaacaacaatgatcatacaggacaagattttagaaaaggatgccattaaaatgaaaatatcataaatccatttaaacttttttttgttcatttcaaatgagcataatgtcaagagataaaacaggggcaatttatacagaactaaattatcagaagaacgacatatcaaattagaaaggaaatggcagacagagaaatacctaaacacaacacaacaaagggaagcctgaagtagcaatagttaacacacctattttggatgagccaagccttgggtttctcataaaagtaatcagtaataagaatatgggtttctgaggtctgaatattagcaaatgctattatttcatagttaccatgaaactatcacagatgttaggcagtgactatgatatcatgtcattcggatatggacctataaagtactgatttactgattcagtgacatatgcctataacataactgcaacttaatataaaccttcaaagaacaaatgcacattgatatcaactttcaccccaagaattccaagcccgagtgttgtactattgttcagcaaagaatcagccactgaagaaatttcaaaacagataggaaatggcgtttttattaatccacatatcatggcagcaaaccaaattgttcattttaaaaaagccgcaaaaaacaatggttttagtatcaaaactttcttgataaaagaaacccaaaccataatctcaatatgctaccaatttggttctaacttaagtaaagagaacagataaacttgagcaaagatagcaaactaaaaactactccacatgtactcacacaaaaacaggaacggaggcagcaaaaacatctcctaaaaaaatatggcatgttaatgaactaaactagtaataacaaggatggaagggtggggcaaatgacgatattgtgtaaacaaaaagtcaaaaagaagatctgagctaccacgttaaagatggatatgaaaataatgaacagcagcagcataactgcagagcgccataacatgttccctctttggtgtacaaactatgcattgatatacaagaacagattatagctagagcaattaaagacagttagcagcaaactaaatcctcttacagatgggccacccatatgcagtaatatttttccctatacttgccttcttactcatctgcaaatttatgaagaaaccaggttatttctacttgttactaagctcagtcacagtaaaaagattaaatgagtacggaattttgtttaagataaaagactacctatggaccaagtacaagtatctcagaattttaaagctgcctcacctccattatcaaagtcattaacctacgccttgggtagccggaacacatcgttgtatatttgttattagcaaatgcagattgaataggcagaggcaccagtacaagcctcttctaccaccacaacatagagcaacgcttttctccttccatacataacggaatcaatggaacacaacactatgcataggatgcaaaacacaaacacaaccaaaacaggaacacataaattatctagccagcaaaatttgttacattctggaatcagagcttcagcaaataggaaaaaaaaatctgatggttcccagttgaaattccaacagacaatggttgtcacgactcatgacaaatagggcatcggacgactcagaactaatctacatggatcacagcgatcaaaatcgcgacaggcatgaaccggttatggcaagagaacctacaaattaagcctggaattgcaaatgctgcactgggtaatgtacacaggatacaaatctcaaaaacttgcgtgggatgagaattgccgttaccttctagcaggttcctccgatccgagacctacccggcgatttcccagcgcaccaagctccattacgatggctcaacgtgggagctgtggagtgagaccccgcgttcacccacaccaacgcatctccatctccgacgcccaaacgcgacacgacacaaccaccgcctcgagacggaacctaaggtttctccggtgtgctacgcggggtcgccgctctcgtttgcggccgcttccgcggggggaaatccggctggagagaaacgaaaccctaacctaacgaatcctgccctatctccccctcctcctccaccgcacaaacaccaaggcgaactggcgccgccaccgccgggacgggaatgcaaggcttaccgcggattgctcgtcggcttctctcgcgaaggcatcacggcggcggcggagcggaggcgaaaccctagcgccgacgacgccccatgcgattcggagatggggatcggcgcggcggcggcggcggttcgagaatggggccc

SEQ ID NO: 24020 - DNA, 6704 bp, Oryza sativa
ggtttgttgtttggagcactgtgaaattgaagttgttgttcttctccttcttgagcaggaaaatggttgagcacctatcgaggatatcttcactgtgaccaggttcgatcttgatgggaagaagttcgacagaggtataattttacctggctgtacaatgaattgagctctgcgtctactatatggtttgctatgatgcctgacaatatgtctcccggagtatttgttacttgttagagctttgctggtttcgaacttaggccattttctagttcctttacattgtttagatctttgagttgtatgccgttttttgtgcttaatgttggtgcagatctttgttgaagtaatgttatccttttccatgtctatgtacagttagtcgcatcgaagctcgtagcgagcagttcgacatgtacatgcagttagatgttgctactgaggtctatccgatgcgtgctggtgacagattcaccatggttttagctcctactctgaatctggatggaactccggacactggcttctacacgcaggtgatgggccttattcaccttacaagttgattttgaaaaataatgtgccgattgaattatggaaatgccactagaatgtgttttagttcacttgaatcatgttcttgtttcctttgggtttatattcacttaggcgcatatatttaattgccagaactctgtgcatgatgctaacattaaataatgtgctaattgaattatggaaatgccactcagaatgtgtgttagttgcctagaatcatgttgttgtttcgcttgggcttatattcatttaggcacatatttgatagccagaactctgtgcatggtgctaacattatatatcatttctatctttcaggctggcagaaaaacacttgctgacaagtttgactatgtcatgcatggaaagctctacaagatctcagaagacagttccagtggtcaagccaccaaagtgtatggcttctatgaatttcaaatttaatcaatttgcattgtctagcaggagcatggtttatcataatctagtaaggcttaagtggggtttctttgctcatttttcaacatatcccagatgaacttatcctatagggttaattaaccatgctgatgaagtgcgtagttttgattattaaatgctttctttaagcttcaggatcctttaagagaactttcagtatttggttttaggaataaatggctgttttttgtttagtttgagtgcatcaagatggtcttattgatcaatctaatttttctattgtccagggtaaaaacatatcagtgcactcagttttttagcttttccaaagaaaagatgcaaaattagttgaagtgactagcttataatgattttgcatggggtttttctttgtgcactaaaggctattcttactttgatatcatgtaatgtcaacaagattaataatcactagctaaagaactcaggtgttcagtttgttcgaacagttcatatgcatcccattgctgtctgtactgtttcagctacttggttaattcaattcaagtgcatttacttaattaattgtatcattgttatgtgaatcatgttatacgaagataagtaccttcaaagaacaatttttcgccttgccaatatgtaaatctggcctacagctacacagcttgtactagactactgttagtcctgtatcaagtttatttttaacgtaatcctgtatcatgtgatgatgtcaactccctttgtgctatgaattttaatgaattgcattcttttccattctagggagatctatgcatcgtttggtggccttctgatgatgctcaagggtgacccctccagtgccgctagctttgagctggaccagaggctgttcctcctcattcgaaaggtgtagatgcactatctacctaataacctgtgatgatggttaactttcaggctatagccagcctctgatctccatttgatggtttcttgtcatgctaattgcgcaccacccctatccactcccttgggtggcaatgcaactttgtatcaaacatcgacaaatacttgttgaaacataactcatttaagcatgttatgtgaaattgtcccgttgtttcgcatttggtacactgcattgtgcaggttgtccttgtgggtatttatcagggggtatgacattgcgtgcctgaaacttcaatactcgtatcctcagctcttatgagtacaatggaccacccaatctgcagcagcagatcaatgaacaccggatgtatagctgtggctgcctggctggctggtactccactactccctacatacttttggatggttacaaagttcacatgccatttccttccaggtcctcctgaggacaggaaccagttgcagcccaggagcagaagcctttactactaccatatatagagagcaggatatgaattggggacagcttatgatttaataacctactagctcctgcaaggcacagaaaggctcaagaaccattgccaagaaacacaaagagagattgaagatggctggaccactgtctcttgaacaaaatttttttgagagctggaaagggctctgtaccaagaacaatccatggagagcagctcctactcattacacctaggaacagtactcactcaccatatatactgccacagcttttcttttcctgggatcatatcttcagagatttcatgcttcaaattttggtggccatctttattatgtgctgctaggattgtgtacatctgctatcagtactgattttgagcctacatttaatcctgtcatcaattcaagaatcaaatggctgtgctaataaacaacaaggacagaaacaaagagagtacaagagcatttatgcatgctggttcgaagagactgttgatgagtaggaacagtgtattctgagcaactagtaattaaaagaatcatacacatattgtgctcagtatggctattaactaaagcccattctgtcatggggatacaggccctacacagccacaagaaattcatgagttcatgaggaagtactatttttctctaactttctacgcagaagaatacaatcaaaatcttttacttcagagttcaggagatcacatcttgtgaagcttttggggtggaaagaagcgatcctcagacatgatgaactgcagaatcttccacttgtggaatcgaaacaaacaccccatggaggaatagctgatgagggcaattcttgtttctgatagaaatcaaaaccaacacagctagacagaatatacacccaagtgctggcagacaaaagctcagagaagaaaggagcaaatagaattcatcagcaaaaaagatattaaaaaaaatgctaatactctactttactaacttagcttatctagtccatgatgaacagaggtgatgagagcagttgagcaccagcagagaactcactatgcaactgcaacaccaatggctacaatgctgcttgctgcttaactaattgcagctcactgaccctgtatctgtctacaatgcttgccttgattgcttgttagtttgctcttcgattcgcattcgctgttgctcgtcttctagcttgggcatcgcgatggagttcttgccgcgcgatcatcacctgttgtgcaaggggttcgggcccgtcggcacgacgcgcttgtcgtcgtcgtcggagcacggtgacggagcgccgccgtgtccgccgctcttctccttacacggcacgccgccgccggcgtcgaaggcggtcgagcgtccaccacctttcgccttcgccacggcgcgatgcacgggctgctgcagggacgacgccaccgccgccgccgacgccggcagcgccaccctgtggccgtggtcgtgcgcgcggcgcctagacgacgacagtgacctggcagcggcggcggcggcgagctgcagcacgacgacggcgatgcacagtgcggcggcgcagcgtgccggccaccgccgcctcctcatggagctccacgcagaggtggcgccgtggcgcgcgcgcgcgcgctctcgagtacgcacgttcttgttgttgttgatgatggttgggaggaagaagaagaggaggaggagggagacacacgcaggtgaaacgaacactcgccgtttttaacagcgcgcagttgtggtgaccaccacagtaccacactgacaaactacggctaccaatattattaaccacactttctgaggacaattatttacttaattaaccaaaactgcgcttgccagaggacagaacacacgatggaactaaacgtgtttattattggagaatttatgtcgattaatgggatttttttcaacgcttaactattcgtcttatttaaaaaattaatgtaaatataaaaaatgataagtcatacttaaaatacttttgataataaagtaaatcacaaacaaaataaataataatttcataattttttttaataaaacgaacgatcagacattacaaacaaaaactcaaagcgacaagtattttgggacggaggtagtaattaatagctgtacatgtgtgtaagtgtcctaggatttttacagttttgcaaaaagaaaggctgcactgcaccccatgctcctggatgcagctatagctagtaccacacccaaccacattgatgagccttcaatccccttcctcctctcactttgtgcgtgtatttatgcctgtacttattccgtcctaaaataaataactttattatgatatataacatatatagtattgtgaatttgtattatcgacacctctcgtattagttttgttgagaataaatataatatttcaactatttgtctagatttatctatacaatttgatctttttttctagaacgaaaggagtatatatatctttatatctagagagagaacatggcaatggcattgcagaggtcactctcttgtgtatgcatgggccgagacgacgacggaaatgcatgccgggtttgactgccttttgcatgctacctcaccggtgagatccatcgatcgatcgatagatcaacacagtgtgcacatactccatgtgttactcgaattcttctccgtttccggcggccgtgtgaccgtgtccgtgcccataattcttcagtactcttcagttcgtattactccttgggtatctctctctctcgagagagagagggtacagtctacagatagactgtagtgtgtgcatgtgtgatgataataatggagtgctcatcggtggttggttcattacatgtcgatgtctctagggagtggactatgtacctgtccaacgataggtagcactgaaaacgtgcattagagtagcactagcaggacttactagctagcagtagcactgaagaaaatgttgctgctgctagctgcttcttgtactgtatttttcatcttcgttttcttttcttgggccgagtttagttccaaaatttttctttgaacttctaactttttcatcacatcaaattttttctacacacataaactttcaatttttccatcacatcgttccaattttaactaaatttataattttagctgaactaaacacaccccatggtgttgaaactgcactgcacagttttcatctgaagagctacaaactcaaaatacctcacgcaagctgtatatatgcactactgtacgtatactctagctagtctatactactctgtattctgtgtgtacatgtgtacgtgagcttatactgacagaccagacgagttgttaaatgatttcatgagttttgacgcagtttgctgctgcttcttggatttcagctcctgcatcgatctgcatgcttgttttagtatgggggcacttgattcagaaagagacacacaaaccgtctcgggagttacgattcgatcagatacaacaaaaattcagcatgaatttcatccgatgcttccagtttctctgaatccgtgagaaaaaccctctctgtttcatgtacatgcatggctgtcaaaatcatatcaaacctctgcttaacattgatcactcttctcttgtgggatcgagctgtactgattgaccgatgttgtaagcaaaagctgtttccttggtccatttcctgtgctgtttcttactacacgttctatagcgtttgtctgattacaattactgccatatagagataggtagcgagggatgggccggtacatgagttgcaaagcctgggcacaactgatgcatgcatagctcaaagctaaacttatttatgtttctgcctttacccagttcctttttttccctttacctttacaagaatgatcatggctatgcatgaatgcatggtgaccgagtattcgagtgagtgagacaagcatcagcaacaaagaggcctcccaaatgagctataggagatacatagtattatatgcatggttcactgcaatatgataaacaagcatatcgtatcgagatactccttcctatcataaatctttgacattctgaaacaagattttgatcaaaccttttcaaattctaacaatcaacttatatcagaataaatttattttgtttgaacgaaatcggcaagacgccaattttcattgaatagagaagtaataaactgtacaaaaagtaagtatttacaagttataaggccgcgaccctagcaaccgaaaacaattacactatcagccaggcggcaagatgccctacgcccgccagactgggctgcagga

SEQ ID NO: 24021 - DNA, 7131 bp, Oryza sativa
aatggctgtttgattggaccacaggaaaaacgcaggaatcagatgagagagatagactcagaggaaatgttccaagaagttagacctcttgctaactttcctccaaaatgtgcataggattactcattccatatgaattttaaaggattggatagaattcaatcctttgtttcaaatgccttcctagaattttttttccataggattgaaatcctctaaaatttctacatttttcctacaagtcagaggggcctaatcattttcaatgcagtactgtccgacatgtacaaatgttgaaaagtttggagtctgtagagatggtttaattcctgcagctcctacgtaggggccggacccccattggacaattcgtacttgacagtaacttttcttcaccagtacagacaaacccatagatgaaatcttccttacaaactttcaagcaaccgtctggttaaaaactaacataatggtgtacccagctggtgtttcacaagcttctcaacttgttgtttcgatcttcctgggaataaagattcaagaagttgtttcgagcttctcaacttgttgtttcgaccttccttctcaaggtgaatccatgacaataagtgtagcagtagagaaaaagagtacggcgatatcagcttgctggtcttctgtgctgaaatcaccctggcatttaacaatgtcagtagtaggcaaacagcctaacactgtcaatgaccgcataattccaactcgagtgaaaacattgcagtatggccgtacagtggagatctggttaaaaaaacagtaaactagtgaggagacttcaaccctcaaaagtattactattagtcagtaactcctcaacatttctgcaaaacactgtcctattgtacaagcaggcatggtgaacagaaaataattattgacataaatccaacacctgaaatacagtgtatgtacatcattcaaacacaggtcagaagatgggcgatgtaaagctgccggttagaaatacagtcagaagctagtaattttgtacagacaatttattagagcaggtacaacttcacatatgtacagtaaactgaaccattggtccattgtagatggctgtactacatacatggcagagcaaatctagtgatacttgatgatcaaatctccccccggtagccaccaccaccgaagtaatcacttcttgctcgagcaagcgtgacactgttctggagctgctgcttggggcaggcctcgatacgatggccaaggccaccacaaaacgcacagcccttcacaccactctgctgagcaatggccaccttatcgtcctcctgtggatcatcaagatcagccagaattggtggtaacctttgctttgattcgatgagcaattgcttcaggtcaagaagcgtagtctctgtctggttcttgttgatgaatgtcgttgcgacgccggttttcccacgcctgccggttcttccaatccgatgcacatagttctctatctcagcaggcatgtcgtagttgatcacatgctggatatcagggatatcaaggcctttggatgcaacatctgtagctaccaatacatccttttctgaggctttgaatgatttgaacgcgtcttttctttcctcatcatcttttccaccatggattgcaacagcttcgacacctttcagaagaagaaattcttggatgtaatcgacatcggctttgtgctcgcagaaaaccagcacagggggtggggttttctggagacactcaaggaggtatatgattcttgcttcctccttgacatactcaacctcttggatgacatcaaggtttgctgctccagctcttcccacattgacaatgattggtttcactagcgcactctttgcaaaattctggatcttctctggcatggtggcagagaagaggagtgtctgtctctgtgccttgaaatggtcgaacacctccctgatgtcgtcctcaaatccaagatcgactagtctgtccgcctcatctagtgttaaatacctggacatatgaagaaaattattgagaacattcaaataatcaaggaatgagagctccatcagttggcctaataagccaaagcaaaagccaaaatttgaatttttgaacttgattttggagttgattttaagatattctcagtgtaatttctttttaccgttggtttttaagtcgctacgaacaaaaatataaaagttttacctataaattaattttcatttcataataagccgttttggcttattaggaaatatgggaaatcgatgaggctcgaacaaatggtttaattactggaagcatacaatcagtatatttggctatgctgtgaggctcaaaactgaaaggaatcaaagtagattcaagacacatctgcagccttctttccatcttgtttgattttttcagctttgagcatcgacatttctattactttcatatgattagcagatagaatcttgttttacacaagcagatagaatcgaatattagcatctctccacatccccttcgaaatgactactcttacttgaaagttgtacttatgtatcatcttcacccaaaaggccaaaacttaagctgatcactaattttggctgaatttcaatttccagttgacaagctacaaggaagaccatctctgcagtttgcatatattctgttctataaacgtagtgttctgacttttgacaaagtcataagcagtagtaaaaaccattttctacaattatatcactaaactgaatactgtttagctgttcatacttcaaaaaaaaaacccaccatttccatgatactgaacatatgaacatagcgctatgaatgccaatttgatgacagtgaacaattagccatggaagcagagcattcctgaagaaatcagtgcaccacatacctgcagttatcaagattcatcttcttcttggagagcaaatccttgagcctcccaggagtcgccactacaatatgcacgcccttcttcaccacctccatctgcgtcctcatgtccacgcctccaatgcagagcagcggccgtatctccgggtacccggcctccatgagcggcgcgaggaacatctcgatcacctcgtgcgtctgcctcgcgagctcccgcgacgggcagacgatgagcccgaacgggccctcgccgggcacgatcggcatcaggatctcctcctgcagcgccgccatgatgagcggcagcacgaacaccagcgtcttcccggaccccgtgaacgcgatcccgatcatgtcccgcccggagagcgcgacggggagaccctgcacctggattggggtcggcttctcgattcccttgccgcggagcgcgcggaggatgggctccgggagacggaggtcgccgaagcttcgggacggcgggggcacgtcgtcgccgtcgacaaggatgtgccagctccgtcgcagcgcgtccgcgcgggaccgcggcatgcggcggaggcgaagcggcggcctccaccccgtggtgatcggctcggagtagctgatccccttcgcgatctcgccgacgggcatgagggccttgcggtcggagaggtgctcgatcatctccctctcctgctggagcagccgctcggccggggtcacctcaggggcctcgcgcttcagcttcgtggccttcacgagcaggctcgtcttgaccgcaacctcacccaccgccggcgacgaggtggagcgcggcggcggcggcggggctgcaactgcaactgcgttcgtggtcggcggtttagtggcgcggcggaggcgttcggcctccatggcccggcgcttggcgacggggacgtactcctcgtagtcctcctcatcgctgtccggtgttccgcggcggggcgagtcgccggcggcggcggcggcggcggcggcggccatggcgggatacgagttggagggaggcgattcgcccagggagaggaagtggtggcaaaagtcggtttcgcctagaagtcgctagatttgatacgcgtggaggcccagtagaaaggctttgggatgcagctgggccaagttcgcgagtcccagtagagatttgggctttgtgaaatctggagattttatgtggccgaccagtcttggatacggcctggcccattttgttggttatggtcagcccatgaatgaatggccagggattctccagtccggtctgattgttacgtgggccgtcagatggcacatggccggagaggtgacaggcgggggtgctggaattttttcacctctgaggttgaaactcttgtcagtaggaaatggaggtaaatcaaatatggagtccagtctcataaaaaatctctttacacctctcatactgagaatcatactcctacatcaacattgaaaagtgttacacggtcactgtccatgtgttgccgtaaaaatcttaattcttaacagtactgcagccactctatcaccgtacagaccgtcactccatgagtgcactgcgcagcagggtgcagatgagaagcaaatgatagtccatgtttttatcgtcattgccatgcatgcatacagctggttgccatttgcgagaacagcattcacagcagtgcaccgtacgtcctttcgcgtcgccttctgccaccccggcccaccagcctatcagaagactatcccctgtgtgtaccagtgtatcatatcgatcgccaaaacggaagtttcaataatccacgctatatttttgcctgttcaaaacacagaatggaaatttcacttcacgcaatagcactagccctgtactgtaacacttatttaggcacgtgatgcttggagcgaggtggagattaaaaaaaaaattggcgatgtcagtctaatcggcgagttacggcgcccgtgctatgaatgcccatgcatgaatgtcgcccatctgccaaattaaacgagcgcgtaaatgatgcaacaaaacaatgctttgaatcatcacggcggtggtagctagccatccaattttgaagagccccagatcgatccatcgaacttggctcgtctgaatgatgagatatcgagagatcccttccctccctgcaagctgccgccaggatgcgacgaatcctctcgtctcgtcggtgggccggacggacggacggacgaacggcgaatgcgtcagcgcacgcagcagcgcagcggataaggcaaaaacgcgcagcagccagccagcctcgcgaggacaacacgtgccagccgcgcgcaggcgctgcagctgcagcagcagcggcagcggggtcgcgcacgggggacacacggcggatgccgggctcgcgcacgcacgcgcgcacgggcgcacgggcgcacggccaccccagcgctgcgcgaaccgtacgcgtacgagccgtggcacagctggagcgcagcggtggctatggcgtcacgagatcaaccccacgtaacgtacggtggtgcagtgccgacccgaccggggaatgatggcctgacgccgggatgccgccgcgcggaggacgcggccggggaaggcggattgatctcgatctgcccatgtaaaaaggcgaagaaatcatgcatgccgctcacacgccgtcacgtacgcgtggcgacgcgacgaggcagagtaggcaaccgaccagctgctacccgggagcaaaaccggcgtgccgcggttgcgcgtacgctggtttcgtgctttctggaaacatcgtactgtatatactttcagtatgcgactattagtatagtataatcttctcgcggagacaagtattttgtatattatgtaacgacctcagcagcagcagcaacagcaatggagtactcctttaattagatgtgatgtactatttgtagtaggatatatcacatccaaccaaattttcttatacgtagtattttctctgttttataaagtaaatattttagcattacccaagtttatagatatgttaatgaatctagatatatatgtgtgtctatattcattaacatttatataaatataaacaagttttatattataaaaatggagggaatactatttaggaacagaaggagtacagtacagtgcttctgctagctagtgctcgcaatgtagagatgatacgtgtggcgactgatgttgctaggactgcgagtattgaacacactcacagggcgctgtgttcagcgacaattttggagttggcagccataaacgcagccgagagcgagtcagctaacgctagctaggacccacggagggacgcacgaatcagtcgcaatgataaggctaaaggctagttgatgcttgctggtgagtggtgatcgatcgatcgatccatcggccggtcacggctggaattaatcggacgcgtttaaggcgtgcggcggagcgcatcccatgcatccggcagggggtccgaatcccttcaggcttcttcagatcgatcagctcagctcagcatcaggcttgtgttaatggcggggagcaggcaggcaggcaggcaggcaggcgtgtgagcgttcaactccccttcaaatttggagctgtagatttgctgatccactcgtacggcgtacgtgcagcacacgattgatgagtgaggtagtagctgctccagatgctagctggcacacgatcaacaacgaagaggaagggaccccatccttgattgattcaattcatcgcagtagtagtagtatgcatgatgcatctgcatgcagatgtacggagtactcgctacaggttagctagcgtccgtgcgtaggccacgcgtgcatcgcgaaacaattggtaacctgcaattggggctgatgagaaactactccacgcgtacattattgttgttcagctgcgcgtatcctagtacgtcgtgtgtgaaacaactcgatcgagtcgtcgtattgcaaaaaaacgagtcatggctttgcacgaccgggtacaattctttttttatactcttctccattgatcggtgggaacgaggagggctcttggagtttttgtctgtgtacgtgtgagccaggccagagtgtcggacagaggtttagaatttgtaacgtgggtttggctgtgtttagatataaagtttggatctaaactttagttcttttccatcgtatcaacatgtcatacacacaacttttcagtcacatcatcttcaatttcaactaaaatctaaa

SEQ ID NO: 24022 - DNA, 7686 bp, Oryza sativa
ttcggtttgtaggaatgagatatatacgaaaacaaaagaaaagccagaaaacatagaaaaaaaaattatccaatcgaatctcttgaaaaaaattctatgaattaatgtgcgcatacatttctattactccacattttctatttctatgaattgaaattcctccaaacctaacaagcctaaaaaactcatgtaaatcgggcttaaagttacttatatttgagacccgggagtacctacaaaaccattattttcagagaaactatagtaaacttttaaaattattgcaaactagccttgagattaggaaaagatagttgtacatcaagatttctcccctgcatcaaagccctgtaaattcatgatagcttaagcattgatcttttgattgatgcaggatatcactaaaaagtacttcctcttattactctttgtctaaattcgttgtcttaggaggagtcacatatcttattaggttgtttttttttaagatgggagtacagcacgtagctcatggtggttggttgattacattggcatcctttattttcaactcccatgcgtggtacctatccttatcaaatgtcttaatcagtttcataatcgcaaaattgaggtggcatgagtatgtttccaagaaaatgatgacacgtttcaaaacctctgcggagcattggcggtatttgtaatcacacgggaccgtattctaccaatacgtcgaaatgtgtcaattttaatttatcccttaaaattgtgcaggagctgaacaatctactacttagtagtacatcaaggattctcatggtgcaaaatccgcagttaaagtcatgtttgcactagctaaaaatttcatactaattgcctaaaaagatacggtggagtaaacaaacagattcataactttttgacaaccagtattcgtacagtcgtacgtatcgtaggacactctgattaatatagttctgacagatatgcaattgcttgccatgcaattatagctagctgtatctgcgtagtactgtagcacagactgatgattgcacttgatgtgctctaaaaaaatcggtccttgaaaaaaaaagcgtgattgagaccctgtttagatgggactaaaacttttaagtccctatcacatcgaatatttagacactaattataaatattaaacgtagaatattaataaaacacatctataatcttggactaatttgcgagacgaatctattgagcctaattaatccatgattagcctatgtaatgctacagtaaatattctctaattatagattaattaggcttaaaaaatttgtctcgcgaattagcttccatttatataattagttttataattagtctatatttaatactctaaattagtgtctaaatatagagactaaagttaagtccatggatccaaacaacacctgaattcatgaacgcaaaagaaatgaaacgaatggtgtgagtggtcagaggtagtaccagcacaagtttgacatgttctcaggacaccactaatgtatatagtaaaagttaaataaactttaactatagcacttctcacaaatgtatatggatacaatatgacattaagagaagagagagaaatagagatagataatattatttatatcatatgggtagttcatatgcatatggatacattttgctattttctttatatgaactagttgcacaatgttaataggtggctgaatggaatagtttatattgtggatgccctcatagcaatgcaacttcttttcttaaaaaaatctgtggaaataaattccatcaaaatgacgagttaggcaaatcactaacctgtcatttgagatgcaaactctattaaatcttcaagccattaatttgcaagaaattaagaatccaaagccaggctgatattagcaatgcattttcctgcattgtcatcgtttcgcacatgactgatacgcttattgcgaaaaaataattaataaatatctttttaaaatgtgcatttaacgacttaaaaactaatgctaaaaagtaaacaacgattaaatagttatttttaaaatttaaattttggttggaactaatagtccaccaaatttatgtacagttaaacctggtgcattggggtcctattcagattcgtagtttctagaaaatatcacgtacctttaaaatttcttatattatactactccgtaggacggagtaccaaagaaccacaagaaaatttatacggccatctgaattctgaggagaacacaaccaaagatggcaaatccagcgatgagcaaacgagccgttgcgtccagaattcgctgaacgtctcggtcgattttaatatctgtactatactactacgtgaccctctatggcgtcgtcgagccgaaccgagccgagccccctctgctgctcgctacagaggccgctgtctctcgcccctctggtgccaactcacacccattacacggctggcaatggcacggcatggcatggcagagaaaagatcactcacttcgcggcaccatccatccaaccatcttccaaaacccctatataaaccccagcttcgccccctgaatctcccacacacactgatcaccgacacaaacccaaagctaagcttcgagctcccccattgatcagtgagctagctagtagctggttggttaaaaggcctttttgttttgtttgagttggagcagaggagaagaatggcggctctgcttgtggtcgtgttggttgccatgtcggccatggtggcgacggccaactttaaccaggagttcgacatcacctggggcgatggccgtggcaagatcctcgaggatggccagctgctgacgctcacgctggacaggacgtccggctcagggttccagtccaagcacgagtacctctacggcaagatcgacatgcagctcaagctcgtccccggcaactccgccggcaccgtcaccgcctactacgtgagtgtcaccttccgccgccgccgttgttgtcgccgatgtgatcatgtgagctgatggtgtttgtgtgtgcagttgtcgtcgcaggggccgacgcatgatgagatcgacttcgagttcctggggaatgtgaccggggagccgtacacgctgcacaccaacgtgttcacgcaggggcagggccagcgcgagatgcagttccgcctctggtacgaccccaccaaggacttccacacctactccatcctctggaaccccaagcacatcatgtaagtcaagtccacacaagaattcagaaattttacaggtgacaagagaatgaatcgtgaatggattgttcgttttgtttgttgctgcagattcatggtggacgacatgccgatcagggacttcaggaacctggaggggaaggggatcgcgttcccgaagaaccagccgatgaggctctactccagcctgtggaacgccgacgactgggcgacgcagggtggacgcgtcaagacggactggacgcacgcgcccttctcggcctcctaccgcggcttccgcgccgacgcctgcgtcgtcgccgccggtggccgcacgcgctgcggcgccaccgtcggcaccgacgccgcacccggcaccggcgccgccgccgccgccggtggatggtacaaccaggagctcgacctcacgcggcagcagcggatgcggtgggtgcagagcaagtacatgatctacaactactgcaccgatcccaagcgcttcccccagggcgtccccgccgagtgctccatgtgatagtaagaatatcccatcgtcgtcgtcgtcgtcgtcgtcgatcgccggcggagcaagatggccggagatgaggaaggtgactggctggcgtctgtaaaaataaataaagattggcactgggggtggtaaaaaaaaagtgtaatgtagctgtggtgggtaaaattcttttttgttctctgtttcgtagtaagccactgcacgccctgttcgtgtgtaactgatcgtgtccatgcaacaattcatgtgtaatatattcctcaacaacatacatgtgtctcgtcctcgatgtgcatacgtgatcgtgatctgctctacgttgcaactgtataaattttgttgcttactactccctcaatcccatcccgaaacaaattcatttttcacatatttcgcacgtattaatctctatctctactattataaatattgaaaatgtttttgtcgatattttgatacgttattcgtgtatgaatcggtttttaatttcgtttgcttttaaaaatacatatatgtatttgagtcggttttttaagactgttcacttttgataatacagaaggatttatataagaaatctatttaaaaaactcgcatgctaacttgagatgatcagatttctaactgcagctcataattttctaaaagtatatatatccaagcgaactcgcgactaaaccatataataataataagattaaaataaacatttctagaaaataaaaaagtaagaatttctcaatttctcaaatcctaatacaattacttatttctttattgttctctatttaaaaatcaaattattttggaataaatgagggaaacttaagaaatgaacttactgtaagcggaggtgtacaagtatagagttttggtctgattaattactcgtggtacagtcatgcactgtgcgttgaaataagttgatcttggtctatcgggtttcaaaaaaaaaagagttgatattggtcttattggtcagcagtgtgtgtcaacaccaggtcaattacttacgtacgtactcctactcagcactgggtctatcggagtagatgttgcggtctccaggtgttgaacagctgtgtgtagtacgtacgtagcctattccattattcgatgccaaacagtctctttaattgatcattaaaaaattaagcgtcttagtaattctttacgattcacgatatggatgtttggttcgacaagagagctttcgtgattagtgcgaaaattaagatacgattaactaaagatgctaccactagtctacgtcacacacgagtatatcagcatggaacaaccaaacaaacagatcaattaacttgattcagaatcaaatccaagcaaatcagttactaactcgattcagaatcaaattcagatgcccctctctcagttaatccacaaggctaattaagcagcagcatgagtgagtactgtgcgagtcacaggacagaagacgacgagaaggggcacgagtacgaatacacgagaaggacaagggctcgtaatgatccgtcaggtctgcagactctcagttgtctcgctgggcactgggcgatcgatgtgaaatgcgtgttcaatttctgattcggacaagtggccgcaccgacagattcacagggtgtagatagccttcgcccatggctggcctggccatcgtcggtcggatttttggatcagcacgaagctgatcgatcgagccaaaattcaccaacagaaacagatcgctgctgctacacagtacagagtaccggaacaaagctacaagccgtgatcttctctttctctgaagaaagatggtggctgtgggctgtggctgcttgccttatcctttcgagctggtcaggtcacggtctcacggaccagccgtttcaggctttcagctactaggagtgtctgaattttctgaataaacaattttacgttacttgagaatatatcataaggcattattttttctattgtaaatttggtatctcatgttacttagataatgtgagataccatgaggtaccaaaatcaccttaaaaaccgtagaattgctttctaaatatttagtaggtgctacttgcggtttcagtcgcccacaccgcttggttgtggtgttaaactggtagggacgttagcccgtttgtagacgatcagtactccgtggtgttaaactgttaaatttggagtagtagtagaaatcttcggtacaatgctttaatgaatcatgatgaaaagtcaaaggatgagcttgcagttttgcaaaatattgtgacaacctattaggatcaggctgtgttctagagagtttttttttatatgagcacggtttctgaaatattaaatgatattttttatataaaaacttgttacataaaattattttagaaaattaattaataatagtttacttaattaatcatgtgacttcttttcatttttttgtgttattgaatcacctcatccaaagtgttgtcatgaacaaagccttagttctttttaattatttatcaaactgttcaaacagattatttacgcggtggtaaaataaaataaaatttctataaaaagaactttcttctacttatattgcttagaccacctattttcgttatttgttaaatatatttaccacaaatattaatttatccctataatcgagtagataatctgcggcaacaattcactcaacaacttatttcaaacgaacatgagtccgttggtgagttttgagctaagtacaacaatctctttggcaatctacactaatggatgatttaccagaaaaaatggagaggagaatgactaaagatgtccctatttcttgttttttttttctttatgcaccattgtttcttgttgggatataagttcgctaagtgtcattatagttagctgtacctacagtgtgcgagtagtatgcaaccgacgtccggctgttttgtcacctcatcatgtctcttcgggtgtcgtctgatagggatttgggagtgggcatgcatggtatctgcagtaaccagtgacttacgattgattgctacacaaaagctctatcacaacttgtgactcttgcatgagcatcaacacacatgatcaaactagtacatctgctcttccttttgtaaactactactagtagtactagtaaaaattatgtactcctacattccttgagcccctttgttttagataatgacattccttagaacttttggaagcttggtttgaacagcaattaaatcatggacggttcagggagttaacaacttcaacaccaacatgtcgtgtatacattttttgtcgtgtatacattttttttctttttgccctgtttccgctgattggagttgcgtttagtcgtcgtactctcttcatttttggtttttctgttttgttttttctccctccccttagcataaaccggtttagctgattgcgttgtgtaaacaaactctctttttttctaatatattgatgtgcaatccttttacgcgttcgtggaaaaagtgtacaaatttttcaatgagagtttgaaatccaattccaggaggaaaaaataactctgaaccagtactgatctatgcatgattgagctggttgtacgcagtgcaatgatagactcaagaacaggatatacccacattgtcaaatttatgaagtttaaacagggagccaaataattggttgtccacgacgctttatttatgggtgggggtatatccgtatatgctagctagtgtcattctgccgccttcgttgcactctgcattgcgggtgtgtttagttccacttttcctaaaattaaaagtttatatatgtaagaaaattttgatgtaatgaaaaaattgaaagtttgaagaaaaagtttggaactaaacaagggctgcaagggctgcatctcttgttctcttgcaagaccctagcactagctgcagtgctatactgccgttgacaa

SEQ ID NO: 24023 - DNA, 29170 bp, Oryza sativa
ccttgctagtccacgctatttcttgccgcacatgtaacatgtttatttgtactgtgcaagctataagagaaaaaaacatcataattgctattactaaatgatccaaggtcttacatagtagctgtataccacactctctttaattaattaatcatttgatgattgcaagatggtcctgaacctagtggaagatgagattacatgcaatccattccagatatgctgctacatttccagatttcacttgcctaacagagtcacaggttaaaattcgcactacaaataaaacagagatacagtagctgagttggactcattgcaaattccagcttcagtacattcatccaaattaattgcacaatttcagcaccaacataattggcacacctgagttcagacaactaccctggcctaacctgcatatgattagatattagaggatcatcatctagcctaattagcatttgggaattgggattactacttttgatgcatcaatggcattctaaagcgactttctgataactgagggaccagtccctctcctgcggacagctgctatacgtgcaagactagtcctcctcttggattggatcacgccttagatagtcctggacatcattaagtttggtcaagtatgagaaaactcggttgcttcttttctgaaagaagataattcagttgcttgtcactacttgggtttcagttactatctagatctatcatgtatgcacttcatcctagttggaaggtgatggagatgcaagctataaatcacactatctgtttaactataagcttggagaacacatgtgatggcacatggcctgaaacaacccaaattatgtcaatcatctcgcagagatgaaaggcatggccttgaaagttgaaacccatccgaatttaaaggaggctttaatagccactgacgagcaacaagaatgcatttgctgaactttcaactcggcctatgaacatcgagctggatccaactcgatcgtagcttgctgagagcttaaatgtgtactctgttctgaactctggacactgtctgtgtccagctaaaccgtggtgcggcgctcaagaggctacgaactcggcaaaaggctttgctttcgggtagtagggtttaatgtttgggtgttagtgcctttgtgcttttttgtgcaactgatccagctttgatgttgcctgaaatcctgcattgttttctgctctgccgctagtaaccccaatcaccactcgaaatatcaaggaacccaatcattatccattgtgcttgtgcatgaacaatcctgtccgatcgctcaactcaaaagttcacagctggaaaattttatcattgtcctacccttttcatgctttcgtccgtgctcatatgtaccgcgagtgcaacaaacaaaatagtttagcgcagctgaattcctggaaatttccatacgaaagtttctagaaaaaaaaaaacgtaagtcaggagcacagctgcgctaaatagcaaatctgcaattgtaacaaccatccctccaaaaccgcgtagcgtagcccaaccgataagcaggcccacttacacacatcactccccttacactttcgttatcgcttcgtgtaaaagggttaacccgggagtgatgtggttggaaggaagaggccttataagtcggttccactcggctaaactagtaaggtggtactaaacatgcgcacacaacttatatgggccacacaggcctaatccttattgggtcgggatgtcacagcaatcccctgacataggcttgtctagctgagtggtgctgtgtaacaaaaactcgttttcttataatatattgacgtgtaatcattttatctgttcgcgaaaaaaaaaatccccgatcaatattggtaataggagttatagacttatagtacttaccggatgcatccacatcttgctactgcgattcgatagccggtgagaccacaaatcgtccgcattgacaacgggaaggcctgtgaccgcgcaacgcgatcaccgatcaacacgcgggctcgtcggcgccggtgctgatgctgatcgatcttacgtcgcgtcgcgatttaactttggcatcagagtatcagacattgtcaatttttctcttgtcatcgcctcagctcgactgatgaccggacgaggcaacgtcgtcgtcgcgaccgtgccactggtggtgtagctagctagcgcttctattacgacgtcgtcgtgtggtgcaacgagaaatcctgccgctattccgcacgatgctgcatcgtgttgctgccgagtgccgacagattcgcctgggatatctatccctttcgtttgcccataatcgtttgaggaaaacgtggatttccttgtagatttgtagtttctactagtgacaggctacgtgcaaaagcgggttcccaaattcccaatcccgtagccttcttgggcttagcttaggtgcaaagtggggtacaggagaagcccaatcttgtgcacaattctaccagggaaaaagtacaccgaaggtccctcaacttgttatcgagttacaaaatcgtcgcctaaccgtaaaaccggatacaacgcatcccaacttacaaaaccagtgtagattagatccctcggtggttttgcacccggttttgtccgacgaggcggctgagccagcgtgggacccacgtggaccccacatgtcaggatgccacgtcagcaggctggcctctcccttcctcctctctctctctcactcctctctggactgggcagggcggccgacggtggggaggaggtcgccgggtgaggagttccgacggtcggccggcgatgcggcggcggagacacgggagaatgggagggcggcggcagggcgaggcggcgtcggcgggcgagcgcggtggcggagaggcggcggcggcgacgacgccgtcgcggctcccactccctctcccactcctccccaagcagcggcggcggcggccaccgagcagcggcgcgacgagggcatcgttcgccatggcggcggcacttgggctcagcggcggcgaggcgttccggctgtcggcggatgcgggcgcgggcgcgctcaagctgcacaaggacgacatcaccctctggtccgtcgacggcgccaccgtcgccatcgtacgtccttccttccttgttaattcattcccttcctcgatccttgccgatgcttgtgttcgtggctatggtgcgtttcgaatctgatgctgctcgtgtggatttggtaggattagtgcgcgtggccacacatttggtgggattagtcttgtgtttgactttcactaatcctcaatctttctagaaatatttgcaaaattgttaaagcaataatctctaactcttaactatctgggtatgacgacgaagaagatgacagttattcatatttctcaggttaatgctgctaatgaacgaatgctaggaggtggaggtgttgatggaggtgattgaatgcagctactagtgagctatcatttatctcatcacggattgactatctcatactccagtacaattctcattgtagctatacatcgagctgctggacctgaactcgtagaggcctgcccagtccagagacgcggggctggcagattctcctacgccgacgagcttctcaaggcgttctgcgctgcctttccttcttcttcatcgtcgtcgtctctgccgacgcctgcgccgccgccgacgcagccgcagccagagcagcagaaaccagtggtggtggtgtgtaggagaatctgccagccccgacgacggcctctccggcgaaggcgaagctggcggccgcgaggcaggtgccaggcggcgtggctagatccaagaggaggtgagctttcttcactttgcctccacgctcacccacgccgtcgccttcggcttcccgcgtcgcagccgccgccgccgcctcctctccgccaccgcgctcgcccgccgacgccgcctcgccctgccgccgccgtcccattctcccgtgtctccgccaccgcatcgccggcgacctcctccccaccgtcgaccggcctgccaagtccagagaggagtgagagagagaaagagagagaagagaggaaaggagaggaagggagaggccagcctgctgaagtggcatcctgacatgtgggtcctacgtgggtctcacgctgactcagccgccacgtcggacaaaaccgggtgcaaaaccaccgagggacctaatcctacactggttttataagttgggggatgagttgtatccggtttcgtggttagggacgattttgtaactcgatgacaagttgagggaccttcggtgtactttttccttctaccaggccttactgtccatcacagagcgatgtagcccacagccaaatataaggctttggagttcggaaggcggaactggacacacggcccatcctcttttccgcggtggactggtttgcgggccagaccaacaaaacaaatgtaggaataagtctattttgcttccctcaactcatgagcgtggttgaatcgcacccctcaactgcaaaaccgggtataacccgtcccttaactttcaaaactgttgcaaatcaactctctggcggtttcggaggcggtttcatcctacatggtgggttgacttggtattcattccacatggcatcgatgtggtgcttacgtggcactaaaataaaaacaaacttaaataaaaataaaaataaaataattcttggacccacatgtcagttacccaactcctcctgctttatcatcggcggcgagcaagatggagagagcggcggagcggcggagcggcgggagcagaacgacaacgggagcggagagagagcagaggtgaggaagcctcgccatcgccgcctcccctcctgcacccctcctcctccgcacaggtgaattgctcctatagttgcacactcatattggatgcaaggacgtcgaggacacaaggggatcggggagtcaaagtggccagggtttaaactagactcaagcttagtttagcagcaagggttcccaacccatctttttcatgttccgtgcgcacgcttttaaaactactaaatgttgtttttttgcaaaaagtttatatacgaaaattgcttaaaaaatatattgatctatttttgaaaacaaaaattagcaaatacttaattaatcacacgctaatagaccactctgttttccgtgcgctggagatacgttcccaaccgcctgcagcgaacacatcctcactcactttacaagcatatggttctcggggtatattcgtacttttcacatgttctatagcggatacatgttcttgttatgttctacagtaaagatcacaacgtttaaatatcatttagcaaattttatatttcgaaatcatggctaattgtctctgataggatcataggaggctggcgtcatggcgtgcatgcgcgtctgtggaattctgaggtcctgagctttggtgcgcaaagttggacccctgatgaaagattgtcttcgtacggaagtccagccgccgccgggtgcccagggcggttggttccattccatcaatcatttttccaatcgttctaattgcacttcaatcctaatctttgggtcgaatttggcgtaatggcgcgtgaaccggtccccgtcgcatatgtaccatgtcattgtaacaacagatcgaaatgcccaaagaatatttctcacaatctttaaagccacttttgacaaacaaacttattatacatccatcgtcgtcgacttattatcttcctcgtatccttttcccatctctctactactttttacacgacaataacacatacagcaatagatacagaataattctacaataaaatagtttcaagtgcccctttttttttcctacttggcagtgcactccggcggtaacccctgggggaaccggtacgtgtcggcgcagtaattgtagatcatgtagtccctctgcacctgccggagccggtcctgcgacgcgctgtccagctgctgctggtacatccacgggctccccgggttggcgcacgccgtggcgtcctgcgacgtgcacccgctcgcggcgagcccgcggtacgacgccgtgaacggcgcccgcgaccagtccgtcctcacgcgccccccctgcgtcgcccactcctccgcgtcccacaggctcgcgtacacccgcatcgcctgcgcccgcgggaacgccacccccgtcgtcgcctccgtgttcctgtactcccgtatcggcgtcccgtccacgtagaaactgaacaaacaaaacagattaacagaagttgatccttttgtcattttagcgattaccacgataaacgcgcgcacgcgcacaccactatacactctaacacaaaccaatgatatattttcgatatcactaaaatcttattaaaagcccatctacacatgcataatattcatgaggaattttataattcttgataaagtgtctagaggtaataagattttatactagaaattttggtaactcaagataattagtagttagatgtactaaattttaaattaaaaaatatggcacctcccagtacttttcaagtatgataaaattacttaatattcgtaagcaacagaatttatattctaatgagttgagtcatataaccacgactctactaatgtataagtgcattggtgtaaaaaaagttgaaaagaacataaccgtgatacgtacaggatgtgggaggggttccagaggacggagtaagtgtggaagtccttggtagggtcgaaccacatgcggaactgctgctcgcggccgcctttcccctggctgtacacgttggtgtgcaccgtgtacggctcgccgctcgcgttccccaggaactcgaagtcgatctcgtcgtgctgcgacccctgcgacgacagctgcttccacgcaacacccaatcaccattagctcttacaggcaggcatacgcatatgtactcgattggcgatgatcgatgcgatgcgtacgtagaaggtggcgacggtgccggcggagttgccggggacgagcttgatctgcatgtcgaagcggccgtacaggtactggttcttggactggaagccggagccggacgacctgtccagcgacagcgtcaggagctggccgttgccgaggatcttgccgcggccgtcgccccaagtgatgtccacgtcctggtagaagttgccggcggcgccgccggcgagcagcagcacggagcacacaatcgccgccaccaacggcggcgttctcccgggattggaagaagaaaccatcgtgtgtgtgtgtaacactgttggattggattcggtttttgatcgatcgatcagatggttttcgtgcagtggtggtgaaagatcgttgtgcgagctgcggtttttataggccactggagtggaagggtagcctttcggtcggatggttggaccagagacgagaagagggtgtaatgtaacgtacatgagctggatccattgagcggcttgacgatgtggacgtacacacgggtcagaatcgcacggcttggttttagccagtttgcttcttttttgggccttagttttgctcggtttagtgttgtgatatgattggtgtgcgtcacgcgcatgcaggaaaaggggttcctggctcggaacggaattctgtgtagtagcggtggagccaaaaattttctaagcctagcgctcgagtagggctcaattaataggatattggttttctagaaaaatatgtaatggtttaaaaggatttaagcatatttatggaggtaagccgggctcaagtctaagctgccttagtcttgcctctgccctgctatgctgttgtgcagtaatatatatgtattaggtgcaagcgtttacaatcccaacaaaaatcagtctagtttacgcgaaaattggattttctggactaccacgatagcacaaagcactcgttttttctttagtcaagttaaaaaaaatcaaactaaaatttgattttttgacaaaaaaaaaacttcttcgatttccattggtttttattgatttaccaatatatttttttataacctaagataccgctcgggactatgaaccctgtgtgcaattgacatgtgggcagaggttgtatgtccggctggctcactgcaccgaaataccgaatgatcggcaacctctcgtcacctattctgatcccaagctgaggagtcgtggagtgacactcaaatgcatgcattgatcactgataagtacgcacagattgcagctgtactaacgaaacatgaatgaagagatatgatgcacgcaaaaacaaacgggtgcggatttaaaaacgatgtgaccgaaccgaactaataagagcatgatggtgattaggattagtttgtttagatgtcctattcattagctagcttgttatggaaatttatgctactgcttgcttgtcaattacacgctgattaaatgaacatatatggattaagcttttttttttttaacaatccttagaaaggtactactcagcaagagattctgatctgcagttgtaggagcaattcttttaactgatagcctcatcggatggctatatgcacaaaatacgccaaatagcgtattagcgaaaaactataatgtgtgattaaaacatttacatttattttctttgcgacttaaacgattatgttgtaaaagaaattatgataaaaaaaactcaaaaactactttaaaattaaattaaaaatttaaattttagtattagcatatgctggttgagccaaaagatgaaagcctgacacaaccaacacacgcacaaagggaatcaggtaaagccaagtcgacaccttaacgaacgatctgttggccgttttccctcgcatagctaggttttgaccagttttgattccccgtggataaaaagatcaccataggcgactacgcatcatacaccgtctgcagcttgacaaaaatgggagcacgggagatgcgctctgaatttctcatttctcaaatcaaagcgacagcttaaccgactctgtctaaacccctaggattgaagtattagatcaggctgtcaataattatcgtagcatcaatcgaactcggaaatacatgcatcgacgaactgatcatttatgcatacgtactgcaaaattaaatggcactccgtgaacaaggcgaattcagactttcagagaaatgtaacgctgaccgtgctaatataagcttcagaatcccaaatgcataccgctcgtccaataatcaatccaacaagcatataccctataatgctctcttctagagctagcctagacaagtgctccattccatgaccatgtagatgtagctagccttatctgctcaacaacacccatcccattcaattgtccaccgtctttagctcttgttaaacctatctttttcagatagatcaaaaggggagctacgcatgcaagaatcatgttgcgacagtaatggtcgccatggccttcgattcctatatcataaaatcatttctatggatcaagtggtgtcgccaatttctaggatgataatgggtcggctggtaaagttgggaatcatgcatatacatcagactatcagagtgttcagctatccgcactgatgagctgtaggctgttctttttcttccagcctccaactgatatattgtactacgtatattaatttgtagctagtcagccacaatgcatgagcattcagtggactaaccacattgggttctctatgattagtgctaatgcattggtgatcactttgtgttgcttgcctggtggtcctctgagggacacgtgtgtcaccttttcgtttttctttgaaacgtaggtttccaagtgatagaacattatagactagctttgataatggtggcaacaaaattaatcgatcactatcgctcaagagctcagttggtgagagattcggtgcgcattggcacgaaccaactaggtttaatttggctctatggaactcatattaaaatgcacttcattttcttaacgaaaagtaacatatccctccattttctctgtagaaaagtcatagtcactgatgaagactgcatatatgtattgtagtggatcagcgcaacagggtaaatatatgcatggtgcatataatttcaaacattaatattggaagaatggacgtatatagtatgaaaatcatcaaagatttgtttcagagtacgtacttataattcaaatatcatacttcaatgggtacaacaaagaaccactgaaaaaatatttttctaaaatataagtcactacaaaagtaaatggtatttcttccgctttcaaatatttgttcacgttaactattactattccaactttggccatttaataactcttaaaagactagtccatgataaatgaaagtttcatggttatgtttaatgtgtgtaatacatagtatgttattttcttatatatctataatttttccacataaaaggcaaatcagagtttgcaaatgaacaatgtcttacgccagtcttttttttgaaggagtgatgtcaggtaattaaaaaatggagagaatagtaacatacttttttttataagaacaaataattaacgtcaaaagcgtcatacgtttaaaaccgtagtagtaaacatcactctcaagctgtcgccattttttttgtcatcttttacagccttggtgctggcacgcgcttcctatgaattgagatccaatgcagttgtaataacgactgcaactttagcagtgatagcatattatgaccgttggatcgatgcagccaacagcttggatttgctctgccaccccctgcacagtatacgctacagtagaaaattgctacagtgattcgtgaacaatattttctaatgatctgagccgctgatttttgatccatcagctaccttgcaactgctaaagttgcagtgatagtaacaattgtactggatctcaatccgcttcctatatatcttcccagttgaaacaaacacgacttctcatcaagctctagcaaagatatcaacctccactgcgggcactaagcttatgcagcagtggagtcataaacctacccacacttattgaagccacaaactgcaaactttacactactagtatatactagtagtaatataagtatacaaacaatgtatatattttttttttcagacacgtagctcctttacatattcgcataaaaaaaacgcctttcgaattcgagcaatctaagcgtgactattatatacttcaaccaccggtatatacatgtttcaagccatacgaaaaggaagctgaaaaaggagtagccgacggcgtctggtccagtgtatgtcggggaaatcgacctgcaatctgcacttctgcagaacaaataaacggctaccacgacatggagtcatggatgacctgccggtcatgctcgctgcaattctaaagcatatctgatgcacgtagagtagataactatagctatataaagattgtatttagtagcaattaatcagaccgtgcaccaactgagcttggctagctagcttgccagccggacgtcgagttcgtcagacttggagccacatccaacgtccatacattattccatcctcctcctcctactactaccacaacacaaatcattaaaatctcttactcctagcttcattgtttggtttatttgtagaataagggaaacggccatatttgcaaacgaaaaaaataaattttaagggaatttgtaaacgaaaactaatttatgaataaaatttttatatacgtgttcttagcgatttaaaagtttatattaaaaataaacttcgataaaaaaaaactctaaaatcagctttaaatttaaagttaaaaatttaaattttgacttataagtataagtataagcgaaaagataaaacccgaatactgctgcatgacaaatcgtctaggcctgtcaagagaaggacgtacaccttgtagcaatctggagccgagttggaagcagctgtctgactagactctctgctcttctgctgatctcaaacagcagtagcacatctcatgcagtagctcgtggtctccatgaagggatatttgcggggatttcgggtcctctgctggatgttgatgcctgaaagggaggtggaagaagaaccgtgaggacttcaattttcggaagggtgatgaactagctagctgatcgaagataaggtccagtttttcggagggtcgcatccattgattattgctggtgaaatgtcgttgcggcggctaagttagaggggagcactgggaggacaggcgagcacggtgcactgtggacacacaaagcagaacaattccttcctttaatttgagattttggacgtgaacaactaaagtagtaggaatagtgttctctctgcgtaacagtaagaaatgtttggtgcatattaaaaaacttaaaattgcacatcgcactggaaatccctcgttttgttcatggatgaattcacctgaggttttcttcacaggagctagacatctcgaatatatatgtaaaaaaaagtctgtgagttatacagatattaatagcaggtccagtccccatgtacgcttcagcccattccacaaattattgggcttaatactttggcagataggcccatacccaccaagcataaaggcccagcactaatacttcgccattacggcccaaacatccaatttgcagagttctatagctcgtcgtctcacaataataaaagccggggacgatcacgagacgaatagatctttagaaaaaaaaatcaaacaagaagtccatttacatcgtcgtagccaacaaagaaagaaaaaaacagattctggaacgagttgagactttccacattaccctgcacaactcaacccaaacctaaaagatcaagaagagacgattattcattcagttcccctcactgcaaaacacaagtatgagcctacagatcgctggacgacggatggaatcatcatggagtcgacgtcgcgtacgacgcctcacgttctaccgatggggatgatgcactcggcggggaaacggtgcgggaatcgcttcctgtcggcgcagtagtcgtaggccatgtagttcatccgcacccagttgagcgtcatccagctccaccagtccatcctccgcctcatccacccgccgccgccgccggcgcaccgggaggcgccggcgccggcggcgtcccagacgcaggcgttggagacgttgtagcggcggtacgtggcgacgaacggcgcgcgcgaccagtccgtcttgacgcggccgccctgcgtcgcccactcctccgcgttccagatgctggcgaacacgtgcactggctgccgcgtcgggaatggcaccccgtacgcctcgttgttcttgaacaccctgatcggcgtcccgtcaatgtacagtctgcaccaccaacatttttttttacagatttgttacacacaggtttgtctctctgaatttgacgaggagaccgagccaaacgacatatttacaaacgaaaaataatttataaataaaacttttatgtaaatgttcttagcgatttaaaaacaagttctgaaaaataaactatgattaaaaaaatctaaaaatcaaatccaaatttaatgttaaaaatttaaattttgattgataagtataaatataagcacagaaaaaagaaaagatactcctaaaagataaaatttaaatttttcagagcttacatgatgttgtgtgggttccagaggatggagtaggtgtggaagtcggcggtggggtcgaaccagagcacgaactgctgctcacgctcgcccttgccgtcgctgaagatgttggtgtgcagcaggtacggctcgccgctcacgttgcccaggaactcgaagtccacctcgtcgtgccgcgcgccgccgctgcagatctgcgcccgttggtttggttgattaatttaattaattagttgccaatgcgagcagaaaaaaccatcagatatgtcgacgtgtgcaccatgactagctatccaggtatttcgatcagccaagtatatgccttcaggcgaattagtctgaatctttttggataaacttagaaatgttaatcgtggacaccatgacaccatgactaaaactgcctactactgaaaattgaagatgttcagcctggttaccggccggtagtaatacgtgtaatatgcagaaattgatttattttacggctaaaagtgattatacaaatattctgttccaggaaaggtagcaaatgtaataccaacattgcttggtgaaagtgatgcaattttcaccgaaacaaaaataaaaatgttatcatttttctatctctagggcatgaaccgaccaagggtgtacctgatctacatactgctacttaaatgcagaggccaattgaattcacttactgccaacatttatgctgctgcaagtacaaaattcaccccaatcaccgctcaaccatcccatctgctaatcgaggaccaaacttgttaatctgggatgacaatcttcttcttattattttctgccccataaagtaaagctcatcccaagaatgacaagtgtcaactcgtggaattcccctggtgttcctctgtcgtctactactaacaatccgagctactttaacgggatgaacaattcttaggatttcacacaaactagggggaaaaatcgaacaaatcaagccaagatcgatcagaagactgccccaacttacatagaaggaagtgatggtccctgcagactctcccctgacgagcttgatctcgagatcgaacctcccaaacaagaaccgctccttggactgcagccgcgcccccgtctgctcgtccagcgtcagctccaccatccgcccgccgtcccggaacctcgcattgcccttcccccacacggcgtcaaagtcccggtggaaattgtggtcgccatgccccgccgccgccgccgccgtcactgccgcagctacgacggcgacgagagccgccggccacctcaaccggagagaggcgccaccacgcatgtccgcgcacaatgtaaacgcatgcacaaggcacagtgacagagctccaccgatccgcgaaatgcggcgtatcgaactgacgagctgcaagaggagatcagatggtagagactagaaatgaaactggaggaaatggaccagtgtcctgcgaagaagacagagaaagagaggagagaggtgaagtgaaagaggatgtccaatttaagggcacgtaggggtggcactttcgccagatgccagaacgaggcggcatgcacgtcggttgctgcggcaggtagccctgagccccccagccatgcggcgtccactgaaatcgcatcgtacgagacacaaaccacccatgaaaaaactcaaaaaggaatccgacgagcaacaggacgtggcacagagtcgacggcgccaggggagatcgagcggtgaaacgtagtagagagtagtgtgggcgtatgggtcgcgtgtcgggttggcaatacgacgtgtgagcaggataaattagctcgaccacggtgttgctgcaataaaaaccggcgggacgggacggcaaacggcatgcatggcatgagtgcgcggcacgaacggagcggaggctggtctggtggtctgctttgatttcatctcggctggccgcggccggtgcgggcggtggacgacaccgtggactggtctcgagcgcggccgctgggtggtggttggtttccaaactttaaatgcgagcgatcatcccgtcgggtcgtgcggtacacgcgagcatgcctctccgctgcataggcgtaggacgcttaccttcgtgtagcgaagttagtacaatgcaatggcttcacatgcgctgcgaacaggggcgcgggcagtgtgatattccaattctcgtctcttgttgtgacttggtcgccggtgaagctctggtagcgtttttactgtggcaagttatggttgatgctgtctgttgcatgtgaccctgtaggttgaggaaattaggacctgtactgcggtgggattcggtggataatctggtgatggcgtgatgctaatggaacaagcgacatgattacacgacccgctcgatgcaaattaacagtcttctctctttctttagtcagggcacaagaaatcagatcgtgtcccatttttttctcttggaatcgaattgggaaacagatatctgtttgtgtcttgaactcttgatgatactactactgagtatctatctagtgaggcatgggatggatgacgtcaccgtgaagggtgggcgtgttacggcccacgggacttgtgtattgcctgttgggcctcactggggcctggtaggtatttctcctacaaggtaaaaaaaaaatcataactatcgatcaagtcgaaattaggcaggtgaagtgggccgtattccaaaattttcaatgtggttactggtgagccggataaaggctgatgaagttacaaatgagctgggttggcaagctgaaggaaaaagtatgccgaaggtccttaaacttgtcatcgagttacaaaatcgtcccccaaacataaaaccggatacaatacatccccaacattcaaatccaatgaaaactaagtctctcggcagttttgacttcggttttgttcgacatgaccgctaacttagcgtgggacccacgtgggccgacacgtcagggtgaccacgtcattatcatctctttcctctctcccccctctctctctctctcccccagttgtcggcgacgagaggtgcccatttcctccaccagctagcgcatcgccgaccgccacgtaggacaaaaccgggggcaaaatcaccggaggacctatagtaaacggtttttgtaagttgatagatgttatatatctaattttgtggttgggggatgattttgtaactcgatgacaagttgagagaccttcggtttaccttttccgcaagctgaatacaagttctcatttcccgggcttcattcggcctgacaattggaccttagcccttaagttgggcttatttacgaccaactaagttaaaatcgaaggaaaatgatacatgtacagaaatgtgtttagaaacattttacaaaaactgatgtggcatttgttatatattgtatcttgttttttcgtaactatccactgattaaatccaagtttgtaagagtttagtaaagttctttttaagtacgtatagcattactcagaatcgaatcacaacctgtgattaaaaaaataatttctaattccaaattggttctaatgcatcatgtggtgacagtttgacagaagatgatcagaactacgctgcaaacagtggcacgagaagcagtttgtgcaaacaagcgattgggtgcgaatcaaaaattttaagcaaaacatggctggttgatcaaaccgagtgcgagcattagttttgtttaatccaagcagatcttatcgtttccaatataaaatggttcgacgttttcgttagcagtgttgctgcagctgcagatgcgaatgttggtccctcggttaaattaatcaaaaccggataagctcgatctccccccacgcaaggctccagttttacagggtgtccattgtcgaaggtggccagtctggctggcacgcccagtactagtacaggtttatttcagcggctgagcacacggaaaacatggccaaaacccacaaagggatccatcttctggctaaaagcagctcactaaaatttatcaaacttggtacgtacatcgaccccgtgttacaaaaagatatcaaagaatgcgatatgcatactacatttacatctccgtggcaacaaaacacattcattattcgccatctgacgtgctcttctcatcatttttttcatcgatgacggatcatgcatgcgtagcgtacgttatgatcatcttctcgtgtcgatctcaacggagcttgcactcggcgggggtgccctgggggaaccgcttggcgtcagtgcagtagttgtagatcatgaacttcctctgcacccacctcatgcggcggtagctcatgtcgctgagctcctggttccaccacccgccggcgccgcccctcctgccgccggccggcgctgcgacggtctccattgtgccgacggggcagcgctgcgcgccgttcgaccagacgcaggcgtcggcgttgaagtcgcggaaggaggcgacgaagggggccttgctccagtccgccttgacgcggccgccctgcgtcgcccagtcgtccgcgttccacaggctcgcgtacacccgcatcggctggctcttggggaacgccacgccacgggcctcgtggttcttgaagtccctgatcggtgtcccgtccaccgcgaatctgcacgcaccaccaacacgttgttttagccaaaacccatcgagtatcaaccatgcgtctctgtctcgcgtaacaacaagaggggttcacgtgccaatgtggaagtaaagtaggggactcacatgacgtgctgtgggttccagatgatggagtaggtgtggaaggactgggtggggtcgaaccagaggcggaactgctgctcgcgctgcccctgcccctgcgtgaacacgttggtgtgcagcgtgtacggctcgccggtcacgttccccaggaactcgaagtcgatctcatcgtgggtcgaaccctgcgacgacaactgcagccacaagcacagaagatcacacaaaccatcagcttcattactccactttagttccgtttttttgccgaatttggtagatgaataaatgatgaagtgatgagaccgtttggggaggaagataagcttacgtagaaggtggtgacggtgccggcggagttgccggggacgagcttgatctgcatgtcgatcttgccgaagaggtactcgctcttggactggaacccagagccggagctcctgtcaagcgtgaggtcgagcccacggccaccatcgacgatcttgccgcggccctgcccccacgacacctccgcgtcctggaagaagttgcctccatgcgcaatggccaccaggcaggccatcgccacaatgccaagcgccaccgtcctcatcgcgcgatcacaacacacaagaacccaaagatctagcaagcgagtcgaagcgtgaggacaatgagagctactgggatcagtgtggattggtcactggaatgggatggcgaagcacttgcctatgagccggtatttatacttgggcgtggccggggcagctagcaatagcagagctgcgggcagacaggtggtatccgacgggcaaatgccggctggggtggcgcgtcgcgtacacggttaaagaagtaaatgcggcacggagcgcgtcgctgcagagcgccggatagatttggggcgggggcgatgcatggctggacgcacgctggatccagccgccgcgtgcctacgccggggtgtgggggccagagacgcgggggactttacttgaccacaccacacccatccccgcggcggcatccgcgaaagcggtaacccgtaaaccgggcaggtgatgcctgccgatggacggatggatgcgagtacgtggtaaagtgtgcagcttttgtggcgcttttgctcggctttgctcgcggatcgtacgtcacacggggccgcggccagcctcggctttacagttcatggcctgcagtgcagttcggttcgcgcggaagcagcagatcgtgatccggacggacgagccaacacgacggcattgccgccatgtgcgcgaaggcctgcgattcggggaaggttcgcctggtttgccccatgggcgaaggaagtggcccggccattccatccagggcatcgacggtcgatgcacatcgttcgtacgtactgtacgatgagcgagtgatttaattgcggtcacaaatcggtctcgaggacgactgttgctgctggtgagagtgtaattgcgcccttgatgtgtctgttgggagtttgtgttttgtgacagcggattacacgctgtgatttactggagtagtggtaagttttcaatacctgaaaggttacgttttgattgatcgagttcgggattagtaaggacgacgtccgtagatgaatcgtagctgggctctttagtactccgacatgatgccgttaggtacgggcatgttgattacgacacctctggccaaatgatgaacagagtcgccattggacttgtctaggagggagacaattgattctctggccaaattcttgcgtcactcaaccctaaagatggataactattttttttaacacctaaaatgattacacgtcaatatattagctaaagctggatatagacctaacccgctatatgtaacttgcactgtggagcatgcagcttatactgttcttgatctacgtggcatgtgaagaacgataaaacttggtggcgcgctgtgagtggccctagattgatgtgaagtggctaaggctcgcgagctagactagtgggctacaactttcttgcctcatgattgcttgttatgtctaacgtctagtcgactcaatcctaatggaggtaaaacattgtaacccttaggaaacagcatcatgatctaagtagttaaggcctaagagtatccccagcagcttatccaaatttgattctcggtacactcatatggatggccatcaaaaaaagattccttcttcatatccttctcactccaatagatcatttatatttcatactccataccacatcctcctatcttttactaatatctttcaactaagcatatatttgtattattttctaagggctatattttgaacaactaaattttaatagttttattttatcacggtaatctaaatggttagattttaacggacatatttctaatagataatttagtgcattaaattgctactttctctaaaattactcagactatgtttctcttttttctctacccatagtctgccttttgcccattccaatatattccaaccttttctattcctccttttctctctgctctgttctacactcttcattctacccaggaagcatgcgtggaggcaaggtggcctgcgagcgcagaggtacggcggcctgtcggtgtagaggcacggcggcctacggacgtggaggccggtgggcgcggaggcaactggagctagcaggatcgatggtggcggccgacgggcgtggaagggcggacgaagatagcagcaaggggcggaggcagtcggcggggcgcgcgcagggccgacggccacaaccggccggcatgaagggttggagggatgcatgctgccgctggcggggttctccttctagatctggtatgtctctctctcaccctccctccatggctacacactccctctacaccatccaccgtacagaaaaatacacatccgaccggcgacgatgacaacataggggaggtcgatccaaaactcctgataggggtgggagctgcggccactgtgatatagcgtgaggagagagaaacgctatatttgggcttcctctctccgttttggcgcatcatctatttttgaagggctagatggcgtatccactggggccccgtttttcactcccgtgcactgtatctcggacagggtatccgatagaggatctcctgatgctctaaggctattcccaacccaataattagaatgatgtccatagcattaaataaggtgccacctaggatgaaaaatgatgtggcaagtgaataaatgaggaaagagaaggaaatcatgtctacacaatatccaagacatcatgtgtgataaggagcattaaatttaagtatggaatagtaatgcttgtattaaaagagtagtgtctagtactaatttcttgatgatgtggagtttatagaaactatctagtgttttgggttgggaatggtctaatggggtgtaagagtcgaagacccccgttgtccgtacgaccatccgaaaatgcaagactcccaagtcaagtcctttaccacgcatagcatgcaagacttgtctgtcacacgacgtgccacgatggaacccacatggcatatactgcttcttttgctggagatctcgtactatacaatacacctggttccagaaacttcacaagaaatctagctggccatggcataagcaaacattcagcaactgcatccaataaaatccaaataaatacttccacagtggcagcactgaagaacacctcggcatccactactcagagacaagcaagcaagcataagcattattctatgtactgccatagtgccaccacaccacaacattcaaattcgcccatgcctctccagtagaaatacggagaagcagaaatgatcatcatgccacatatcctcgcaaacaacagctgtccgctttgtccatttcagcagcatgcatactggtgccagccaacgagccagcagcagaccgacgcaaacgggtactgtacgtgctgtggcgaggaagcagggtgggccctcgacgcaaacggcatgggccgtgcatggtttatggtttatcatgccctcattgaacgattcaaatcattgctgttccaaggggcacgtacgacgcagacgcgcacaataattcccgtgtccccgaccgacgcgcccatgcacgcatcggggactcggggtcgacgactccggcggtgcgcatttgtggcttctactgcaatattgccgatccatcgatcggtagtcggtagagcagctctgccataaacttggacttaattggttacttagccaaaagcccaaaggagaatttgcagctagctaggtagatctgatacagtgaacacaacgcattgcaactgaggggtgtttaaatctaggattataaagttttggcgtgtcacatcgggtattatatagggtatcgtatggggtgttcgagtactaataaaaaaaactaattacagtatccgttaataaaccgcgagacgaatttattaagcctagttaatccgtcattagcacatgtttactgtaccaccatattgttaaatcatggaccaattaggcttacaagattcgtctcgcaaattagtcgcaatctgtgcaattagttattttttagcctatatttaatactttatatagatgttgaaacgttcgatgggataggattagaggttaacatctattgttattggtaaaaaaagaaccatagattaaattgttggagtactaagaagaggttaacatatattattattggtaaaaaaagaaccacagattaaattgttggagtactaagaagaggttaacatattattattggtaaaaaagaaagggttaattggatccatgccactgtaaatatgacaaatcagaaaaatatcattactattcatgaaatcgggtagatgctactccaatcttctaaaattaaaaccataccactccatcacgatttccgtcctctccgtcacatttttcgccgtctccgtcttatcttcgtctcggtgcctgaggaggagggcatggcggcacgccgccctcaccggcgccgagctccatgagggagatgatagccgggcttcctctcttcgttgaggtggttgcgctgagagcagacaattagggcgatggcgcaaagcggctgaaacgcgcggtggcagcggagagagaaggaaatcgttgggagaagcggccagggcatggcgagctcgggctaaagttgggaaaggaagaggagacccatgaatttcgtttttgcaatcaatttaagaagaagagcaactgggaggtcgtattcgaacgggaggcggaggcactgcgtacaggcacggccgcacgggacttcgtatagaggttgaagacgatgtgctatagcggaggcgcagcgcacgggcacggccgcgccggtgaagcccttccccatccgccgtcgttccccatccgccgccgtgctctcctcctccggcgccggtttgtccgtcgagacgaagacgaagacgacaagaagataacacggagacggctgaatgtgacgaagaggacggaaattgtgatggagtggcatggttctaattttagaaaattagagtggcatctacccgatttcatgaataataatgtcatttttctgatttaccatatttatagtggcatggatccaattaactaaaaagaaaatggtgtgataacctgtgtttgaaagaattcgagctcagaccaatgcatagctctggcagatcccagctagtcaagcactcgagctagcagccgttctcaacggaaccacagattagcaatttagcattgccaggctgccagcgacaccacttggctgtgttcagatatgggaagttgggaactaaactctccgtacggaaaacggagcggtccattagcgcgtgattaattaaatttttgctattttttttaaaaaataaatcgatataatttttttaaacaactttcgtatagaaactttttactaaaaacgcaccatttattagtttgaaaaacgtgcacgcgaaaaacgagggagaagggttgagaacatgggattgcaaacaaaactgttcgcttcacatttctactagttttctaactacactgctaactgcttcactgtacccattttgccattgagtcagagtactcgcctgtactgtacgatgtagttacataccaatacggagtactgcgattttcagaccaaccgtgcatgggatactcttgcgttttcggcttcacatcagttacagtacacgcgacggtcgggccctacgttgtaaagccacctgatcaatgccaattgaaacgttttaacgctccccaagcacgggagttcggtgactatttaaggttttgttagcttgtcgaattgaatgcatggatgcgtacatacatttacatacccacttgtttcactttcacctttcctccgcacgagcgacctaacaattttaactgatttataccagcacaagctaaggtagcgggagactagtgcaaccacgctacagacctactccctccgtctaaccaaaaaaaaaaaaagacaatccctgggtttccacgtccaacgtttgactgtccgtcttatatgattttttttataattagtatttttattattgttagatgataaaacatgatcaatactttatgcgtgacttatctttttaattatttttataatttttttaaataagacggacggtcaaacgttggacacggaaacctagggtttgtcttttttttttttggatggagagagtatagtacaggtcaaggaaacgatgcacttttaacttactgtaataaaaaagaaaagaaaactactaaaactccagctgcagcctgcagaaacatgccgtgcccagagaggtgttctctccgtctcagacaacaagcaagcaactaatcaaagccgccggatcttccgattctatttcaacttgaaagagcaaaaacaatcaagttctccgggggattgcattcggtgtttgggctctaaccctttggtctgtgaaattgtgagtccatgggctatggcaatcttactcttggacttgaacaagacagacagctatgggctttgcggtaaggaaataaaagcccaacccaatagtctaacacggatacgatcttttggtttggaataagttcatcagaggtcccttaattttacgccgaatccgattttcgtcctcaaacccaaaaactacatacaactggtccctgaactattaaaaccggtgtaaatgaggtccctcgacgtttttgaaggttgttttagctgacgtggcgcctacatagctggtttgactaggtctacgtcctacgtggcattgacgtagcgcttacgtgacaattatatcatgaaaaaataataaaaaccatagccccacatgtcagctgcacacaaaaaaaattaaaaatagtggggcccacgtggccccacatgtcagcctcactcctcccttctctcttcttcatcctcactctctcttcttccctcttccccctatctctctctttctcttcttcccgagcagcggatgagcgggtgggcagcagagcaggcgagcgcggcgagcagtccaagctccggcggcggcggctcgacgtgcgccgcgtcggggctaagggagtcggcgacgggggaaggaggcaagcctcgaccggagagaggaggcctgcggtggggtggtgggcgcctgttgacagaaaacacgaggcctgggagatctgcttaactccagtgcaggtccaaagctcgccttcggatgtatgagcgtgccagttgatttgatcctgcaatcaacaagagatagaacaaagaaaccgcaattaatcctataaatgatagccgatcggctagatgccgatgacatatcatttatttcaagccgatgtcatgcgtacatcgatcggcaaatatcaataagcaattcagaactaaatctactcgatcaactgtagacattaatgatatataatccttatatcggtatatacttaaatcaagtgattgggatatatcggtcatcttgccgagacagtataaatcacttagatcgaaatatatattaatagtaggattatatacattaataacatagctgatcaggtagacctagcatgtatcggctaatactccgataccactctatactaagatattaaagcaagtagaatataccaaacataaccttaatatacttagatgcaataaaatcttaacataaagggcagatttaacgtgtcaatcaagcatatagaataaaagtagttaaatcaggtaagatcggctgaaactccgatactacccttatcggcaaccagaaagcaggctaaagattgcaattctaagcacgacttaatagatcaaactcaactgatgcagcattaagtatgaaaagaagaacaatatctagacaatcaagccgctggaagtttcatagagtggtagatatatcacataatctaagttaacgtcattgtctaacctaatcggctgccttccattagcagatgttagccgattataggttagataaagatattatcgaagactatgtgagatatatgataactcgacgaattatatatacaagattagagtgtcataaagatggaagcactaatcctgagaacataagtcgtcacgacaagttttacctcttgttgaagatcgaaaccgatgcagctcaacccgagagcacaaactcgttgaaataaaagtaaagcaaaaaagggtggcgatgcgccgagattgtattggatgtgttgtctcgtttttacatagggctcgggtctatttatacccgagaattacaagatacgtccataacggacacgactattatctctaacaaactctaagataccataagtctttacggcagacttttgtccaaacatatctctaaggaaattacatagaatatcctaattaataaatataattgccttcccaggactctatccaagcatggcaatcaccttgaagcacatcaacttgaacccgatgacgttcaccgggtcatattatcggaatcagctgtatcggctagccccgtgcaactcgaactctgccgatcctgaccttagccgatttagactgtagccgatttttactctgtctccgcaacgatcttcatcttggattccacttcgatctgatcttcatctccgatgccaatagtgatagaatttaccaaatttggtcgttaacacatgccccccatgtccgaaatattggataatgtttcagatttgccatataccgactctgagagaaactcgcacttgccgttttcccgaccattatcgctctgctttaaatactaaccgtcgccccagagaatctccacgccgtgatctccgttttcaccactcaagcagatcccgtcttctctctctccggcgacctcctcgacgcgcagggcgatttccaaacgattccactcccggccagatctccacccgcgacgatgacgacctccaccagtccgaccgccacatcatctgccgaatatgctgaggtaagtcctcatcggctagatcccttttccgttcatcagatcggttttcgctcgccttatcccgttttctccttctctattcttgtagcatctttccaatcttgttgcagttcccagtctgttgcatgaccaacaatactttctcggtccaatcggcaatctagaccctactgaatttatcatagccgaaaccaatagaactccttttaggtcggccaatccaaacacaagccattggaaaaacaccttcaaatcctggccttctctggagaaaagctggcctgtatggtataagcggatatcggctagcaagcaggcccattgggatgagatcggaatcagccaagccctagccctcacagtagcaaattcggccaaagatgaacccctgttggcggctgcaacttatttctggtccgacactctcaatgcctttcttttcaatcaagggccgatgaccccaacgctgctggatattatcatgctcactggcctagatgtaacctcatcggctaaccccatgagcctaaacaccaagaacacttttgagttcaaaactaagagcattgggggttggtcaggatatatcacagcatatatgggcaaagggccagtcactcctaaagaacacgtagcttttttgctgatgtggttggaaaaattccttttctgcggatcaagctgcggtcctacaaccaactggcggttcttagccgaggccctagtaacgaagaaacaatttcccttaggcaaaatccttctcggctatctataccagatgttaaacagcgcatcggccaaaataattatcggctcagtggttggaacaggtggatcatggtggctctttcaatcctggctgaacctggtagtcatgaaggttttcaatcggccatctgtgacagaagctgaatttccaaggttggagccgattgtagaagatgatggagaagaacgcacccatcgcagatgtatgtcatacggagagtatgcatctacaccagctgatgcaggagcaaaattatcggctgaacttctgaaggactggttcttcagcttttatgacggattccaaaaaaatgcccgagtttggttcttctatgccgactcaatggatttcgaactgccagccgatttcaggttcgaggatattaatcatgaaaagtttcagcaatccagagaaatctttactactgctatcagcccatgtatcctcccagggctgcaggaa

SEQ ID NO: 24024 - DNA, 3340 bp, Oryza sativa
tatcactcttacttaaataaccaacagccgatttaaaccttaattaaccttttcttctgatctgcagacaacagaatcttctccacctcgccggagtaatagtggtaaagacattgaatatgccccaagcttgattcccaatggaggtgggccatctccttctgccatcggctacaatgcccgaaagacctcagcacttctccgaggactcatcagagaaccagccgatgccggcgagaagcggagaaccagatcatcggctgcagatccttcagccccggctccgaagaagaaggctaagacaaagaaagctaagccagctgacgatctacccaccctagatccatccatcgaacaagctctggatgaagaagaaattgaggaagacatcgaccaagctgcagccgaaataagcgatactgaaaaaacaccatcggcttcacctaagcaggctcctccattcccttctgctccagctcaattggcaagggtaagcaactttctctgtccacttttgcagtcatctactttatagccgattcctcacaattttaataaatatagagaaagaaaattgtcgtgaggaagaaatcggttactccaacccctaaaccagctccaccagtaagatacttctatcatctcattaactgacttgggctgattatatctaacatttatccctttggcagcctcctcctcctccttcttcccctcttatgcaggcagaatcaggcggccgcactccatcggctgcaggcagtcatcatgttgaagaggaggaacaattagctgcacctactattttagtaagttttattaacataaacttgagatcggccaatcatatcttgatccttaatcatccatgatattgtctcttgcaggtcttagccgatctgttctcctttgacatcaaagattacctcgatgaaacagaagaagacaccaccagtaaagcaacagctctcctgtctgatgatgtgaagaaaacactcgaagacatctcccatcggctaggagaatcactagataacctggtgaccaactgtggctcgatccgggcaaggtttgcagatatccaagcctctcttccggacgaattagtcgatgctcttactccagctgcctacctcgagcagcatcaattcaaactggagaaagccaggcagaggttagccaatcgccgggaacgcaaggacatcgaggctaaaatccaaaccaatcgacagcttgttcatgaagagaaagccaagcttgatcagttatctgaaggcccaatcaaatccaatattgatcggcttgaagctcgcaagattgaactcttggcacaacttcaagaatgcaatgctgaactggatctagagcataggaagttagccgatctcccgcaagctatcgaagaacagaaggcaaggctaaaatcggctatcaagaacattgctgagatgactaaatccttgaaagtcattcctggaaccgatgctcaagacgcccaagctatcgaagaaataaatcagattaggcaaagggctatatcggctatccagcgatacttgtctcagtgatttccatataatagtctgtaggaaattgttgtaatcggctaagacaccctaattactttgctgtttaacacatccaattttctcaaaattttgcaattttctatgtatgtgcccccctaattttacaatgttgaaaacattgacaaaattatagaaacgactaagggcgatataacaatatcggccattcgtacatgggcaaaccacaaccgattacaatagtgaaaagcaactaagggcgatataacaatatcggccatcccaaggcgatgcaaacacatcggctatcatgcatcgacaacactagccgatcatgcattaacccaaacactgggataaaacttcttcaagtatttgccatttagagctcggccataaacttctccatctagtccttgcaacatgtatgctcccttagacaccaccttatgaatttggaacagtccttcccaattcggcgaccacttgccgaatttgctatcccgagtcccaatcggcagaatcaacttccatacaagttcaccttccgaaaagtccttaggtactactttcttattataatgccgggcaactcgctccttatccctagtaacctttgcaagggctcgtagccgtgattgaaccagatcttccctttcatcggccataaggttatagtactcatcggctgttaaagtattttgcaactctgttctcctcgagctaatccgaacttcccacggtaaaacagcctcatgaccataaacaagttcataaggaggaacctgtatcgatccatgacaagccatctgataagaccacaatgcttcagccagtcgagtatgccattgccgaggataatcagaaatcttccttctaatcaacttgatcaaactcttattagatgcctcggcctgcccattagcttgtgcataatacggtgaagaattcaacattttaattcccatactatcgacaaactgaacaaactcatcggatacgaaaattgaaccttgatcagtcgtaatagtttgagggataccaaatcgatagattatatgctcttgaacgaactgtatagcatccccagaatcaactttctttaaaagaatagcctctacccacttggtaaaataatcggttgctaccaatataaacttatgtcctttactcgagggttgccgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaaagggttttataaaaagaaaaatccctaaaagtccttttccccccttcctctcttgggccggctcggcccaactccctccctctctctcctctcccccgcggcccatcggcctcctccccgcgcccgcgccgctgacgggcgggcccgcccgccaccctcgctgacgggtggggcccacccgtcatcccctacctcgcgccgcgcccgccgcctcgcccgtgccctagcgccgccgccgccgcggattccgccgcatcccgccgtccccgcgcgcaataaagagggggaaatcactccccgtgattccctccctctttcccccctcttttccctctctcttccctcggattcgtttggaatccctcccgaaatcttcgccggcgcaccaatcggg

SEQ ID NO: 24025 - DNA, 10690 bp, Oryza sativa
ttagttctagaatcgtgtttacaaaatagccctgagcaactaaatatctttaaatgctgtttactgcaaccataacccctttatggtataactcctttgtactcccttgcatttattctgcatttgtgggtgtgtcttgttgagtacggtggttgtactcagtcttgctcaatttttcccaaccccagaagaggaattccaggaggatgaaggcttcggtgtctagctcgtgcctgccatcaagcgcctgtggtcgtcgccctagtcttccgctatttctcgtttgtctctgtgtgtgctgggccttcgttgcccatgtaataagttatctaattacgcttccgcttgttaaactctgaattgtatcaacttttggtgtaccttgcctcctgggacaaggattaatgcacgcacgtaaggaatgcccgttgggttatttccggtcgtgacaagttggtatcagagcccctttgaccctaggacgagccgtagatcccaagccttagcaatattttcaaaaataaaatcccttcttatttgtgaaaatcctctagtctctctctgtcttgctgcttcatttatcgccaaaatctgacctttaaaatgttgcttttctttttgtttttgtttgtagatggccggcagcgtcacccgtcgtggtttggacatgactggtttcgtcttggagctgcggggtatgtgcgtggccctagggtatccacacggagtggactaccaggccaggccgcttccggagcaggagggtgatgatgcagagccccacgctgcttgggaggtcactgcagtgatcctcgctggctctcccgagcggtcttcgctgacagtcaccgcgggtggagactccttccccgccgcttgccagagcgccgctctcctcgccatcagcactcttcaccagcgctacccggacgagttgcagcactcgccctaccgctaccaccctcgtcgcggaggagcccgcgaccacgccaccttccgggatgctagctcggaggatgacgctaccatcgtgcacctggcgcgcatggtggaggcgtacgacgcggcttgtatcgacttccatcagatggtgcgccgtgggatggtcgagaacaacctgaagatcctggagctgcgtcaagagaacctgcagctcaagaaggacctagacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcttgccgagcccgcgcccgtggttccccaggagggggaagcctccggcgttggtagcacggaggatgcgcagttgctcaccttccgtcctggcccgtcgcagcagtagacgagcagttagtaggcttgcgcgtgtgttctttctcgtttgtcttgttgttgggttgtgtggggcacggttatgccggtgtgtggtgtaactgtgtcggagcctgtctttattttattcgcctaagcaacttgaactttaatgaacccatttaatagcagtaataaattcaagaattatggtagtcgtgggtggttagctttaattgtcagctctctctgtttgctggttctgtgtggggttttcagatggtgatgaccaggagaagtgctaacaccggtgatggcaaccaacctgaaggcagcaaccacaaccatcagggcaacccacctccacctcctcctccacctccaccaccaccaccagacaccaacgccattctcacccaaatcctcgcccagcaggccaacatgatgactgctttcctccaccacctccaaaatccgccacaacttaatgctccaccaccacccccacaacactctaaactcgccgagtttctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcagggacccgcatctctatggtgggaccatttccaggctacgcagccagagggacagcctattacatgggctcgcttcaccgccgctttccgaagaacccatgtgcccgccggagtcgtggcccttaagaaaagggaattccgagagttgaagcaaggcgaccgctccgtgatggagtatttgcacgagttcaacaacctggcccgttacgctccggaggatgtgcgggaagatgaggagaagcaagagaagttcctggcaggaatggaccctgagctgtccgtccgtctagtctccggggattatccggatttccaacgtctggtggacaagagcatccgcttggaagccaagcacaaggaactggagtcgcacaagcgccgcttggcgaatttccgcaaccaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctccaccgactgtgcagcctggtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtggtaaggacgtcattcggggtcgtgtgaaccatgtgacggccgaggacgtgctgacaactccagacgtcatcgttggtacgttccttattcattccatccctgctaccattttgttcgactctggagcttcccactcgtttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagatagaactgtcagaaattcccatcgtcagagagttcggagacgtgtttccggaagaactacctggtatgccgcctaagcgagagattgagttccggatagatcttgctccaggaaccgctcctctgtacaagcgaccctaccgtatggcagcaaatgaactggccgaagttaagaaacagttggaagagctgaaagaaaaggggtatatacgtccgagtacttccccctggggtgctcctgtgatttttgtggagaagaaagacaagacgaagaggatgtgcgttgactacagagctctcaatgaagttaccatcaaaaacaagtaccctcttccccggatcgatgatctgttcgatcagcttaaaggtgccactgtattctccaagattgatcttcgttccggatatcaccaattacgtattcgcgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgtggtggttttcattgatgacattctgatatactcacaatcagaggaagaccatcagcaccatctccgtctggtattgggaaagctgcgggaacatcaattgtatgccaaacttagcaagtgtgagttctggttgtccgaagtcaaattcttagggcacgtgatatctgctaaaggagttgctgtggaccccgaaacagtgaccgccgtcaccgattggaagcaacccaagacagtcactcaagttcgcagtttattaggtttggcaggatactaccggagattcatcgagaacttctccaaaatcgctcgacccatgacacaattgttgaagaaagaagagaaatttgtgtggagcccgcaatgcgagaaggcgttccaaactctcaaagaaaagctggtttcctcgccggtgttaatcttgccggatactcacaaggacttcatggtgtattgtgatgcttcgcgccaaggattggggtgcgtgctcatgcaggatggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcactcagtcggacctgaatcttcgacaaaggagatggttagaactcatcaaggattatgatgtgggaattcactatcatcctggtaaggccaacgtggttgccgacgctctaagtcgaaaaagccattgcaacactcttaacgtccgtggcattccacccgaacttaatcaacagatggaagccctgaacctaagcatagttagtcgcggattcttggctgcgctggaagccaagcccaccttgctcgatcaaatccgcgaggctcagaagaatgatccagacatgcatggactcctcaagaatatgaaacagggtaaagccgctggtttcacagaggatgaacacggaaccctatggaacggaaatcgagtatgcgttccagataacagagaacttaaacagttgatacttcaggaagctcacgaaagtccttattccatccaccctggcagcacgaagatgtacttagacttgagggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaaaacccaaggtggatatgattctatatgggtagttgtggatcgattaaccaaggtagctcgattcattcctgtgaagaccacctatggagggaacaaactagccgaactctacttcgctaggatcgtaagtctccatggcgttcctaagaaaatcatatctgataggggaagccaattcacctctcacttttggaagaagctccaagaagagctgggtacccgattaaacttcagcaccgcatatcacccgcagacagatgggcagaccgagcgtctaaatcagatcctagaagatatgcttcgcgcatgtgtcctggatttcgggaagacctgggataagagtctcccctatgccgagttctcctacaacaacagctatcaagccagcatacaaatggcaccttatgaagcgttgtatgggcgcaaatgccggacgccgctaatgtgggatcaagttggggaaagccaagtgttcgggactgatatcctgagagaagctgaagctaaagtcagaaccattcgggataatctaaaggtggcacagtcccagcagaaaagttatgcagataaccgtcgccgtgacctggaattcgcagtggacgattttgtatatcttcgggtcacgccattgcgaggtgtacacaggtttcggacaaaagggaagctcgcacctcggtatgtgggtcctttccgtatcgttgctcgacgcggagaagtcgcttaccaattggagctgcccgcctccttgggcaacgtgcatgatgtgttccatgtgtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggtccagtggagcaaccacgccgaagaagaagctacctgggagcgcgaagacgagctgaaggcagcccatccagatctcttcgccagttcttccgaatctcagggtcgagattccgtttaaggggggtaggtttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaaagggttttataaaaagaaaaatccctaaaagtccttttccccccttcctctcttgggccggctcggcccaactccctccctctctctcctctcccccgcggcccatcggcctcctccccgagcgcgcgccgctgacgggcgggcccgcccgccaccctcgctgacgggtggggcccacccgtcatcccctacctcgcgccgcgcctgccgcctcgcccgtgccctagcgccgccgccgccgcggattccgccgcatcccgccgtccccgcgcgcaataaagagggggaaatcactccccgtgattccctccctctttcccccctcttttccctctctctctccctcggattcgtttggaatccctcccgaaatcttcgccggcgcaccaatggagcccgagatcgccgcgccgatttccttcctctccggccgctctctccccctcccaacactatttaagcactccccgtgcctccctcctccgtttccgccgttcgccgctcgctctccccgtcggaatcgagctcgcgccgtcgtcctctctctccgccgtcgccgccgagcttcggttcgccgccgtcgtcgccccggacctcctcctgcttcggcatcgcctccttcggcttcgccgcgtcctcgtcgacctcgtccaccccttcgtttcgcccgccgaccaccggaacgccgccgtcctcgtcgacctgagccgcgccgccgcctctctccgcttcggtcgccgttcccgtcgtcgccgtcgacccggggtgagccgaggaccgccatttcgcttcccccttccctcccctctctcgggcgccgctccgtcgcgccggaggtcgccgccggcgaccatcggggcgcgggcgcgccgcctcccgtcggccgtgccggcgaggccgccttcgggcgcgccccgcggctgccatgtggggcccggccgtcagccgcctgcgccctcgggtgcggctgacgcgtgggacccacggcgccggccggcgcaagccgcttgcacccggtccaccgtggaccgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttatcgttattatttctttgttcaccctagattaaacaaaaccccaactagtggacactctactcatggtgccactagtacaattataggtagatgcttcgcttttaattaggtaacattaggcggttttacaactctagactttgggaatattcatatcacctggacactgtggaattgttggagtattgtggaattggattcacactgccccctctattcaaaatccccaaaaatggtttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgacggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccctaacccctttatggtataactcctttgtactcccttgcatttattctgcatttgtgggtgtgtcttgttgagtacggtggttgtactcagtcttgctcaatttttcccaaccccagaagaggaattccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctaattacgcttccgcttgttaaactctgaattgtatcaacttttggtgtaccttgcctcctgggacaaggattaatgcacgcacgtaaggaatgcccgttgggttatttccggtcgtgacaagggtggattaatcataccgatcatatcaattccccaacctctaaaaggccacggtttaataataggattcatagccgatgctggcgccctttggatcgctccaaacttctgacaatcttgacaacctttataatatctgaaacaatcctccagcattgtcggccaaaaatatccagcacgtcggagcaaccacctcattttatgagccgactgatgtgtaccacatatcccttcataaacttcgccgattgcaacttttgcctgatcggcactcaaacatttaagcaacactccatcaatcgtccgataatagaagtcatcatccaataaagtatatttcaaagctttataacgcaatttccgcgaagccgattgagatggattctgtaaatactgaaacacatcatatctccaatcatcggctgtaattgtagcaatctctatttcgatatcttttatcattggcttatgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttacccccccccttttcataaatggacggagatttgtatagtttccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggtttggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggatcaacgactgcactgcactgcgttacatgcggcgtgacacgctcagccaaaccgcaataaatgtggttaggt

SEQ ID NO: 24026 - DNA, 7498 bp, Oryza sativa
aacccatacacgcggagcaaaaacccacgaggggtcggggcgcctcggccctcggggccgaggggggtgcggctcgaccccctcggggggactaagaggagggcgaacgcatcaccctcgggcccgacgtccctcgggggtacaaggccacgtgtgcgattgtgtctgcctcaaacctctagtcatgatactcctgatcccatgtcaccgacagtagcctccggcgttatgccagggcgatcgccctctttaagggaaacggtcgggcgtgacgccactcctaagtcctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatacccacctcatgcgccgcaagcgggcgaatgggattagtggaagcgtgggcgcgagaaacgagggggcgaaatagtgggcgcgagaagcgaggagccgggcacagcgttggcaagagtataaaggcacagaggaagggatctgtttccttcctttcgccattattccccttgtcttcgccgcttgcaccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccattggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcgacgtgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggtgcaggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgggaatctgaccggcgagaggccgcggatcgcctacgggaagctgaggaggccgcccaggaggccgcccgggctcgccaggccgaggaaaccgctcgggaggaggccggatttcgccaggacgaggcgatggcgacttccgaggcagctcgcgacgaggccgcgggcgcgtcgcttgggcccactccctcgggcgacgctcaggaccaaccgggtcagggggacatccccgagtccggcacttccatcggcggcccgagccgcgtggcatcctctccaaggcggctcttccccacgccttctatcgccctactgaacgcaaagccccttctgcaggccttggccgccgcaaacaccacggtgttggatgggttaagtgcccaggtggaggtcctgcaggcagagcgggcggagctcgacgccgcgtgggcgcgtgtcgaaaaggggcgacgctcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccatgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcgaggccgccgtcaccatccgggaagcaacgctggtggcgcacgaggctgcctgcgccgaagaagagttcacgctccgcctccgcgaggacgcgctcaccgaacgggagcgagctctcgagggggccgaggccgcggcgcaacagctggcggtcaacctgtccctccgcgaggcagcgcaggaggagcaggcgcgccgcaatctggaaggtgcccgcgccgagagggccgtactgaaccaacgggccgctgagctcgaggcgcgggcgaaggagctggacgcgagggcgcgcagcggcggggcggccacgggcgaaagcgacttagccgcccgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattccccctgggagttcaccacgcctcggggcacggctcggttctgggccccgtttggcgattttagccgacccgagcccccgagggcaggattgagcacgagtgacctatttcaagtcaagattcttcaaaaggaaaaaacaacacagatacagcctttaggaaattgaaactgcttttatagaaattcagatataagagaaataagaatatgcatatgttgtagcccccggccaaccctgcacgcccgaggggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgtcgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattaagagctgtcggccaatagaaaccctggcgaaaagctttaccaaccaagatgcgcgaggcggagtgggctccgcattcgccttcatggatatcggcaagaagcacaacgccttgttcccgaggaatgcacttcaggaggattccattagccgcgcgctgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccgtctctcctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctgccacaaaatcggcgagggcctagctcttgatagtgtggcgtggttcaaagtgcaaatcgaactcagaaaattcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttatcttctgtgctgatgacctcggggtcggaggataacaggggcggccttcccacagtggcttcggggccgtcctgggggtcgggggctcctggcgtcgtcgaaaaagcgggcaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcctgggggtcgggggctcctagcaccgtctgacaagcgggcagagggccaactccggtcgtcgggggccttgggccaccgttcggctcgggagcctctcctccctgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacagtccggagcgtttgagaagcttaaataagggtaacgccttctctcccagcctcgatatgaaccgacttagggcggccatgcaaccggtgacgcattgcacatccctaagtttgctggggggg

SEQ ID NO: 24027 - DNA, 620 bp, Oryza sativa
ttttcttgatgtaagttcttttttatgtatgtataaaagtaacaatatggcgcaggaagtgaagcatagaaactgttcatcatctattgaattgctctgacctctgagtttatatctagtagttaaccacttatcattggtataatgcaggcaagggcaaacaaggtgaaactctttgatgcaatgggaacattctttgcaaggtttgattggatccatttggctttcttctttcattgctacaaatttctagcttcactttgacttttgatctaggtcaagtagaccggtcaatgagacacagaactccatagaaactgtgagaccatgtgctgcatgcaatgaatctgaaatgtttctgaagcaaaggccggtaaaattatcttcccatacatcttttctttcttgaaatggttctgaagcttaggcatattggaagtgtcgcactatgtccatgcttgagctttgcttttctttcctcagactggcgaatttatggttgggtgtcggggcttccctcaagtgagtaacatgtgtgctttgcttagttaccagacctcttgttagtaaaaaaggaaataagaaccattcattaatcttgccagaaaagagcatatgga

SEQ ID NO: 24028 - DNA, 989 bp, Oryza sativa
  unsure (1)..(989): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacgcaccattgctacaacttccaaactttggtaagacttttgagttggaatgtgatgctagtggagttggcattggaggtgtgttgatgcaagatggtaagccggttgcatattttagcgagaagttgcatggttctgttttgaatcattccacgtatgataaggaattgtatgctcttgtacgttctttagagacgtggcgtcattatttgtgacctaaagaatgtgttattcactccaatcatgagtcgcttaaatatcttcgctctcaaaataatttgtatcgtagacatgctaaatgggttgaatttagggtaaattgaaaccatgcgattataattttgcatagtttgagatatgccatcggtatctcaatgacatgtaagacccacatgagtcaatgacatgtgggtcaggatggcatatctcaaattttgcaaaattataatggcatggttccaattttcccttgaatttattgaatctttttcttatgttatcaacacaagaaagggaaagataatgtgattgcagatgctttgtctaggcgctatactttcttgtctcaacttgattgtcggatttttggacttgaatcaattaaagaacaatatgcgcttgatcctgattttagtgaagtgatgttaaattgcaaagagcgacgta

SEQ ID NO: 24029 - DNA, 11744 bp, Oryza sativa
atttaaaaaaaccttaataactagcatgcacaaaaatatttcaattgccacaggtgtcgattggagactctactgaagactttaaacaagtttggaaggttttcaaaataagattcaagtctcgcatctcgtgtttcatagaagacctactcaaagagatcaaaggaggtatcccctgaaacctgaaaactactaaccaatagcaggaatacaatatatgttgccaattagtcagcctattggtcatgttacagcaaattagcaactagtgaattgccaaaggagctaaaataatacataagcagacatcttgggttattcctaatatcaactgagaaacttaacataacctatctccactaacagtatgacctttattgacaaatatgggggaaaaacagacaacaagataagtagattgacaagattctaaagtagtacagaaagaactccataaacaataactgtctgttttagccttcccatcgtctaggtgtgtgatctgcagtgtgatccgaacttaattatgagaatatggtccaaaaggaacaaaagatgatataagaaatctcattcagctgaacacaacaaaaaatagactcaagaacttagcacaaggcaccaacagcaactaagttacctggggaacagatgcagacgagaactgtggtaagtttatcttgtgtgtgtcaactctggatggagctgatctggcgtcacaagtgaaactaacattttttggctcataagagaggtgcctccattctctgcaaagatatgaaacaactagcagattaggtactaaataatattattttttttaaaaaaaaagaaggcagtcagattagacaaatgaaaaagcagcttgtgaattccatttaattgatgctcagaatgactgctagaactttccacaatctgttactcttgatgctgaaaggagtcgtcctcatgtgcataagcgagctgaacatggcaaaccttaaatctgacccaactatagactatatactatgtcaaggaaagtggcctaacactatccatggagaaattcaatcattgcagatagtctgtctggacaaaatgctaatggttataataaatgcagataatttatctaatgttaactgctaatagttgacacttgacacatttggataaaaaccaatcattgcacttagggagcaagtatatgtgacaatgtagaaattttagtcagtaaaatttaaaaggtgcatgtagaaggagaaccaacaatgcagcacgttgaaaatatgcagttccaattgatgcaaatcagtatacagtgagatggatgatagaaagctaacgttctgagcagcctttgtatggctgtaccagctgatcaatctcagttgagtttaacagccttatattggtgggtgctaaaacacagtgagtggtgcttttttaaaaaaaaaaaaatctttctggtgaacactgggccccttaagtttttcttctactttaattggtgattaaatcaaagagtactaactagttatagcatgctactataggttgctaataactaaagctgttactgaaactgccaatcctgaatacaaagtaacagctaacaagtagtcttcacaaataaaggtggggctcactgacttagtggcttctagataaaggggatcaagtttcgctactcctctgtaccttaaaccataacatcaaatggtaagctagaaagtcacaatgtgcataaatgatcatcgatcagagtcatcaaacaacagatgagtacagattaaggaaatacatctaccagaacaaaagtgacttaaacttaatgaattagtaataaaacaagtaacagtgcaactgcattttgttcatgacatgaaaaaaaaaaccttgtatcgttctaatcaatagaaaaacagaattgtgcattgagctaatattgttacctaaggacactggaagtaagaatatagccaattgcagtggcaaaagccaaatgaattctaatagccacaacaggaataatgaaacggcaccaaagcattcctgtgacaactgcttttttcctgtttgtgtggcagcgatgtcttgggatctaaattaacaaattccaataaaatttgccaccgcgtgtggcacataaggcaatgaataaattaaagagagcttatatgccacataagttttcccattaaaagctccgtgaaattgcatcaatgactaacaaattaatgctttgctgataaacgctactattaaacacaaattcgtccactccacccagctaaataggccaacaacagaaagttaccaattttgccgcggtgattaggtaccggattagacagagcaagggagtttctcacctgaggaaagttattgaagaggcgagccgctctacttcggcgtcagggaagttcggctcgggctccccggctgtgagctccgagatggcgtgcaccgctctggagaagacctccggtgactcgtcaaatacgcagacctcgacgccatccttaacctcctctccttcagtctggggcagcgcccccgtcgcctccggcagcgccgccatcaccggcgaatcgagcgaagagagcggttgagccgtggaaaacgagaatggggggaatcggccctcgcaggtggggttgttcaatcgagccggcggcccgccatccccgaatattctgccggtttccaattgagatctctacgggcctgtagttatgggctgaaagcgtaacaatgcattaggcccatatagcttctgactttctgcaaggcatgaacaaccaatcggctggtaagcttcctttatcttctttactagttgacggcaatgaaaccaaaaaaaaaaaaaaactaccatacggatgagtcgatgagactaattaacatgtgaatatgcagatttagagacctaggaggaagaggatggggagtacaccaaccttgggaatagttgtcgcggactcggggaggaggcgggacgcgacgggcggcggtcgagggcggtgcgggtctagggtttcggcagtggtacgagtagaggaaggcgcgatgagggaggagtcggcggcgtcgggtgacggggtgagtgcgagcgagaggagggcggcggtgtccaacggtcgacggtgacgatgtgggggccggcgtggctatgtgggggagtccggaggatggattgggggggggcgacgagatgccacgacgggcgggatgggacgacggcaggggggcggtgggttgggacgacgggagcggcagtcgagggcggcgctggtctagggttttgtcggcggcggcgggtgactctccggattggggggcgtcgaggcgtcaggtttttgttttcgttctggaggaggcggaggagcgtgcgccgtttttccgtcgctctcaacgtgtcgagagtcttttaccctattatctggggggcttttaggctgtgttcagatcctaagtttggatccaaacttcagttcttttctatcacatcaatctgtcatacacacataactttttagtcatatcatctctaatttcaaccaaaatccaaactttggattcaactaaacacagcctagcaaataactatttgccacttttagatttagcaaataactatttgccacccctatctcaaaaactatgtgtcacaaaaacttttttgagttagctgtatgccatgagcccaacttttgttgacccgtgtgccattttggatggatggagacataacagaggtgttaggggctgtgtaaagacagttttgccctagtgtacaataatgggtttaaacataataaagatatgcattgaaacattatgtaaattatgtttgatgataatttaatatgtttgtatttgaaaagctaagtatattggatatcataaaacataataaagatatacattgaaacgattatattggatgataatttagcatgtttgtatttgaaaagctcttaaattataaaaactataaagatatagcatgtttgcatgatgtttaaatgcgatagttgttagtggatgatgaatgtggcatattgttaattagtggatgatgatgtggcatcttgttagtggatgatgatgtggtatctttgcatgttaagcttaagcagttagtgggggataactttatagtaagataggattatgctttcagcccataacttcaggcccgtagagatctcaattggaaactggcagaatatccgaggatggagggccaccggctcaattgaacaaccccacctgcgaggtctgggaatacagatgccggttgcctcctcttctgcaactctggtgacagaatcgctcccccgaagcgaactatttctccgtttctttcctaaactctagctatgcatctcgccgtcgtctcccgctccgcacgcaagcagcgggcggctgctgctccgcgcctccgtcgtgtggggctcgcgagagcctggaccatggcggaggcctccgccgacgttgctcgccaccggatttggcgtggtctacttcttcggttattggttggctacttggcttcacgtctcttccaccccaaacaagagcttaattgggccgatctcaagccctagaaggaacttgcacttctcgaccaaaaaacccaaacaaggcctaattgggtcaattccccctatattctcgtttcgcacggctcaaccgctcatcaagccctagatagtgctctctctctctcttcgctcgattcgccggtgatggcggtgccgccggaggcgacgagggcgccgccccagactgaaggacggcgtcgaggtctgcgtatttgacgaatcaccagaggtcttctccagagcggtgcacgccatctcggagctcacagccggggagcccgagccgaacttccctaacgccgaagtcgagcggctcgcctcttcattaactttcctcgggtgagaaactccctccttgctctgtctaatccggtacctaatcaccgcggcaaaattggtaactttctgttgttggcctatttagctgggtggagtggacgaatttgtgtttaatagtatcgtttatcagcaaagcattaatttgttagtcattgatgcaatttcagggagcttttaatgggaaaacttatgtggcatataagctctctttaatttattcattgccttatgtgccacacgcggtggcaaattttattggaatttgttaatttagatcccaagacatcgctgctacacaaacaggaaaaaagcagttgtcacatgaatgctttggtgccgtttcattattcctgttgtggctattagaattcatttggcttttgccactgcaattgaccatattcttacttccagtatccttaggtaacaatattagctcaatgcacaattttgtttttctattaattagaacgatacatggtttttttttcatgtcgtaaacaaaatgcaactgcatttttagttgttttactactaattcactaagtttaagtcacttttgttctggtagttatatttccttaatctgtactcatctgttgtttgatgactctgatcgatgatcatttttgcacattgtgactttctagcttaccatttgatgttatggtttacggtacagaggagtagcgaaacttgatctcctttatatagaagccactaagtcagtgagccccacctttatttgtgaagactacttgttagctgttactactctgtattcaggattgacagattcagtaacaactttagttattagcaacctatagtagcatgctataactagtattattaaccttgctagcttttatagagcaattacacatactgttgtctctagaaatacagtgttattcttggatgatttatggaatggatgattcagaagtcagaagctaaaaaaataccctcatttatgcaatcatgcattcaacataaataaatcagtaaaggctatgtgcgcaaaacctctagaagattctttcaagtacgcctttataacagctgaagcatacagtgaatttcagttgttacaaatggaaatctagttagttctgcatatgccaatggggaattggggattctaggagctacatttggggagcataaagatacacagctcaaaagttctgtaaggctaattttgttagttctcctcaagaccatttaaattgttatggaaaacaaactaaccaagtgtgtcatgaaaatcaaagttttcatatggctactcttttatgatagattgaacaccaaagatatgcttgacaaaaagaattgtgcttcaaaagatgctaacatctcttatgttctgcgctcaactagtataagggagaccttgatacatcttttttcatgtgcccttttagttgaagggacaagaactggattcagatggaatattaatttaaatttgtttcaaatgattgttctaccaagaatcggcttgaaaagaaaaggtttcctaaagattatgtgcattgcatgttggcacatttggaagcagaggaatgaatttaccataatatcaacccatcggtggatcaatggtttcaaaacttcaaagcatatgtgtaggatgaatgagcctttaagatctatagtctttgattagttacataacttgttaaaattccgttttgtaattgtaactagactctatatctatttcttatactagcaaaagggcacgtgcattgcaacaggaaactataattacaataaaagttagataattcatgttaatctttgtgattcgatccctttaagagaaatattgttattatggatcttaacttgtaaaatagtaacgagaaattgtaacataacctttagatcatttaggaaaaaaactcccgcactattgaaatgaataacatggcataacttctattgtccctatgtttttactcgctccatgttgttattgtgcatttgattcgtctaatgtgaccttgccttgtcatgtgatcaagaagttaagaaagtgagagtggttggctgacggccaagtgtggtgatggcagcaaggatagagggggcgaggcagtggcacgcctaactctaaccaacgagagcaagagaagagcagagccaaaattagacactaacatggttagcaaactggatcatgtgtgtcgtgtgttgtaatttggttttggaaacaaaaaagattgtaattagaccataatatagacattgtgaaggaacacgatcttgatggaacactcgaacccaatcaacttaaatatataataaaaattattgtagcctacctatctcaaatgttgacaagtataaggctgtagccaatcaatgtatgcaccaaagttgaaaggaaagagccattgccaaactatataaattactatgaaatttacactcactatattacagtctccagctaatcagaatcaatcaattgggaatactgtcaggccaacgccaagcagttataatttatataggaatatagagtgcaatccattcttttgtacattgaatgtaatcaaattacattcaaattttaattttactgtgcataaattcacatgttaatgctgtatttctggttaatgctctaaattccttagagcacccgcaatggtaaagtaaggtgctctctataaaacatgtacatctcagcaatagattagattaatagtaaatcacctcaatagtatgtctacatggatatctatagctctctcatccattgcctcgtttttctctatagactatctctaagttagtagatagttttactctctctcttcatttaatctcttccaagtaggaaaatatgatgacatggatctcttgtagagagcatatagataaccattacgggtgctcttagtatgtagagcccccacgacctgttggcagcttgcgaatagactcactaaaaatgccaattttttttttaattctatgcagacactgatgagttagatccaacgtcccagacatctcccggccgcaccccccccccccccaccacgcatcgcctccaccacccccatcacgccgctgtcgccgtcgccatcccgctgctcgtctccgttgccgtccccgcccctccgcccccgatctacgcctgggcacccgcctccgcgcccctagatcaccgtcggcctgagtcgccgggctcgtcgtcgccaagccgatcccctccgcagggaggtgcagaaaccctcctcccctactggtcttttccttttccagtttgattcttgcaagttctagagactgatacaatcatgtaatttggaattcaaagttatgtgcacttagaaataataattttgctcatactcaccaaatccctttgattcactggacactcaagtgcaatattgaatccatcaacataacggaatcaaatactggagaggattggaacagattacccccatcaagttggtgaaataaaggagcaattaggacgaccactaaatccgctaatggaacacataatgaacagaaattccttagagcttggagtaatattagcactacagtcactatctttgaaaacgatcaggggagcattcattaccttggcccatgctaacatcagttactcctccactttgactggaacacctcaacacatgtgtcatcattagtttgaacctgtgaacgatgagtttgctattcacttcagggaagtaagctttagtggaaaccttggagcttatgatatcaatctaaaagaccattgagctaaatatatgcaaatctggagttgatttggcaaccacaaaaccaactgatataaatccttgagtccatgtatgaagaaaccacacttcatttttggtgaagccacaaataaaccctaaaaatgatcaaagacatacaatactgtggtattagtacaatgccaatttacaaaaattgaacgaatcatgcatcacaagcactgtttacagaattttggctctgttcatagagaacagatcttcaaagcaaaattcatcctctatttccaattattatttttttgggctttgattcactcatagtagagaaataagagacgcaatagcactgcctgggcattatttgagaagaatgagaaacctatatgtaaattgtccatcctttttctgtacttatagtagcaaatcaatagctcaactaataatgtcattgaccaatggcaaaaaaaaaagatcctataagactgatgtttgaataacccaattaatcaatttttcacctataattttgtaattccatcatagcacaaatgagagagctatgaggtctaacaagaaagaaacataaaccacatcgtttcctttctttttagagcagcacaaatgagaaagagctatgaggtctaacatgagccttctattcaagtattccttgttggaatatgttggtctgaattaaactccatgcactacatttattctacaggaattagtatgctgatagtttacatcaatctcgctgcatgtgcactacaagagaattatgctattgccacaaaaatattgcaacaaacttttattcgtggccagtgcattattctattgccatgtccggtcgccttgtggcaagtagtaaattatattacaacaatttagtattgttgttatactttagttttttttcatggcaattagtgtattttctctagccacaatatattactgttccagtaattttggactctttacaacataccaaaattgttgccacgacttggttaaattgttggaatagtactttttagtaaaacaaatattttttaagtgatgtaaaattttgacgtaactgatatggtctcaattattgtaccccttggagggactgaaatttttttatggcgcctaagcacaggacggtgggagttgtttcagataaatcaacgatcattaatctaactagaatgcctcgtttggtcaatttatttgtttcctttagtgtgtgcatggatttagaaataaaattcaaatgccagtgacaatagttagtctgagcgggagcaatgacctcgccaggccgcatgcacgcaccaccacttgctggaatccttgcctcggagccgtcgtctcgccgtggtgctaggtacatggctgacgctcgctctcgccgaccctgtgtgtgtgtgtgtgtgtgtgtgtgtggatgagtgtgtgtgtgtggagatcagtgggagaccacgcagatagcccagaatttgctctcaggttggggcaattggtattccatagttttcttcagattgtggatctcttcccctcttctgctcacccgatcccctcgtgccgcatgcgcacgaagcctttgcgtgattggcgacgcctctcctccctccttccatcctggatttttcccgtctgtctcctcaggcctttcaaccttcaaatgtgccaccgcatggattaggccataagcaattttcttagaaatgcacatgtcctgtaagaaaatggaatgcttttagttagaatggtgaccctttgtcaattttaagtcttcatgttccacttcaattagttggaatgaaaattccttgtcattcgaaggcttcaagtcccaatttcaatttatggttgtaaacttggagtattagtttatggtgtatcagcattcaacaaagttatgtgcagtttgaaaagagggcaatcggtccataatttgtcttgcatattatcttctcatttgctagttcaagatagcctactaaccactttgtaggaaggtcatcctttcactaattccattttcccttttacatgtgtcgaatttttattaggcttctctgcagctaatacaggaaaattactttagtttctactcagcattcttgtgtgataatggcgttagcagcaatctacagccttttcatcattaacaaatctggcggccttatatactacaaggtattgtttactgtactcctgtttctctttgttctttcaaagctggagtctgaacaccttgcacctctcatttatccaggactatggctcagcagggaggacggacaccaatgacagtctacgcttggcaagtctttggcattccatgcatgctatctcccagcagctgtcccctacacctggctgtgaaggcattgaccttctacaagcccacaactttgatctccattgcttccagtccctcacaggtcttttatcatcctcctctgttgtaaatttgcgtgaaaatctgacctggatgcttataactgcaaagtttttagtattattgggttggaagtcaattattacagtttgtcgttttttctataagtatgcatcctatctctaatctttcactaagttactctttagttgttctgttttctgaatgttgtggagatagtcgcatgaattataagcacataatcatgggcttctatcttgcggttgcaagcatagtctgagtgtgatttacaggctttgcatttgctgaaataatgtttttgtacttgtggcttggcagttgggtacttggggcctgttccttgaagtgggcagcattctcagttgtatgcgttgtgagcatgatcactctcactcgtagcttgcttgatggacaaaatatattaaactaacaaactaacaatagcacactcctataaatggaagtttggacgagttacattgatatatgtgttcaagccatgccaagacttcagttcacgggaagtataaataatgatgaaacaagttgggccaaactaattaaatttagtgcttgattctattgggtattgtg

SEQ ID NO: 24030 - DNA, 4715 bp, Oryza sativa
tgaacttaagtgtgaatgtctgacagaagtgagatatttcttaatctatactaggtgcagatatatccagcaaaaaagacaatgaaagcattgggatatgctgtcctgctcagtatatctttttctatgcaaaacaatttaattggaatgttagagaacatactttcttgactatattgtgccttttgatctttaagtaggccctggtacatctctagagttagttatccagttatactttatttggtgactgaaaggaatgttgctaaattggttcaattgtaaacatagtgacccacttctgtttcatggggcaggtgtttttccgaattgttgattgttagaccaaaaaaaaattcactgtccttttgtggtttgcacttgcctgccgctgatctgtatgattttgcttctgtttcatcagggacaaagttttttgctgtatgcgaaactggtgctcaaaatatcgagactctactgaaagtcatatacgagctctacacggattttgttctgaaaaatccattctacgagatggagatgccaattcgttgtgagctttttgatctcaacctggctcaggtcattcagaaggaccgcgtcacacttctgggtcgatgaatcatttagaaaacatgacgcaccatgtctttgtatgtggcttatatgacatgtatggtgtcagtagggtacttggaattcaggcaagtcattacactgcatcacaaagtccatatacagtgtgcagtcgattccttctagttctgaaaattactttattcctgaagtatcatttgtgccattttggactttatatgtttccagtcgcaccaaccaattcaggaaggtgcatcacacccgtatttgcatttgcatctggcaatgaattcttattgaagagaacatatgaacaatgggcaatttgttttgcaccaatctctatactcaatataacatcctgaatactaccgaaactaattctttaactttaaaatcgcttgtgtgctgcaatattttttgtatgtgcgattaagggtcgtatggaaaataatgatcaatgacattacaaaagctaagaaaattaaaatgtaatattggagcactgtcttcctctaatattgggtatagaggtttaggcccctttgattcaaagaaaattcataagaattttagaggatttcattcctataggattttttcctatatagtccttagaatcaaaggaatagatcttatagaatcctataaaattcctatggattggctaatgccatgcatgttttggaggaattctaacatgaggtaaaacctcttggaactttcctttgagtctttatctctcctctaattcctgtgttttttctgcggtccaatcaaacgaccaatcctgttttttctgtattttgcaatcctctgttttacactttgaatcgtaggaatgagaaaacataggcattcctgcgattcggggccctaacaccattgaattagactccaaagagtgtaaacgacattcaaggggtggaactgttcttgggacatcacgtggaggccatgataccatgaagattgttgacagcatccaggatcgtggtataaatcaggtaaaggaaatgaatgcaattttattacttttcggacactgttttaagaatcaatttacggatagtatgaagattcttctacctaatcgaaacatcttacaatcagcgttgattacaagtttgtgcgttgtccaggtttatgtaattggtggtgatggcactcaaaaggggcgcaggagtgatttttgaagtaagcacgattatatatcatcttgatgtgttcaacctgatcaaattatagtttttactcccaagggttggtagtgtatttcattataaataaaatggactgaaagggtcaattaggtctagagttttttttagggggagggtcgaataggctaattaaaaaacttaagtaaacatggaagcagggattttcggaattttcgtaaatggttttcggaatttctgaaaataacagagcaggcgtgaatcaaagtagattctagatctaacagcctaccacaggaaaatgctagcacaaacaacaactagatttatagtggcacaatcaagcaaagctagaggagagggagaaagtgatatcaccaaagatgttacacacgaagttattcctggagttcgaattcttgagagaattctactctctgttgaggggctcacaaagagccggccttagctaaccctttcttcaagaggttgcacaaaaacttctctttcggaggtgagatctaacctgcacaagcttctcccagccaaccacatgtaaaatggtggctcaagagcgacacctagccgtttaggagtccttaacctctaagagtaaaaaatgatgcaacaaattcccggagatgatgtaagtgctcacaaatctcacaaagacaacaagaaacacccacacaaactcgaatccacacctcacacacacacacaatctgaatcaaacccgagtggaaaggggaaacaagaaaacaaggctcaaatgaatctcaagtgaagcaaagccaagggcatgaaaatatccaatcagtccagcagccctctcaagaggagagagtgggctatgtatagccatagctccagaactggcccgttagagtacaataattgcatttttcggaaaattaattttggaactttcaaaaatttccaaaacagcaaaccaggaagcgaacgatgattttcggaaattccgaaattttttttggacaaatccgaaaatatctagaaccaaaaacaccttcagtagacttttggaacttttgaaaattgctttcggataagtccgaaaatttccagaagcatgtttgacttgcagacattttcgaaaattccgaaaatgagtttcggatgaataggtgatttatttgatcatccatatataaaatcctcttcttcttcttttttttttccagaaatttacatttctcaagtaaatgaattagtgtgctcattgcaatctaggacttatcttctcctgccaacaaacactggttgcatgaagaaaacaaatggatgtacaggcgctgaagcatactgttaatgccaaattttggtaagcaccgaagtcgtcatcgatatagagttagtatcggcctctggaattggccgatggaaattatcggtcaccaacagtaggatttttagtggattcgattaaggaaattaatcaattagaagaagcttactcagaagaggtcgagttcaagaaggatgcgacataacaattcaagacagagtaagtttctttttttacttttaggaaaacttgtttagagtctgatcatgacttatatattttactttatctttaggaaagtatgtgtcatgtccaataaggactagtatctacccatgggtataaatatttatacgcaggttcattgtaatctatctctcgatcaatacaaatttcagcgcatcgccaccctctttcctaaggttttatcaccggcagaacttggcacctcgacgcggttctacattgctttgatctccggcaaaggggcaagccctaacttccgctggctctggcaattgtatctgctatattggcatttgtcaaggctgcatcgtttccaatatcttggattgctcttgttcagttggtatatttgtctacctgatatttcaattctatctttaattgtattgggtttagaaacacatcggtttagttgagattgtctcggttaggtccaatcttttatcttagtcgatatatctctacaatcacaatgctattttaaatggattagttatatccatcacgctgaccataaatctatcggttaacctacacccatgaaatcaatcaaagcctgccattttgcagtgggcatggctagcaaaggcctgaggctagcaaaaaacaaaatttattttttttgtgggttatactcatcggtgacgggctttaccttaaagtccgtttgagttatagtcatccgtgaagggcataagtttaggcccgattgaaattaaagtcatccgtgacgggcgatagtttaggcccgattgaaattaaagtcatccgtgacgggttatagtctacggccgattgaggttaaagtcattcatgacattctttagtctaggcccgattgaaattagtagtcatcggtgatgggcgctagttggggcccaattgaaataggtcatccgtgacgggctctagtttgactagtcgtctgggtcaaagctatcggtgacgggctttacttggggcccgattgaaataacttcattcgtaatgctcgtatgcccgattgagataacttctcacatcagtgacttctatgctgtgacggatgccatacctgtcacagatggggttgctgcctgattgagatgtgggtgactgttgtagtgtatctaagtgtcaaaatctatatctaatatatagccgaattttcaaaacctattgacatcggctagcatcgctacattagcttgttggccgattagctctttgatcattagtttatctatcttgtttcatttgcaggatcaaactgactgccacgtctgaacctgataatttaggacctgcactggacctgcactcgtcgtaactggtaaaaaggaagccccaacaacgagtttttgacagggatgcagaggcggagataggggcaatggtggctg

SEQ ID NO: 24031 - DNA, 2788 bp, Oryza sativa
atggtggtgtggaggcctgaagccggtggcgcgtgtggccaacctctgcgatctcccgccacatttcatcgttcctcatcgtatgcatcagtaaggtcctgatatggagctcctgaaattttaagggtaaaggttagggttgagggttcacactatttccttcagtgaataaaatcaacactataccattgttagaatcttaatggctggctcccttctatgtgcattgtatgcctctccacaagaaaagtaagacgagaacaggaaagactgagctactgctaccgctgtcactatatcttgccgccatcgttgccgtcaagcaatcactcttccccctggtcctacaccctctgttggcaactttttgtgacaagtcgacaagcacgatcgcaacacctaaacgccttacggtgatatagagtcgccaaccacctcgatctagccaaagggccaaatcaagatgggttttgtagaaaaacagctaaaccggctagcagagccgatttagagatcaaaatcagcctctaggccgatttagatcgatatgaggataactacccatctcgtgggcaaaacggaaggttttcaggacaaacctacaaagaggtgtcgcactctcgcagcggcggcggacggtttatggcgcaaaccgacaaagatggactaaaactagggtaaaatagaaaacgtagtaaaataacgattcaaagtaaattgtattggggggttttacaatgaactggccttgtcccttaaataggggttggtcttgccctctacaggcccttctccacgccaaactcgggatagaaaccaaaggaaacacgaaacatgccttcccgagcaaggagacccgagacccgacgaaaacagactcggactcggaccctgccggtctgaccgcccacataccggcggtcagaccggccctactagctggtcagaccgcccacacacctgtggtctgaccggccatgtgaaggaaacccgtcactttccaaacattggcaattttctcctatttcgtccttaggtgccaaatttgggtgtaaacacatgcccccctgcctttttggtgaacatacgtgaacctaaaagcatagaacattttatctcagggcgataatccaattaccggccataggacttcctaagcatcttgccaaatgctcgaagtatttcttcaagtatttaccattaattgctctccgaaaacactgtcttgaagtgtcttcatctccttcaaagtcttcaaacgtttgtcgatgacgtcttcaaaattacttcccatcaaggtcttgtaatcttcaaccgacaagtcgtcttgtttgaaataccgaagagagccaagatttacctcaactggcaaaacggcaatttcaacaatgttttattactcgacttggcttatccattagcctgagcgtagtaaagagaggaactcaacaacttaatatcataagattcggcaaaacttatcacttctttggacataaaagaagctcctttaacgtttgaggaataccgaatctatgaacaatatgctttaaaataaagtcaattatctccgtacaagtaatattctcgagcggcacggcttcggcccacttagtgaagtaatccactgcaactagcatgaaccaatgcccttttgatgacgaagaataaatttgaccaatgaaatccaaagcccaacctcggaacggccatagtttaatgataggattcaacacagcggtaggcgctaattgaacattgccgatccgttaacaagcttcactccctctgtaacatttgaaacaatcatcaattattttcggccaatgaaaccccactctcctaagcaaccaatttatcttacgggctgattgatgaatttcacaaatcccttcatgtactactctcctagcaactttagattgatcattatctaagtaatactccatctatttttcggcgatataatatttgagcgcttgccgccgaatctttcgatcaaccttaagtgtaggatctttcaaatatctaatcaaaggaattctccaagctatttctaactcatgggcacaaatgtccgaattcacaattaattcagccttttaatcaattgtaacgtgccccctggctctctccccgagatcgatcagaccggcgacgcaatgcctacccggtcagaccgctggtaccaccggtcagaccggtcgtgcaatgccggttagaccgcccctggtctatgacttcgccaatttcgtccaaacttttgaaatcaagcatcggccttaagtatatatgttttcttcacataatagccagatgcttggtgtatcaaattatcggaccaaaattcctcctctctagacatattaaaaattataatatccaacaaatatgtctagatgaatactaattcaagtggcttttgaaacaataatcatcatgtcatcaaaacacttagccaattgaagtatgaacaataatgaatcaccaaaatcatatgtgtcacatgcatagattccaataaactacaaatataagtaatcggcttgagcatgtatgtaaaatattaacaatgccaatgttcctaaagaaaaccactctagagcaaatcatcacattgaccattgacattagccgaattactagtaagcaaaactttcatgttgcaataaatatgaaatctatatcttatatggtgatccataaaaacacatatgatttggctttaaataaatatcaaagagtcatgagccaaatcatacttcaaacaaattatatgccaacctac

SEQ ID NO: 24032 - DNA, 718 bp, Oryza sativa
tctctttttctttttgacctatggcccgaagacgctgtagcctcctcttttgagagcgagataagccagaaggtatccacttcggctgtggttgttttccaagagctaagcaatgactcttgatatttttggtcgaagtagaagctccgtattgctctcaattttcccattcttctccaatgcccctcggtcagaccggccacaagccgtcggtcagaccagccaatagggtcggtcagaccggccacaggttggcgatcagaccggctagatgcctcgatcaaacctccacttttgacaatcacggtgtcggcttcgatctcctttgcttgtatggtttccaccgcatctccagtaggtacttgagcatcttgagactcctctttgacatcaacgacctctggagctttggcttctttcctcacccacaccttcttcacctttttcactttttccacctttgatccaccggaccgattcttttgtgggaaacggtcttgtcttggattagatgaatgacttggtactgacttaggtgattccttccatccttgataatacggcataggtggttgaggcatccatggcaataatacataaaaggataaccatatagtgacattgaatatggataccatggcatcacaactggaggtttgtatggagttggtatagttgatggctccgattggtttgatgtttgaccaaatctcttcct

SEQ ID NO: 24033 - DNA, 274 bp, Oryza sativa
taaatgaggttcctgttgtagtgggcacagttggtcaatggtgtgggattacacctaaaccacccatattctaatcctcgttaaggcgaatttgggtgccggttttcttgttaatgcaaagtcaatataaattccccaggttgatcccatttttttagactacaaattctgcaacatcgatattctagtgtctatgacatatatatatatatatatatatatatatatatatatatatatatatatatatatatatatatatatatatatatat

SEQ ID NO: 24034 - DNA, 8454 bp, Oryza sativa
aggttcgtggcacgttgcaccacttgtcagaaagctaagtctcgtttgaatccacatggtttgtatatgcctcttcctgtaccttctattccttgggcagatatttctatgtactttgttttgggattgcctagaactaagagggggagggatagcatttttgttgtggtggatcgtttttctaagatggcacatttcatatcatgtcataaaagtgatgatgctgttcatattgctgatctgtttttccatgagattgttcgcttgcatggtatgccttctactattgtttcagatcgtgatgcaaaattcttaagtcatttttggcacatgctatggaataagttgggtacaaagctattgttttctacaacatgtcacccacaaacatatggacaaacggaggtagtcaaccgcactttgggtaccatgctgagggctattttgaagaaaaatttgaagatgtgggaagaatgtttgcctcatgtggagtttgcatacaattgggcaacacattctactaccaaggtaagtccttttcaggtagtgtatggtttcaaccctcgtgctcctattgatattttgcctttacctactagtgagagggttcataatgatgctatggcacgcgctgaatttattttgaaaatgcatgagtcaaccaagctcaacattgaaaagatgactgaaaagtatagaattgctcgtagtaaaggtaggcaagaggttaagcttgaaccgggtgatttagtttggttgcacttgcaaaaggatagatttccggaattgagaaagtctaagttgatgcctcgtgctgatggtccttttaaaattattgagaagattaatgataatgtatataaacttgagttgcctcccgagtttggggttagtaccacatttaacatttcagatttgaagccatacttgggagaagaggatgagcttgagtcgaggacaacttcaattcaagagggggaggataatgcggacatcactacctcggatatacacaacaatcctccaacgatcattcaaggaccgataacaagagctcgtgcacgacaattaaatttagaggtgagctcgttcctatgttcttctttgtatgaattcgagaatagattgctacctaatgattatattatgattaggaacaatggaggggacaaggagacacttggagaaggacttagagccatggaggatcatcgaggacgtccaagtcaaggtggaggcccaaaccaagtcgacgtcaggtgcaattcggagtccagaaccagtctgcactaaaacgggcgcctaggtcgcatacatgctcgaattggggcgttcattatatggatggaaagctaagaagataacttttccaatggtttaggtcccatgtccaaattctttccgagtcaatgggaattgaccgaacaagttgacgtccagaatctgtcccgctgctgcgtcaccgtatttgggcctttggcccgtgtatcgtgttgaaacctattagggttgtatcgagaggattttgcatgtccctaaactctatatatcagtacccgccgccatctttaggtttttgggttttgcttagattaatctatcgagaacagtttcgccgctagatcggtttgtaagaccccaactcgtgagcttaatcattcatctgcaattttggttgttttctatcttgttcttgtttgtgttcttcgattagcaaacagggattagccttctcggcgaggtcatccgcgtttcgacacgggtgataaccagaggagacgtggtgctgcgattgcgggactcaagagcgtgcgcgttcaagaagccggatcgatttatgtcgcgactccgcccaaatcgctgtgtatcagaacctttcggaagatcgggaaccctagtgcacatcagggctccccacgaccaaaacggccaaaaggggaggagcacgacagagaggaggaaggtacagccggtgaagaaattgacccatcaccgctgtccgcgatgccgagcagcaggattcaggcgcggggccccaaattcgacggcggctccacaggatgcacctgcatcgccaccaccatcgccgggtcctaggtcccagccgcccatcaccgtcgttgccgtcagagacgtcgggaaaagcacctaggggtgaatctgggctggaaaaaggaaggctggaaaaagaaggggggagaggaggagagggggttttctaggggcgacgggagctcgcttgatgaacaagggatagcccagccgtccggagagagcggcgcgcgcgccaccagccgccggcgccagcaaggatggccaaccgactccgcgggcactcctttcgggccacccccacgcgccaccagccaccggtgcccccgaggacgtcggccgactccgtgcgtgtgccctcgggccgccctcaccgcccactcgagggaaagcgaaccacaagccgttggcaccgctgacagcggctggccagctcctacgcgcgcaggccaccaccccatcgtcgtcccgacccactgccgccagatccgccggagggaggcacggatctggccggggccgacctctccctgccagatcctggcgaggacggcgcagatctggccagaggcacctccccaggccccgacagcacctagatcgccggcgggatgtggggagggagagaagagagagtcccaccgccaccgttgttgcggccggccggcttcgctcgagcagcggtgaggcaggggaggagagaggagagtgaggcggcggaggtgcgtcgccgcccgagtcaccctcgggggaggcgacgcgggcgttttctgcagtatgataggtagagtagccgccccctactctaaaggaccctgagtatttacttcatactgaaatgtcatgcttctactcgatgcaatttatattggttcaaacaaaataaatttactaaaatatgcctaccttttgttaaggagaaggtacattgagtcatgacccagttgacaagcttcaagctgatctcaagatgacaagctacaagaaattagtgttgatgtcaatatttggtctctaggagagaagttaggctgatccatctgattcttcttttgtatgattcaatatagtttcccaaatgatatgttggtttgacaatgcaaaacaaaaaacaattttgtaagattgttttgtatatgcaacaaagctgccattcctatttatgaatgaaatcaattgttgataatcatttcgatgtgatttcaagaaaagtatatatctctggtcgattccaattgtgcatataaaaaataatattatgatttattgatagtagcaatacataatagtactatgcaaccagaattgaatcctgctatctgttgcaactttgcaatgcttatttttagtgtcactaacacatgatcatatatttctaccattgcaacaccagcatagaacgcatactaaaagcgttggtgtagacccttgcaacacttatttggatttctagcaatacatagatgtgttgttaaatgaggttcctgttgtagtgggcacagttggtcaatggtgtgggattacacctaaaccacccatattctaatcctcgttaaggcgaatttgggtgccggttttcttgttaatgcaaagtcaatataaattccccaggttgatcccatttttttagactacaaattctgcaacatcgatattctagtgtctatgacatatatatatatatatatatatatatatatatatatatatatatatgaacaataaaactcaaaattatgcatccgttccaatatactaatctagcgaatgcaataaaagttgggaaactaccagctagttacacatgaagtgatgtcccttgctgttgcctgaagcatcaactaattttatttatttattggccgggatggccgaaagattggccaacctatttgattaagatttgggggaaagtgttacaaataaactggacaatgtactgtcgaaggacctacgtaacagaaacaactgatagatagggctacaagctctacactcagattacataaaaactctcttgatgttgtttatgatcaactcgcttggtttgaaaaccagattgaaaactctggcattctgcttgagacaaattttccactagagcatcaactgattttgtttaaggaaactatcaactattaaattcgtgtaaaatcaaaggtgtttttgattattattctgtgatgaacaattgggcattggagattattggttttgttatttggaatttatttacgaagtggtttttggagatgattggatttacaggtgaatctacaggatattgttgtgattttatgtggaccggtcagaccgggttggtgctaccggtcagactggcgtgtattgcgcggtcagacgggctggcccgcggtctgaccggccaacgctgtgtcggtttcggtttcgggttgtttatttggatatccatgattatttcatgattatggcttctagatggatactatatgtatgtaatactgttgtttgctactaatgagtcaagttggagatagcttggtctcggaatatggtttctttgtttgttccatgtgtaggtgactcgatgtctcgggagagtatttgcggtgatgaatcgggagtcgacttggggataagacgacgtccctggtggtcagagatcatgcgggatactaaggctagagttgatgcacgtggttgatggagattccatatggcatacgatggagttattgtgtgcgtatgggatgcagagtcgaatttggaaggagtccaaatttagtacgattggtcatgtaaagtttctttcttgtactagagggtttactaaggtgtttaggactcctagtatgagtttggttcgtggctttagcctgcctacctcgggtataaatagagggggagcgtgaggcttcccggtatcgcttttgagagcaattgagttgagttttgagttagggttcgagtttagtcaaaatttttgtaaggagtgctgttggtgcactttgtaaacacagagagaagtaataacgtcgtcatccactttaagagttcttcgatttgtgtttcaccgagtttcggcggtctaaccgtcgatatactgacggtcagaccggcgggaagcggcggtcagaccggcggtggctaggcgacaggcgcggcaggggatctcggcggtcagaccggagattcaacaccggtcacaccggcggcatccactcggtcagatcggcagatcaatctcggtcagaccgatctccgtcaatttcgagggtaacttttatttccgctaaaagtttttgggtataccagccattcaacctccctctggttggcttagtttttgctattcgattctacaagtggtatcagagccttgttttcttctttggatttttatcaatctagagtttttgccatggctactcctgctaggttttcaactaagcctcatcttttcgatggaacgaatttttctcattggtgtagtaggatgcagtcttacattatggctgaagattatgatatttggagaaaagtttctcatctttatgtgattcctgaagctattaatactgctgttgaaaaaactgcttttgaacaaaattgcaaagctcgcaacattcttttgagtggtatttctcattcagattatgatcgtgttgcacatcttcaaactgctcatgagatttgggttgctttaagtaattttcatcaaggaacaaataatattaaagagcttcatcgagatcttttcaaaaatgagtacattaaatttgagatgaaacctggagaagctttggatgactatctttctaggtttaacaaaattttgagtgatcttagatctgttgattcttcttatgatgctaattatccacaatctgagatttctcgtcactttttgaatggtcttgatatgtctatttgggagatgaaagttacatctattcaggagtctgtcaatatgtctactttgactttggattcacttcacaccaaattgaaaacacataagatgaatgttctttctcgaaaagctaattctaagtctagtgctttggtttcttcttcttcttctttgtatgtagatgcttcttcatctaagccttcttttattgctgtttttaatgccacatccgatgatcaactcgaacagatcgaggaggaggatttggctttggttgctaaccgtattgctcgagctatgaataatgccaggaacaggaaaagaggtggtccaaatcgttgctttgaatgtggttcaattgatcatcttcattcgtattgtcctaagcttgggagaggcaaaagagaagacaaagagggtgagaagaccagcaacaacaagcccaacaacaacaagccgaagggttcatcccaagagaggaagatggagaatctcaggaaggcctttcaacaagtttgcgccgccttcgagccactaagtgatgtagatggtgaaaatggagacgatgataaggggaagaacatctccgatgtttgcttcatggcgcgtggtgaatctgacacggagtttgaagataatgaggtaggtgcgtttgaggaagctattaatattttgagtgaaaaaaataagaagtgtgagaagatgtatagaaaccaggaatttatcattgaatcttttaaatctcaaattactagattaaaatctcttattcctaatgatgatgattgctcaaattgtgaggttttaatgaatgagatttcaaaaattagagatgttaaagctgcacatgatttcaaaaatagatcttctcttacttgtagtttttctttgcatacacgcactttggatgaattgtttttaactaaaaagttgttgcaaaaatatcaaattgcttttcatgctagtttgatgtttaatatgatttctgctaaaaagttaaaacaacctcatgatgttttggattgctcaacatgtaatttgaataagatgaaaataaaagatgctttaggtcgtgttgagtatatgtaagatgttgtgaaaaataatgaagtgttttcttgccccaaatgtcgtaaaagtaaagatgtcatggtagattgtgaaaattgtgctaatttgaaaaaagaggtttcctacttgaaaaattctttgcaaagattttctgatggtaaaaagaacctcaacaagatcaatcaaaggttagcacacataactgtggtttaggttttaatccttatgctcataattctagacatcctcctgttgtgttaggtgttggtgctagaagtggtgaaattttggttaaacctgataccaataaaactgtgtttaaatctgctggtatcatgtctaccttgaatgcatcttcttcaaaatccaatgttgtgcatgcaaaacctcctattactgcttatgttgctaaatcttctagttctaacaatgtgtctaaacaacgtgaaaaatatacttgttctttttgtggcaaagatggacatattgttgattttttgtttcagattagttcataaacagaaaaaggagagagagattgctttgctaaaatccacgtggcaaaaatctggtgttccctcgagaaaaccggtcagaccgcagtgagtcccgcggtcagcccggcgacaggtcagaccggctactgtgcctcggtcagaccggacactagtcagacatgcggtgaagcctcggtcagaccagcccccggtcagaccggctgcacaccctcggtcagaccggcttctgagagatttttctaaaaattctcaaattgattttgcacgtggatatatgcctattggatcttctggtcgtgtgtctcagtactggattcctaaatttttattattatctaaccccagtactgaggcttcgacttctgcttgtgtgtaggctttggtggcaaggaaggagaacgtgtggatcgtggattccggttgttcgcggcacatgaccggtgataaaaattggttctcctctctcaaaaaggcatccaagactgaatcaattatttttggtgatgcttctacaagtgccgttctcgctacaggtttggtaaaggtaaatgaaaaatttgaattgaagaatgtagctttggttgaggatttaaagtacaatttgctttcggtttcacaaattgttgatgaagagtttaaggttcactttaagaaaactggaagtaaagtttttgattctcgtggtgattctgtgatgaatatttctcgctatggaagagtgtttaaagctgattttgaaaatcctgtttcacctgtgataacatgtttggttggtaagtttgataaagatgtgatgttttggcatcgtagacttggacatgttggttttgatcatttcactaggttaagtcgtttggatcttgttcgtggtttgcctaaacttaagaaagatcttgatttggtttgtaccccgtgtcgtca

SEQ ID NO: 24035 - DNA, 1217 bp, Oryza sativa
attaacactgcatgttatatttcaaattgagttttcttgcgatctaaacttggaaaaacttcttatgaacatcgatttggtcatcaacccaaagtttcacatttgcgtgtttttggttgcaaatgctttgtcttgaaatctggaaatttggacaagtttgaggcacgttctaccgatggattgtttcttggttaccccacacatactcgtggctatcgtgtacttattttggagactaacaaaattcttgagacttgcgaagtttcttttgatgaggctagtccaggtactagacctgaaatttcaggtacactgtcacaggttcagggggagaatggttgtatttttgaagacgagagcgactacgacgacgacgacgaggtcgactcggccgatcagaccgggcgccaggccggtcagaccgccggcacacctccggttagactggcacaggaggtgtggtcagaccggccagggtcgtcggccgagggttctgttgatgcagatcgagatggtcctccggagattactacttcgaccagtactgatacagaacgtagatcaacttcagaaatcactgctcctttgcacatttaacgacgacatccgccggaacaaatcattggtaatataggtgagcggactacaaggtctaaggtaacgactcatgatgtttgtgtaaattctgattttgttgcttcttttgagcccaaagatgtgtcacatgcattaactgatgaattgtggattaacgccatgcatgaagaacttgaaaattttgagagaaacaaagtttggactttagttgaaccaccttctggatataatattattggaaccaagtgggttttcaaaaataaacaaaatgaggatggtttgattgtgagaaataaagctaaacttgttgctcaaggttttactcaggtggaggatttggattttgatgaaacttttgctcctgttgctagaattgaggcaattagacttttgttggcttttgctgcttcaaaaggttttaaattatatcaaatggatgttaaaagtgcttttctaaatggttttatacaggacaaagtttatgtcaaacaaccactaggttttgaaaatcctgattttcccaaccatgtttttaaattgtctaaagctttgtatggtttgaaacaagttcctagggcatgttatgataggcttaagaactttttgcttgtgaaaggttt

SEQ ID NO: 24036 - DNA, 13388 bp, Oryza sativa
cgaataatgaggtatttgaatcatacacttgagtttggaatttggtattctacttcatcttctatatgcttaagtggatattccaatgctgattttggtggttgtagaattaataggaaaagtactagtggaacatgtcattttcttggtacatcattgattgcatggtcttctaggaaacagtctagtgttgctcaatcaactgctgaatctgaatatgttgctgcagctagttgttgttcacagattctttggcttttatctactttgaaagattatggtcttacttttgagaaagtacctctcttttgcgacaatacaagtgttattaacattgctaagaatcttgttcaacactcacgcacaaagcacattgatatttgttttcactttctgagggatcatgttgaaaagggagatgttgaattgcagtttttggacacaaagattcaaattgctgatattttcactaaacctttggattctaatcgctttgcttttcttcatggtgaattgggcataattcatccttttggcatggtttgagggggagtttgtacctcatggttttatcaagcaaaaatataacaatgagaaaaattgataaaagaaagctttgtttatgcatatggtatttcttgtgcatgctagcaatactttgaaggtttatttgtctctagcatagcttgtatgtattctagtcttttcatgagatttagactttgcttttaagggagatgatgcatgacacttaaattctatacttgaattaagtaaatatgcaatgttgatactagcatatggtttgatttataaatgctctatatatatgctttattgacttgttattcctcaaatagctttacttgctcattatgaaaagagaataaaaagaatgaaaaaaatgaatatcaaatccttggaaacagtctgacgacaaggacatattcgatgtgagcaaaataatgggtgccgaatctctggaaacagtcttgacgacagggacgtacccggaataaaaaagagaaaaatatgagcaaaaaggctcaagaaaagaaaaggttaaaaaattctcttggttattttatgctaaaggttatttgagaaagagtgataaatgcaatagatatatgtgtctagtgtttattcttcaacctatgtgcttgttaagatattgcattataaatcgtatgaaatcatgaattttaattgttgattcaagcttaattgtaaaatatttggttcatggttatactttaatgcatgcttgttgtgttatagatgggttcatcttctttttattgtaacacatgacttgatatgctatatgtatgctaagctcttatatattaatgaacataattcctatgcttgatgaaatcattgtcaaaagggggagaagtaatctaaaatttttttagatttttggagaagcaaggtgaaattttggagagttgttgagaagagtatatttttggttcaattggcaatttctttcttttaaaaagggggagaagttttcttttggatttttgagcacgatgtgtacttttgtacaaagtgtgctttttaccacttttgtttttatttttccaaacaccaaaacatttttaaagggtttgccaatgtgttcatcaagggggagattgtaaaatcaaaggtgtttttgattattattctatgatgaacaattgggcattggagattattgcttttgttatttggaatttatttacaaagtggttttggagattattggatttacaggtgaatctacaggatactgttgtgattttatgtggaccggtcagaccgggctggtgctgccgatcagaccggcgtgtattgcgcggtcagactggcgcagcccgcggtctgactggccgatgctgtgtcggtttcggtttcgggttgtttatttggatatccgtgattatttcatgattatggcttctagatggatactatacgtatgtaatactattgtttgctactaatgagtcaagttggagataacttggtctcggaatatggtttttttgtttgttccatgtgtaggtgactcgatgtctcgggagagtatttgcggtgatggaccgggagtcggcttggggataagacgacgtccgtggtggtcagaagtcatgcgggatactaaggctagagttgatgcatgtggttgatggagattccatatggcatacgatggagttattgtgtgtgtatgggatgcggagtcgaatttggaaggagtccgaatttggtacgattggttatgtaaagtttatttcttgtgctagagggtttcctaaggtgtttaggacccctattatgagtttggttcgtggctttaggttgcctacctcaggtataaatagagggggagcgtgaggcttcccggtatcgcttttgagaacaattgagttgagttttgagttagggtttcgagtttagtcaaaatttttgtaaggagtgctgttggtgcactttgtaaacacagagagaagtaataaagttgtcatccactttaagagttcttcgatttgtgtttcaccgagtttcggcggtctaaccgccgatatactgatggtcaaaccggcgggaagcggcggtcagaccggcggtggctaggcaacaggcgcggcaagggatctcggcggtcagaccggagattcaacaccggtcagactggcggcatccactcggtcagaccggcagatcaatcttggtcagaccgatctccatcgatttcgagggtaacttttatttccgctaaaagattttggttttggggtataccaaccattcaacccctctggttggcttagtttttgctattcgatcctacaattcgttcaaccgttgctaggaacaaagaataatccaagcataaaccaacccaagaatacatttttttaatcttgtctggtgcgagattatctcggacgacaagatcaactgtcttttgtcgctccggtaccaatatctatcagtcttttctcgcaaatgtataccaacttaattgctcttcagcaccaaacacaaccaattatctgcatttggaaaagcctgcatagatctacgcagttaatatgaataggtagcgaacttcattgatcaggagagtagcagggctagataaagaaaaaaaatgcagatgtgaaataaatctgaagagtccaaaaactcttcattgcagcggacaaaaactcttactgtgagttctctatgaacttcattgcatatcaaaaactcttcaatatagtaaggttttttttttggaaaatcacagtaaggtatcaattgataaataaatgagggctgctacagaacgggattctgttgcaacgggatagacatattaactattctcttgcatgagtatcacagatatcaggtcctaggtattacaggtatcaggtaacaagtatcattggtatcgggtaccatgcagctgataccacaagaggtatcaggtatcaagtacaatctcatatcaaacgggataccgttgtttaggctttctgtacataaatctgcccttttttttctgcgaacttcacattaaggttccaaaataaacaaataaatctgaattgcagcagccatgttgaattggtcatctgaattggaaatatatcaaacaataactcatactacattagttctttattttcttatgatatttttggtgcttgtttacaagaagaggctgctttgtgcatctaatttacacaatcttctcctctcatcctcgatctaatgaagagtcctctcatcctttacctatatttggagcaatgttgacatcatacatattagtgtattatgcagaattcagagaaccaatgcgacaacctagataacatgaaaatattgtagtgtagtacttaattattggctcaccctgaacatacaagcatcaaggtcaacaatatattaattatcaaatttcagacacataaatgaacagtcggacaattatatatgtttctgtaagatcaatgtgttttgattcttattctgtgatgaacaattggcatttgtgattattggttttgatatttggagattactgttgaagtggttttagagataattgattttcatgtgatgaatagggtttgctgttttgtcggtaccggtcagaccgggaggtggttgccggtcagaccggcttgtgttgagcggtcagacgagctggcccgcagtctgaccggccgacgctgtgtcggtttcggtttcaggttgtttctttggatatccgtgattgtttcatggttatggcttctagatggatactatacgtatgtaatactgttgtttgctaacaatgagtcaagttggtgatagcttggtctcggaatatggtttctttgtttgtttcatgtgtaggtgactcgatgcctcgggagagtatttgcggtgatggaccgggagtcggcttggtggtaagatgatgtctgtggtggtcagatatcatgcgggatacttaggctagagttgatgcacgtggttggtgaagattccatatggcgtacgatggaggtattgtgtgcgtatgggatgccgagtcgaatttggaaggagtccaaatttggtatgattggttatgtaaagtttgtttcttgtacaagagggtttcctatggggattaggactcctagtatgagtttggttcgtggctttaggctgcctacctcatgtataaatagagggggagcgtgaggcttcccagtatcgcttttgagagcaattgagttgctagtttagctagggtttcgagtttagtcgagatttttgtaaggagtgctattggtgcactttgtaaacacagagagaagaaataaagttgtcatctactttgagagttcttcgatttgtgtttcaccgggtttcggcggtctaaccagcatctctccggcggtcagaccagcggcaagcggcggtcagaccggcggcgcaagggcggtcagaccggcagcgacttcacacgcggcaggtgatctttaggcggttggaccgagtgatcaacaccggtcagaccggcggcacgagcgcggtcagaccggtggatcaacctcggtcagaccgatctacatcgaatttgagggtaacttttatttccgctaaaagttttggtttttgggtatatcaaccattcacccccccccctctggttggcttagttcttgtgattcgatcctacaagtggtatcagagcctcgttttcttctttggactttaatcgatctagagtttttgccatggctgctcctgttaggttttcaaccaagcctcatgttttcgatggaacggatttttctcattggtgtagtaggatgcaatcttacattatggatgaagattatgatatttggagaaaagtttctcatccttatgtgattcctgaagtaattaatactgctgctgcaaaaactgagtttgaacaaaattgcaaagctcgcaacattcttttgagtgggatctctcgttcgaattattatcgtgttactcattttcaaactgctcatgagatttggattgctttgagtaattttcatcaaggaacaaataacattaaagaacttcgtcgtgatcttttcaaaaaggagtacattaaatttgagatgaaacctggagaaactttggatgactatctttctcggtttaataaaattttgagtgatcttagatttgttgattcttcttatgatgctaattatccacaatctgagatttcttcttatgatgcgcaagggcggtcagaccggcggcaacttcacacgcggcaggtgatcttcaggcggttggaccgagtgatcaacaccggtcagaccggcggcacgagcgcggtcagactggcggatcaacctcggtcagaccgatttacatcgaatttgagggtaacttttatttccgctaaaagttttggttttggggtatatcaaccattcatcccccctctggttggcttagttcttgtgattcgatcctacagtttcaagcttaacaggcacactcaacctgcacttgacagtgccaaaaatacaaacaaaatcatgaataatgttttgcaatataactgcattgtgggcggtggcttcttgggccgtcggtcaggcctctcggcattggtatctcaaattactgaattgctgtaggaaaattaaacagtaattataggtgtgacaagcaactattgtaacctattgaatgtcttgcttgaggagccaaacagcagaactgatatgctcaaatgatgaggtgaaacagtgaaagaaacgtgaaaaacataacatgattcataatacacccaaaaatttaatgcattattacaataggctcaatcagagcatgtcatcagataggtacattcggcaaattcatttccctgaaagacaatttttttcataacatacagtagtactccctccgttgtgcttaaagtacttttgataataaagtaggtcacaaataaaataaatgatagtttcataatattttaaataagacgaatggtcaaactttacgagtaaaaaagtcaaaacccttgcattacgaaacggaggtagtaccttgtcgaggggtgatcctctctagcgggaggtcgtgagaccccctttgtgagttcggccgggggagcaggtgagatccgaggtccctcgagacaaaagagacacaagggatttatacatgttcgggctgctatgaagcgtaataccctactcctgtgtgtatgatgattcttctatgcttgcaaagcctctgaatctcccaagtacaagctagggttagagaagctttagtttggggatccagagtccgatccccactctcgctaggcatggtcctccttttatactctaaggggatcccacatatgctgcgggtactacctagggaggaggaaaaatattctctatattaattacatgtcttgtgccttagcccaaaagctatctgcgcgtcggctgctgcgtggggcctatcagatcatgcggggcgcccttgtcattcgccgtttaatggttgaggacttccgggttcctattcacaccaggaaaaaggtacccgggtcagttcaaagtggttggaccagctctgaccgggataagaggctgtgaagcccctcatcattatgatgggacaggatggagcacgccgcctgacacactgacaaggcgagggtacagggtcgccgtcccatcggtcattcgaccggtcacaaatcggtcagatgcgcagcacgccgcattaaatgcggcatggcgcggctgcatagaccgctttaaatgtggttaggtggacgttaggcgtgctcacctaaccctgtacacgtgggctgatacgtagagggggtcgggaaagctcgtccccaagctgggagggggcagccgccgcttcaccccaggctcgacccccccacgtgggtttgtgggcggcctcctccctctagctaggaaggggcagctgccgctccaccccgggctcgacccccctcggggggagccacgtgggtttgagggcggcctcctccctctagctgggagggggcagccaccgcttcaccctaggctcgaccccaagctaggagggggcagccgccgcttcacctcgggctcgacccccccttggggggagccacgtgggtttaaggtggcctcctctctctagctgggagggggcagccgccgctgctgccccgcttcaccctgggctcgaccaccctcggggggagccacgtgggtttgtgggcgggcctcctccctctaactgggagggggcagctgccgctccaccctgggctcgacccccctcagcgagagctacgtgggtttgagggcggcctcctccctctagacgtgacacccccgggcccatatcaccgacataccttttacatttgtagggtgattctctctcttgtcccaaagagatatgccgacaggcagtaaatctcgaatcggctgtatgcgaaggataaatcattcaatagtcaatcttcattagaaataattttaataggtcggacctaaccgatgcagcacaagattacaaccaataaagataaactatttcagatctaatgaagtaaagctcttagccgatgcaagtgaagaaaagataacataaaaatataaactatcggctgaaaccccgatagaaccatacgcatccttagccgatgcatctaaaccaattagctttgatcttagcccgaaggatcggacctaaccgagacagcttgcgccaatatcatcactagccgaggcaaaccgattagaatattggacctaaccaaggaagacctaaccgaggcaaaccgatacagatgcatcaaaatcgatctagaatctaacgatgtatatgatacgcgacatgcgtatcagtagctgagtatatcggacctaaccgaggaagtaccagctagccgacgcgcatgaagtttgacgagacatacctcctgccgtagttcgaacctaatcgatgcagcacgacccaaaagcacgatctcatcgaaaaacctagcgagcaagagtggcgatgcgccgaaattgttgtattgattgtgtgtttacaatacccaggtgtacaacatttatatattttgatttgcacaagaacagcattgtacacaaagtcaaagtcaaatttaatagggggttgcattattaccgatagtatttgtgtactggcctccctttttttttatctcttcccataaaggatacttgcgatcaggttttttagtagcctattactgtagcagtaacaaggcactcatatggggcaccatggtgcccgggcaccatgatatgaaatacacaaatttgcccaaatttttaaaaattttcaaattgtgagtatatacctagttataagtattcgattcatacctatacctagcaacaaaacaacataaatctaactttatttcacaatccaatattgcatacctaactaattatatgtttggatgctatatacctagaatcaaaatataataaaaacatgtttaaattcaattcaaacttgttttgaactagttagtaaagtagttaatgttaatacctaaacatttaaaaaaatctcatactcatttgaattgagtatgtactcaatttgaatcatggagcccgggcaccatggagcaccactctcgcccccatttcatttttttcctctttttttcgaatctgaatcgatccacctgaaaggaccttgatgttgcttagagggggtgaataggcactcatgaaatttacttctcatcgtagcggttaaaattagggcccaaaacttactggcaaaaggcccagaacttcctggcagttttttctaccgagcagagaaagctacccaaaacttctgggattcttcctaggaacttccaggtagttgtgagttgctctttcaagcacctcacaacaaggaaattaattcacaagagtaatacacatgaaactacacaagatagcacaatgatcatacaaggggagacacgatagcacaacttagacaaataaggggataagcatcacaattataaagattaggagagtgagaggagacaaacgatctgtttcccaaagttcggatgctccaccgagaatcctacgtctccgttgaggagctccagagagccgggtcctgattaaccccttgcctcactaagcaaaggcataggaagaggtctccaatcttcaaaccaacacccctagatacttctctttcatttcaaatgaccactaagatccccaactagaacaccaagagaacaccacaagtgaggcttgctctaccaagacgacctcctaaacctcagctcggaatccactcaccgggtattccgtttcctttcagaggtggaataacgccctcacaaacttcccgcaactcaccacaagcttgggagctcaccaggcaacgcctagccgtctaggaggcttaacctccaagagtaataaacacaaacgataatttacttgctatgaactaagtgctcaaaggatggagtgtatctctcaagctctcaaccttggaacctctcaatctctcaaatctcttcccaaatctcactcataaagatctaccactaaggtaggaggtttgggaggggctatttcgctttggataggtctattcttgcctaaactcagcagccaacacatgagagggtggaggggcttaaaaacccaagccctccaaaaactagccgttactcacataacagggcccggaactttctgtccagaccaggaacttcctggcaccctcctcgaccaaacagatagatcgagtcgaaacttcctggctcagaacccagaacttccgagcttccctaacatcacttcacaaaaacggtcataactccttgctccggagtccgttttcgataaacttgggctctatggaaagcttattgagagggctaccaaacccaaccaaaaacaagctataaaaccactcataggttaggttaaagctttggtttctctcaaggtagcacttgcataggtcactttgaacaccgaaacataaacaaacacatcaatgttgcatcccttttaatagtacgacattcctatactcaaatgcataaagaaaagttataccactatgaatgccttcttgacatcttcttgcttcacttgagggttgccaacgtaaacgtcattttaccattgcgactattctcatctacaactcattaagcacattagtcccaaatcaattatacttttgccttgatcaatgcccactttggcttttgacttgatgttcatcgaagaaccgcatcctcttgattttcgacattccatcttccactcatcttataattgatacagattactcatagcttcaaatggcctcgtacggttcatcatgacaaagccttcactcactcttcaccaccggatttggtccatcggtgccaagcctcttgttttcccttcaccatcgcatggccaattgtaaccgagccttatttgcccttcaccgttatgccatagatacacacttcataccccgcatcatcaatgtcttcacttgctcctcatcaaggtataatgtccatcttctagcttcggtcttttaacttgatgccggaactcaacaatgggttgtcattaatcaccaaaacaatcaccgcactcttagggtcataaatcttccaattccccttacaagacaaccctagggcatagatctttcaccaccatcccagctcacagatcggtgacgcaccatggaggaggacgacggcaccgttgtggttgatggcggtggccggtggctattgaggcgaagtcattgcttcgggcctcgctcccgaacgccgggcaacaccttaactagcaaggaggtgttcacctgggccaagagcaacaactggcgattgctccacgtcggcgacattgacataacaaggaagaaaggaaatgacactccaatttgcatctgcatactctccttcaccttcacacatgaagccccaatttctttttgcaaatcaaattaatgtgcaatctccattattacctgatctgaattgatgggctacacaggtcctacatttgcacatcgtgctccatgtggctggctgcagaggatagggtggagtccgccggtgatggaggttgttcgctatttttctttttctcgtcgtctctatgacatgaacgagaatgtttttgcatttttttcgtgcttgctagagatggatggctgctactgcgcagtgtcaagctcatctctataccacaccgctacatccttccatgactctatcgtcgactaccgctcgccacccgattgccctctccactactagtcacaaggcacagaccagtctcttcatccttatagcaaaattcggcaaagccaccatgatcccagcttcacaatagatttttggctgaatcatgttttttgcttttctagtttgattcacttgtgggtaattttatcactcgtgtgtgattgagccggtaattttttcattcgtactaccattttatgatacaaattaacaatactcttagcatcagtttttactcttatactgtgtattaaatacatcagtaaatatattactatacggtgactatgagatcatgggcaatatcaagaggaatgtggtaattgttttactcgcagaccacgaagtctaaacaatatttatagcactggtaaaagaattactggcgttgtaagctagtagtaattcttttacggccgtctaggaatggtgacgtgcgctgtggtcgcattcatgcaagtaaatttgtttcttttgaaacgggcattcatgcgagtaaaattgttgcttttgaatgagcaaatgtgggaggctgggactaaatgaaaaactccacagagtaaatttgttacttttgaaacgtgtaaagacactagaaaaatagaaaactcggaaagaaaaactagacggtaaatattttattaagacgcgaaaacagaaaaactaaagagaagcaacgaaaaatggaaaaatatagatggttaatattttacagggccctttgatgaagcacagatgagataaaaaagagaaaaaagaaacacggaaagtagggtggtaaaaaacaaaagaaaacagacaggacaggtgtggtggtaaaaaagtgaaatccgaaacgagggagtgttgtgtggcgctcgaactaatattccacgcgctgtgtgcgtattagcgccatcgaacattttcaatacaaaacaagtatattatcaaaatatattcaatgctaatttttatggaactaatttggtgttataaatattgctattttttttctaaaaatttggtcaaagctagagaactttaaaaaaaacgacaataatatggaacggacctatatatgctgtgcaattagtaatatcgtttaatcacctgatatattacaagtagtgcaacttttcatagttaatctatacccatgccatgcattatcatgcatttccaaacgacgcaatcaacgtaacaaaatcaatactggtttgacatcatatatccatctgtatctggtagtaagtaatatctatgataaaaccatttttcgttatatagctaaatatatactgtgacaaagttggtacattagcccatctaagtgcaaggggacacatgttggtacgcaaagcatatgaccgcccgttgacaacgcctgtgcccatgtggctagttgggccattagcctgttcacaatttgtttcctaaaaataagttcagtttgggtccctctatttgccgtcgagtctaaaattcatcccttaaccacaaaccagatacaacgcatcccccaacttacaaaactatgcaaacaatgtccctcggtggtatcgtccctagttttggctga

SEQ ID NO: 24037 - DNA, 8799 bp, Oryza sativa
gcggccacatgacatgagaggggatagagagaagaggagagtagtgagatgacatgtggggccacataaatcccaccgtttttattattctgtgtgcgaaactgacatgtgggcccataggttttattatttttccaaatcgaattgttatatacgcgccacgtcaatgccacgggacaaagacttagtcaaaggagccacgtagacgtcacgtcagccaaaaccaagggcaatattgccgaaggacctcgtttgtattggttttgtaagttgggggatgtgttgtatctggttttgcggtctagggacgaatttcgaactcggtgacaaattgagagacctaaagtgaacttattttgttttcctatgtttactctttaattagctgggcacactttggtcacagcacaagccgtagaaaaaaaggttcacagttaaggtttctcatcttatattcaagtttcaaaatcatccctaaatcaaaataccaaatataacgcgcttctaattttacaaaatcagataacctccgttcttggtgacgtgagggttgagtcagatgggtcgcacgacctccggttcctcgcgcgcgtggtgggacaacctcaagggctcgtacgtggagacgaactactcgttctatgtgcaggacatcaaggtgagcactgagcaccccgtacgtagctagattctgcatgagccaggcaggaacctcgcaattgtaggcgacggagggagggaggatcgccagagaactaactggttggcctctcggcgttccaggcgcgtgctcggatctagtcttgccgcggcgccggcgtgcctgccaattctcacagggtagtgctgctgtgtgttacggatcggagtatatgattgcatcggagcttcagattagttgctactactatacttaggctctcttttgtttaggcttaaaattattgtcttagaattttaagtcagcttattggcttatatgatttacaagccggtggatttaatgtcctaagtttaatgatggagtaatgcatctatctcatataagccaaaaaaaacttatccaacctaacttttgacttaatagtgttagagtggcttatggcttcaaaaaagccaaacaaaacagccacttgtttgtttaggcttagatttttcggccataagttaacttataagcctaaacaaagagggtcttactagtccatgtttgagtgttgcaggataaataatacggggaatgaaaacggtcggaaatggtacattattttattatttttttcgaaaacgaacggaaacggtccggaaattttcatatttatgaattcatctatttagtgtcaactttaatgccacgctgacagaaattaaaaaaactaaattttgaaaacggtaacatcggtaaaattattattattatattagttttacggaaatggtatcggtacggtcggaaaattttcataccgttttcaccccttaatacctcaatctgccgctgctagaagaagtagtagctgtccaccagtggcggagctggacagaaaatcaaaggggggccagccggcttttgacagttcaaaaaattagcaatttctcttttctttcatgcattggcaacacgtaaaagcgaatagtttgcaaaagtcgacaacaaagatcagctacagatgtcagattttaaaatttaggatttgtggatacatcaagttcatagtgacgtaattgacatctcaaattggctctctcttctaaaaaatcagcaggatagaactttaaagctagagagcacactttatcaatgttgaactgaatgaatcacttggatccaaagatgtacacaaagtgagaaactctgttgcttattcactgaatctgctatgatatatgggggtaataaaaaattttgtttttattggaaggggccatggcccctgccagcccccctcagttccgccactgctgtccacgtagcgtaaaaccccagcaccacgaacagaaaccacgcgtctacctaccatcttttttttttagaccgcacggagtcatatatatctacagtaaaatctgccatggaaaatccgtccatcacgctagcctaagcggtttaattagtcgaaattgaaagcaacaggaagcatgtgtgtaatcagtaacattgcaacaatataggtaaaccgagcaaatcatgcgtgcgtcatttaatttgtatgttcaagtaaattccagttaaaaaataaagtaaatctcacaaaactatatatatactttgatgaaactatcacaaaactacatacatatttaaggaatcgatttagcagtatatttatcataaactatatatttaagatagcctatcacaaaactacaaagtaacaaatttatcccaaaactatagatttaataccaatatatatctaataaaaaatacataaggcttctaatagtgtaatagtgatagtgatcccatgttttaatttattgcttgggcacaaaaccaaggaaggattttaatttactttttcaattatagtgcaatagtgatcccaatgttttagtttatttctcatctcctaatagctgttataccagtgaaagaacgtctttacctgttgcaacgcacaagcatttttttctagtttaatcataaaactgcatctataactttacctgttgcaatgcacaagtattttttctagtataatcataaaactgcatcatttatagctctaacataactgtagtgctagagatttgaactctaaaatttataattttgtgataatttcaatattaaatctgtagttctatgctaattttaatattaaatatgtagttttgtaatgcttagccttaactttgtagttttacggtaaaatttggtattgaatctgtaattttacgatacaacactttaaatatatagttttgtgatagtttaatcaaaatatctataattttgtgaaaattactttaaaaattacttcctaagatgtgtagcatattttgattttagaaaatcaatctttagtataccaataattagttaacataacatgtatagaacttacaacattagattcataattcgaaacattatcatataaaaactttctattgcacataataaatgctctctggtccaaagtgaacaatcagagtacctattattcttcttccactaatatttcaactataacttcataactccttcaaaataatttgccacaacattaacaataataaaattttgaagtacattagtcggggaggactatggatcggacgtcaaacgttttgcaaaacatcggatggtgttgcacaacattgttacaaagtgtcgcatatatttcatcgtttgatggaaaatgtttcaacaaaatatagagaataatgtttcattgcatggcacaaaaatgtctcagcccttgaacaaacatggttcaacatatagaaaaaatgtttcaacaatttaaacagtgaaacacaatcgaatcattcttgaagcattttgctataacacatgaaacatcgattttgagctactgaaatatccaaatactttgaaaaaaaatgaaacacaaagaaaaacaccgcaaatttttggtcttcctcctttctagtggcaggccaccgtattggcaccggattacttatactccatccatgaagacactctattgcattctctagatgatccacaccgcgtacactgtccttcctactaccgttgttgacgaagatgaggctgagctagtcccctcattgctggttcccctcccttgatctagcgccctgagcttagcatggtcagaacgccggcctactacatcctggcaatgtggtgcagagcaagatgagtcgcctcatgctcgccatcgagcattagcgatggtctcagcaactcggctccatagctgctccagttgctatggggagagaaggggaaaaataaatgaccgggagtgggggagtgggaataagattgactattggaaagaaaaggagatgtagataatgattagataaaagtgagacagatgcatttaatatttcctcgtacgccagatggagatgaagcgttttcgacattagtctccagcaaaagagcgggaaatatacctattttgtcctacttctacgagcatagaaaaattctccatcctccctctccagtctcccaacctttctctctatatccacgtaggcatccatgtcatccattacggtgacggggccagtgttccacgtggcattcgtggcccgtgtgaacgcgtccctgcaccccgcaccggtgggggcccagattcctcaccctcactgacccacgggccccacccgtcaaacgagcggcccacccgcttcccgaaagacgcgtcacgcctcggccccacggacgttttgttaccccacccggcacctactcgccgtccccaccactccacagtgccagtgacgcgtgggtcacacccgctcccttggtcggccccaaaccctcccaccgcccacctgagcgagtggggcacgagtccctatatatataggcgcctctctcctccgcccccgccgaccgccgcgtgctctctcctccgccgccgccgtcgtccgccgccgcccgccgcgtcacacacacagaggaagcaatcggctgcccccgcctcctccccccatcggctgcctctcttcgcgacggagagaagaggataggaccccgactgcacgcaaacgcgaaaccctaggctcgtcgccggcggcggcggcggcggcgaccggtggggagatggcggggcggcggccgctcttcgacctcaacgtcgcccacgaggattgggattgggagaagggggaagaggcggaggcggaggaggaggagcccgaggaggttgttgaggaggggaagaaggaggtggtagtgctcgaggaggaggaggaggaggaggagccccatgaggtgatcatggaggaggaggtggtggaggaagtggtggaggaggaggcggcggtggcggaggaggtggacggggaggtgaggaggaagaggaaggactgcgaggttttggtgggagggcttccccgggacgcggcggaggaggacgtggcgcgggcgctcgcggacgccggcgatgtggaggaggtgcggctcgtgcgggatccggcggacccgcgctccaacaagggcttcgccttcgtgcgattcgccgccgcctggcaggcgcggtgggctgccgacgacgtccgcacggccatggtattgtgtccacccccccccccccccctgcactagattcgtatctccgactcgttcgatttggatagagttgtatctaatgcgaatttgatatgttgagaataagtagtttgggaaaaagtgttagctttagtcatgcttgaagtagagctgataaagttagtggtctgggatgcttcttgttcactaatttgaggtaatctatgcccttgcaatctcgttttgttgttggcttgtgaaatttgaattagtggatgtggaattagataatgagattaagtagtttgggaaaagatgttgctttagtcatgcttgaagtagagctgataaaattagtggtctggaatgttttttgtttactaaatttaggtattatttatccttgtgatttcattttgttgttggcttgcaagatttaaattagtggatgtggtatcagggcttttgattagtgttgaggaagtagatgtatggtatgtgcccttgtttttcaaggcctaagtgaccgatcagaccacaaaattggggaaaaacagattagccaggttgaaaatggtaccttttagttgatttcatagcatgtgcctggttcacctattgaactaaagtcgtagagatatttaaaagtcttagttttgaaaaatactgttctaaattgtgatgtgacctgctgtggtgctaggtgtcaccttcccactaaggtcctatgcaccaccctgctttcccgccaagtgccttatccaaacataattttaatggtcatattacgttaagcttgtaatggcatatttgtcagtacttgatgcttcggatagttttaatgacgactcctgctggaatgccttcttaaatgcgttttgtgtttcatatatctggtaataatgaccaagacgtggcaatctaaaagaagctgaaactaaattagcaaatattttggcgctcatttttctaaatgcaatgagcaaatatttttggttgttaagccaatatggtaatagccaatgatttcattcatggtgtcattggaaaaagaggcactcagttagatttacccaatgaaaatgggaaattcctgataatttgttgtgctatttataaatattttaaatgctgttaattactccctccgtcccaaaaaaactcaacctcgtactacgatgtgacacatcctagtactagattgcctttgtttgggatggagggagtaatttgtaccacactgcctcacgctcaggacaaacactaggacaatcgttattaaagatgctacttacatgaatacttttcgatgttcccggataagttcaaactgattgaatctcagttatcttgttgtagcatcagtttgaattgaatgtaaaatgtataaacttgcatacttgataaaaatctgcaattgatccatatgtgcacacacaaacatccatttactaaaatgtgttttgccaatgtgtgcacaagtccaagttagcatacttgcatttatgttatggttttatgtttaagcactggtcactatactagttattctattgaaatggtgatgcgaataagtatctaaactagaggacaactgcacttatgaactaattattctgttgaagttgttactttagttaagagtcacaattagagccacaatgcaaatgtgccaagcttattatactccgcgatatttgccaattcattgtgaagtttgctcccacaatgaactgttagatcattagatccaagtctgttgaactccacattagttttagtttcccttctattagacgataatgatatctttattgatcagtaataatgtttttccaggtcaagggagaagcttgtatgatatgcaagaatgatgcaaacgagacccttcatctgcggaatatatgctttgattggacaaaagatgatgtatgctttcatccttatttaattaattgattgtaatttttgtcacaagcatattgttattttctacaagggttctcttctgtgcagttagcggaggaactgaaaacttacaagttggaaaaccttgaggatattaatttagtcgaggatccggaaagaaaaggaaaaaacagaggctatgcgtttcttgatttccgcacaaatgttgatggtgtggatgctttttttaaactacagaacagagatatttatcttggtacggatgttcgagcccaagtgtccttttcaaaaactctttcactggatgataagattatggaaaaggtagtcacacaaacaaggcatctatattttgtactatatgaatctgttacacgtattggaatatcttggctttgacttagctgctataactttgattatgcattgcaggtaaaatctgttttcttggatggcttaccacctcactgggatgaagacaaagtgagagaagtgtttggaaagtttggtgaaatcgatagtatacaccttgctaggaacatgtttaaagcaaaacgaaaagattttggtttcattggctttacttcaagacaatcagctttagattgcattagtacagttagtaaaggtggtattgttgaaggtagcggaaaggtaatcacttgaggtgtttttagatgtgcttttcttctggtttatttgctccagctactgttacttagtaggtcaatattttcaggttcgaatcaaggcttctttacaaaggcccagacctactttgaaaaaacattcatggcaagggattactcccatgttgggcatcaggaggggatttattggaaaaagttatggtgatagagaacactatggtgatagggaacgctatgatgatagagaacgttaccataatagagaacgttatggtgataggggatttgggttttcaggtcatgcaagacgtgattactcaagcaatcatgttcatgacaaataccatcgccacatgcatcgtatggcaattgatgttgaagaaaggcccgtttcatcacgagaacacagatctcattatagaagagattctgcagtatctggttggtttcctttaatcttctctaaataaacttctttcttttttctttctctccaaggctaatgaatgtttatttccaatacttggttgtaggccacatccacaggtatgagagggcaaggcccagggaagcatatcttgatagtcgatatactaatgaatacccaagacataggcactcaaggcatgaagaatccatccagcgagatgcatacaggagtaaatatggacactcctacctggagaggtcacacagagattcttgcccagattgtaatccaagtgatcatagttccagtgccttctataagacagtaagcacactatataaacactatctggttttattatccattgcttgatgttcattggagctggtttactttcttaggaccatgagccaacaccttcatcttcccaagtagcatcccactgtgaggaatcgttcagtcaggttgtgtttttacacttcctcctataaattcagttgcttcagagtgatgctaactatttgatcttatgtttcccagggccgtaagttgatggcatcaag

SEQ ID NO: 24038 - DNA, 10896 bp, Oryza sativa
tcctgcacccctctgatgtcgctttggccgttggttgattgagatgttgcaattgcgagtcaaaaatttcgttgacaagcattatagagcattgcgtgcgtaatctgaaagaatatagtttcttttagtgccgtactaccaaacacaaaaggtgctgaatatatatatttttgatttgtgcgacacgtgccatgtagcaccacataacttggttcgatgaacgcgcagcaaagaagggcgagttttgtgctccaaaccgtacacgatagtgcacattactttacatgatgcttttctttatctccctatgtacatcaaatttttagctgttttttactccctccgtctaaaaaaaaactagtattagatgagatgttttctagtataatgaatgtggataggagtatgtccagattcgttgtattagaaaatatcacatccagtactaggttgagtttttttggacggagggaatatgtggtactacacatcactgtgttgcacgtcttaaaacggtcactttttataatcaaagttttctttggactaccttttctcaatctttacgctttcaaacaagtaattgtgttttcttttttatggtttaccaccctaactatatagtgtggctggggtaagatagttgacgtgggtgtgccgatgtgtgcttgagaatatagggttgggtggttcaaaatgtaaaaagcaaaattacttaattcaaagtaacaagattaataaaaatctggtaataaaaaatgactcaaattacgattcgctttaaaattattttcgtcattgatgtgtgcacatctgagtgcactttggtgattaggtacgcaactctcttgtcaactgagaccgcaggagcctggagggcaatctgtacacattttatacggtagtttgtggaccatacgcacttggcagtggagtttatacaacttaggactcttttgattaaaagaaaattcatagaatttttttcctatatagctctttgaatcaatggaatggatcctataaaatcctatgaaattcctatggattgtcttttcccatgcaagttttggaaaaaatttaacatgaggtagaacctcatggaaagaatcctttgaggccccttttgattcaaaggaaattcataggaattttagaggatttcattcctataggattttttcctatatagccctttgaaaatcctatagccctttgaatcaaaggaatggatatcctatgaaattcctatggattggctaataccatgcaagttttggaggaattctaacataaggtaaaacctcttggaaactttcctttaagtctttatctctcctctaattcatgcgtttttcctgcggtccaatcaaactaccatttctctgtttttcctgtgttttgcaatcctctgttttacacttagggcccctttgaatcgtaggaatgaaaaaacagaggaataggaaaaacacaggattctgacaggaatacaattgtaaaacagaggattgcaaaacacaggaaaaacacaggaatggctgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggattttttttccataggattgaaatcctccaaaattcctacatttttcctacaaatcaaaggggccctatgtttttcctacattcctatcaaaatcctgtgtttttcctgttcctatgttttctcattcctgcgattcaaaggggccctcagtctttatctctcctcaaattcctgtgtttttcctgcggctcaatcaaacagtcattcctatattttttctgtgttttgcaatcctgttttacacttgtattcctgtcagaatcctatgtttttcctattcctttgttttttcattcctatgattcaaagaggtatacaataccttatggttttacgcactcaaaggggtatacaatatcttatggttttacacacttatgtgatgggatgcgaataatttcttgcttggtgtgtactagataagaggatggaatggatgtacggtgattgattgagacgacaaaattggatgaaatcaccatattttacaacttgaatcaatattggttcccagattaaatagagagaacattagggcccttttgattcaaaggaaattcataggaattttagaggattttattcctataggaattttttcctatatagccctttgaatcaaaggaatggatcctatggaatcctatgaaattcctatggaatgcctcttcccatgtaagttttggaagaaatttaacatgaggtagaacctcatggaaagaatcatttgagtctttatctctcctcaaattcctgtgttttttctgcggctcaatcaaacagtcgttcctatatttttcctgtattttgcaattatctgttttacacttgtattcctatcagaatcctgtgttttttctatttctccgttttttcattcctatgattcaaaagggccagtagagcaatgattaatgacattgttttaattgagagtatcctatgtggagaagtaaagttttgctagcaatcacataagtatccaatgctcacatttaattaatcgaaatgtggctgcaccaaatcacagctaatggggatagttatataggatttgtagatacataacatagctctactgctaaaacacctaagcaagttttacatggctgctaatttaccttggccaagattgatacggagttctcattatggttctatggtacctcatttattgtttaacaagggttcgttccggtggagggatctaaataacacccctaaccgtacgaattttctcgtttttttggaatttttttcggctcctcggggaggataagcgtggttggctatttttgcaaaaaactcctcgtgtttgtagaaaatatcgcacagttccttaaaccgactgacaacccgacatgttttatccgaaaaaccccttgtatttcagcgaaatacaatgtgaagaagagaaaattccgcttctaggggtttttatgaaaaacatccatcccctacccccaatccccaaaccctcctcgttccctcacctcagcgccgccgccgccgcaagccccgccgccgccgtccgtcctcccctcgacgtcgcctttcgctctccccccgtggtcgccgtgcgccatcccccgccgccgccgtgcgtcatctggcgccggtcccccttcccccttcttcgccctcccctcgcggcggtggcgtaaccggcgccggtttccccctcccctcgtggcggcgtctgagtcggctccggtgctcccctccctcttccatcccctttcgacggcgtcggggatgacggcaacgcggtggtggtggcggtgtcaggtgcgggtagaaaggagctggtgacgggcggggacaaggcgtcccgatctgcactgactcgatctgcgcgagccaaccccgcgccggattgaatagggtatgaggggagaggacggcggcatgggaggatgaagaggacaacgccgatggagaaaggggtgaggttgcccggcgggggatgctggccttcaccgacgcgtggctccccccgccgcggccgtcgtcgaccgtcctccacccgtcgtcgccaccccccccccttctcccctatctcgggcctcttcccgacctcatgcctgcacgagcgccggccgcgtcccgtgctcctctcctggcggcggcgtcggagccggcgcccggtgccgtcctcccttctggatcgatggatttggaggtagtaccggcggtggcggtgttgggaggaatctatatgagtatttcactttcattcctcctcctctcactctcactaccgatcgggagcgcggagtggtgatggtggcgatgtcggagcgggggtgctggtcgcgtccatggctcacctcatcagggcacgcgccatccgcgccggcaccatcatccgcgtcctcgactatctcttcatcgactccgacatcaacacaaggtgaccatacaaatccttcctgctttcgatcgatctcatctcgctgctataatcatgtatcagaccagatgcctgcctggctgatcgatcttttcaaggagccgctctttgatcattttaatgtatgtgtgtgcacgttttgactgctatcggggaaattttggttaatttccttttttcattctaactgctaggtaaaattttattctgaaatgctctgccgaaattcgttttttcggagttctaaacggcgctagggaaggactgatgaataacagggcctgctctttactgatccagggcagaaattaaatctaaaaaattaaccaaagtctggtctatttttgtatagtagcagctcttgtccagtttatttacatcaggcaacattctaaagtgatgaaatgcggatgaaatcaaatggatgatctacttgttcatattgataaatttaatattacacattatcaacctaacaaatgatgtagtttaagaaagtttttagcaaatcattataagcatggagtaattaatccatgtcaatcatccgattaacaacctgtttagaatggaacattgttagctatttctttttgttacttgaaactttgaaagtttcaagtattacaacatgtgtcaacacttactgaaaattgaatccataactaacttttcctatcatatcttggtttctcagttcagggtcattatcgtccagcaacttgaattgctgcaaactgagtgtgcactgatcggtactagcaatactcatgcgagcccagtaaactttatctcacatggaaccatgcatttcctttccattgtgagctgtccccggcatgttgctactgggtacctgttctgaccgacgtggtggagtggtgatgttgcagaacgcgtacaacatgctccacagcgacatggtggcggccgtgcgtattgcgcacgcatgctgtatgttcctcgacgagctcagcaccacatacctctttcctgcccaccacaacgtcaacgtgagcacattcagatctcccaactttataaaagaaattgcatcttaattcaaagatagtttcttgcacctcttcgatgcttcatatctggagatttgggtagcggaaattgactacaacgacctatctctgattttggagtcgatactaaataatcaagagaatgggcttgttttgtttttttttttttttctagagtgggatatggaaacacctagcccaccgtctaagatgagatgttgtctaggataatagttgtaattggtagatgggatattgcagggctacgagagggtaaatgatccctctgtgtaataggggaggggagtttatttctagggtgaactaaaccatccaaacaagcaagtgcaattctgaacagaaagtaaggtaattgactgcaacatctatcaccgaatagatggtgaaatgaagatcttaggcttttttgccacttgaattgtagtttctaaatacatgtccactgatatatctgaaccatagctacttttcacggacaaactagcttcatatgtatgaaacatggcaatgaaaatgttgtttgattcctggattctgacctactggatttggatgcatcatctttcctttgaagtgttagccatcatctgcaaaagtattgcattcccaagctctttggatggcccggtgccaaaattgaagaacatcatgtactgtgttggagagtgcaaaccattcaaggcaccacaaaacatatctcctctgttctttgtagatgttgtattaggatacatgcaatcaaagattcaaacatcagattctttaccagctaaaatatcaaaaaatattaagacttggcagtgtagttatctttttactaattcttatagatatatgattagaaaaatagaatggtaaaaacatgggtattcgacactctcgcagtgtactagacaagtaaaaaaggacactagggagtataaatcagtcagcacatatttcattttggcacttgatatttggtgccacctcacctgtcatatcatggttttgttgttttccaccttactttcaggacagtgcaaatgtaccaaacaacacagatgtttgcattgatgtgtaccatacccttcagttcaaaatttcgcttacatgatacaagcagatagcagcagactccggtccttctcgtttttgtatttgagagtattctgccatagttccttttagggttgctaacttacttgccattttaccccacgttatatatgatgtattgtttggcaggagaacgtcaatcgaggtcattccagttcagaaagaaaaatacaatttctttgctatccattcatgaagaattgtacattacagagttttaaagtaaattgaaaaacgattgcaccacaaaccactttttatttaaatttgttgtacctactacatctcatattgttaaatgtcaggtcaacatactggggatatatacatgacaaaagaacagagcaaactccttttttatccaaatcattgttcactgaagtggagttgtttctcagagacctcactaatagggtgagcttacaagactgatcattgttagtcttcagctggaaaccaagcaaaagatgtcatactgttgtaaccatgtttgaagacaatttcgttgcctcttgtttgaagatggcaattgtcataatgcgtggtttgtcaaaaatatgtccactgtgacatgcgtatatgtattaataatttgtcagttatttgtacctatctgttttgcctagatgattattgtaaatgctcttatcgcaatgtaccatcctgtattattcatgttattactgatataatcttgcgcgcggcgtggcgccgcgccatggcccatctagtgctttgcaactactgatcctgatgtcttgggctttggcagtgattggtgggcactgggcatagtttaagggtgactaggcaacggtaagactgccggtgagcagaacaatggtgatagcgttggttgcatttggtgttaattgcaggcatgtgcctggccgtaggtttctgttttgctcatagttcatggtaagagtggacgaggaaccatgccaacaaaagcatataaatgtatttttgaaaaacttaatgtaccatcggatattagtctaccactttatcctgtccagccattatttttctatcagagaattaacagataaaggagaaatatggacccatcagtgctctcatatacttagtggcagttgagtttcatcaatgctctctcgtaaggtgatgagattattaggaaaatttcaaatagtcccacctgagcacatctctacattgtagagtttcacaagtaagaaatgcatctccattctgatttttatacaatattttttttaccctgcctatgaaaaactaattttttatttatagtaattaataagtcttgaattaaataagtggtaaatcttaaattgaatttgtaaaaataggatggacgttgtttcaaagggcatccagatttggacgttgttctaagaagtgtccagaggtggacgttgtaccgaagcacgtccaggctcggtttggggcgcccatgccgccatgcggagaggcgccatcgtcgactctcctctcctcgggcccaatgttggtgcagggctcaggcaaggtgctgccatccccgccgttcacctcgactctgggagactgcaacggctgccttccggcttccgcctccacaacgtcaggaatctgccgttgcagttcacctcaactcacctcgaaggctctcgaatctggagaggacgccgccgctttctgccttcacgccgggagatcgcagccgctatccacgttctggttgagtcatgctggaacaataacccactcatgccggcttgtattgcgtcgtctgtccgcccctcttggttcctaacagcaagaccaggtatcgcctcactccaggtggctggccgagcaagtatgctcagttcatagatcttggtattcaggtgtatatgttctgcaatagaaagtttacaaagaatgcaaaattatgaagggtaggacgcaaacatcctccttctatcagatcatctgtcgcccgatgacttccaatctctggcctgttgcaaaaggaaaaaaaaaagcatcgatagaagacctcgcatgcagtacatctggcggccgcttctcaagattcagtcagcaaagagctcgatgcgtagtaaacaatggaccagcacaaaaaccaaactaatcaaatatctcaaaataaaagtggtggctgttcacatatgaccccgagtagagtgtccgtcatgcggaacagcggaagcattgaaggagggccgggggatggcgaccctgtctggcagatcaggtagagagcggtgcctgctcagcaagcaagcaatcaacgagagacaatagtctgcataggagtaacgaggcagagttcgaccattgtgtgattggatccaaagtccaatcttagtccggtgaattggacggctctttggggttttcaatggacgcccttgtaagcagcgtccccatctggacgttttctacaacagcgtccacacctggacgccctatgcaatagcgtccttcctattttcgtaaaaattgactttgctttattatatatttaatttctgcattattaattattatgaataaaaaattcggtatgaaaaaaaaaggttggttgtaaaaatagttttttttaagtagtagtggccacggctcccgtcgtcgcgcaccatgcagatggcattgcctagctaaccacgatatcggcatctcgctgctctgcaggtgctcggtcaaatgaccggtaagattcaatggctggtaagcgacacttatacgccactggtttgaagaacatcactgctatttgttttgccttggaatttccttcttaatttaagtaatttatccatgttttgcaaccccaccccaccccccaaaaaaaaaaatccgtgttacatgcaattgtatctgaccgaaaaaaaaaatccgtgatacaattgcatatgctagtgtggctaaaaccagatacatacctcctatgtttgcaatgaagtaactttagttaaattttacagaaataaaatagtgtcatgtgaaactgccatagaccgacggaatgtgacctcgcatcacaatgaaaatggaacggaaatttagctaagccagtgcttgacttgacagaaatcaggacctgacctgaaacaccgcagaatgtcacggcagcagcatgtggcatacacagcctgcacccatgctcaaatgcacatgcacaagaaaaagaaattctaccatagcatagattcagatctctcattcttgatttcacaacagctagccacatgagcatgaattttcagtatatgaaaaccctcttaaaaacaaattcagtattgcaacaatccacaaacattgcaacagatagatcatgcttgattctccaagtaagattttcgaagatgatctagtcagaatccgaagtaagatccatttcagggtgaaacgggcggagtaactttgctaggtgctcccccatgtcatccacctcctccctcccgaagccccagtcacggaggaccaaagacccgatggcacctcttgcgacaccgtgcttctggaggctccccgatcgcctctctatgaaaggcaggacagtgctgcttgatcgtaatcgtgccgccatcggtatcgattcaatatcgagtgagccctttggctgggattcttctgcatggtcgctaaggatctccccgtgccggccaatgttgcctctgaagattgacgggaacggaagggggacagggagggggcaaagagatgctgagagatgggaaaattttggctttgtctctctggcttcgtagactgaacataccgagtctttcacttgtgatatggaagtcctttgcccacctgtgcaaacaaatttcaattgttaattctttgtacttctacatgtataaccaaaatttagccaccatgcctataatgttgtgaaatgttcaatattgtacaatataacagtagaaaaataagttctgttggcatgacaaaacttccccatctagttttccgcgcgcatgcttttcaaactgctaaacggttcgttttttgcaaaaagtttctatacgaaagttgcttaaaaaatcatattgattcatttttagaaaaaaaaaagctaatacttaattaatcatgcgctaatggaccactccgttttccatgcggaggagataggttcccatcctccagtaccgaacacagccttaatcagaccttacggcaaaagataagacgtgcagacctctatcaagagctccatgaaccaccagcgattcaactgaataaggatcttcgtcctcgtcgctgatttcaggggtcaaagagtgcagcttcatctctatgttccccaatagcatctctatctgcaaattagatgtgtgcaattagcaagcaagattaaatttccatccaatgttggtataacagtagggcatatgttatgttgtgtacctgtcaaagaaggggcaggcatcgctacatccagagcagtaaccatattctgccgaccttgatcagataaaatgtgcagaagttcaccaatgtcaagattaccagatgaatgtgctaagtctgaactcgggcccgttcgttgcaatctaaatggaacagtaattgaatgtattgctgcagcacaaacagcactagcatggaatggtt

SEQ ID NO: 24039 - DNA, 658 bp, Oryza sativa
ggtgacatgtaacctgatgaaacagagtgaaaggaaatttgtgagaaaatctcattcggaataagctttctgtacattcacgaaaatattttttaagggaattcatgaaagtaattttgtatggaaatcaaatgtgaatatacagcatgaacaaaaggagttgattctctcttaatggaaacgcaatcaagtgcagtatcttaaggcacaagatcagtatacatgaaagcaatcaaaggcaaaactaggccaccggaaagaagtcctataaaatcacagaataacaatagcatcgcaatttagtatcctcctgtgtatttagccaacttacgagaactcctcagacctaaaagtgttcgaatggaagttttcaaaaaagaataaaaaaataaactaaaatcgtggagttcaggcaaagggcatacttctacttaatgaaggcggtcctatggggaccatcaggttgcaaaaggacgaaagttttgaaaatgaaacagcatcatgaagagctctcataatggactccctttgattcatcctggatgatccaagggtcattggatccctcacacagtaaagcaatacaggtgtatttgtgtaatcatcagcaatgttctccaaaaactgtgcagctacactggaaaaacctcctgaatca

SEQ ID NO: 24040 - DNA, 736 bp, Oryza sativa
tctgccaaataaagtgtgggaacagacaaaggtattggacctgtagacttctttttttttttgctagtagtagctcaaactaggtggaagatttggatatatttcttaattcctcagcatgaactttaattttgaagccattgcctctttataatggtaaatagcattcccttgacagttgattggtcaccctctcatgatatgatattggcgggatgtcacgatggaacggtaccttttccttacccagcaaaattattttcttaacttaaatcctgtgacctttgagtctttcaagttgctgttctgaaagttctgtgattgactttcttatattccaggttgctttatggaagttctcagcaaacttgtcatttcaaggtatttagatagttttgccaacgacgtcactcttatcagttatcatttacactttgcctgacaacatgtctgactgtagaactgctttactggtttaaaagcaagttactggagttcccaaatcttcacatttcttattctgttctgtttgcaaacaaaactaaatcatgcgttctgttgataaacaggttcaaaaccttttatgtgtgtaactgctgaatctgctcccatcagaaccgtgtcgtggacaccatctgtgaggtagccagttgtaccgttacttctggtctattccaaaagataatttttgagttttgactcttgtcattctatcagtaaggaaagggccgcagga

SEQ ID NO: 24041 - DNA, 763 bp, Oryza sativa
  unsure (1)..(763): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcctagatgcgaaaaggctcaatccaacagcagcatcggcaattctttccccctgccacctttttcttgttccaccacggctatcatacagaataaaaaaaaacagaatacacctttctgtaaagaaaaaacacaaggaaatgtgatacatatgtatatgcatatctatttgtctcttttttttctctctactttgtaaccttcatatatatatgtatacatatacatatatatatatatatatatatatatatatatatatatatatatatatatatatagtaaatttgtttggtgctccatatgagtgtcctatatatatatatatatatgtgtgtgtgtgtgtgtgtgtgtgtgtgtgtgtgtgtgtgtgtgtgtgtgtgtgtgtttcagtgttcacgagtgcattggcgaaattacaacagtttgttgtcggttcaacttatctaatgtaccagaaaacaagctagtacataaaaaaa

SEQ ID NO: 24042 - DNA, 846 bp, Oryza sativa
ttgtgtggcttatgttcacctgaaatgtgttaatttatagtttttgtgatcctagctgaatttgtgtttccatgggatcatttgtttggtttgctacaaaatggggttatccttttttaccctgttctttatttagcggacggaatagtatgcagatggcatgaaatagattcctaatttgggtatgtgtctttcttgtctaagatgaaagtgtatttttgtgcacatcgaacttgaagatttcaaaccactgtcttgaaatcatatggatattggtctgtttgattactaagctagtgacccagttgtagtcacttgggaagttgttccaaagcattgtctcttggacattgtggcactctttgttaaagcaagtggatcaccagtgccaaataggagagataagttgttcagtttattgtagaaatttgaccttgttatgtagtttgactttcttgaagctaactatgtgtctgtctgctactgatgaaataatatatggaataatggaaatgatctgcactacacgtgctttactatttgattattcccttgttacacttgatgtgctactgtttctcacactatttaaagcttggccaaccttgctaaagaccctttccacacaggaacttaggcaagctattctttgggacaaggttcatgaattgtggaatgcaccaatgcagcctgaattagtccccgagtggaaaacttggaaacaggaagtcatgaaacagttcttttcatctcatccagttggcaatgctggcaactttgaacaacacaattgttatgatgatccaggtatggatcaacaagctcgtataaaacattccaaactcg

SEQ ID NO: 24043 - DNA, 701 bp, Oryza sativa
  unsure (1)..(701): unsure at all n locations
nnnnnnnnnnnnnnnnnnnnnnnnnnnnnnnnnnnnnnnnnnnnnnnnnnnnnnnnnnnnnnnnccctaacggggctgcctgcattcctcctggaaccccgccttctatgcccatcgagacggacggtggcctctacgtacaagaagacgaggtcatgtgagataccggcgattcagtggtcacctcatacgacaactgccatagaaagcattgcactggtttccataattccattgggtgcttggtacgttggtatatataaattatgaaggtgatcaaaataatgaaatctggctgttgtatatatgtacgttgaaatatcagttctcgatgaacccaacaatagttaacacaagtctcttttttttgcttaatggaaatggattgtcttttagacgcctatgtttggcttcactgcgtaaatatataatattatgtcacgtgatacttatcaactggcaaagttttgcagttgggtatttggataccagtaaaatcgactgtctgagtacgatttatagccttcaaggctgtttggactgaagtgatgttgagcacgtaattcgtttgtttcacatatccctcagttctctgctcaactataatccagcaaacctgcgagctgaatgaacacaaagcgaccttgtgaatttgtgatattaacgccataaatttatgtggcttgtgtagctagcctgca

SEQ ID NO: 24044 - DNA, 564 bp, Oryza sativa
  unsure (1)..(564): unsure at all n locations
nnnnnnnnnnnnnnnnnnnnnnnnnnnnnnnnnnncggcgattcaggtcacctcatacgacaactgccatagaaagcattgcactggtttccataattccattgggtgcttggtacgttggtatatataaattatgaaggtgatcaaaataatgaaatctggctgttgtatatatgtacgttgaaatatcagttctcgatgaacccaacaatagttaacacaagtctcttttttttgcttaatggaaatggattgtcttttagacgcctatgtttggcttcactgcgtaaatatataatattatgtcacgtgatacttatcaactggcaaagttttgcagttgggtatttggataccagtaaaatcgactgtctgagtacgatttatagccttcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24045 - DNA, 9380 bp, Oryza sativa
ccaattggtgatgagatatggggcatggatgaataccactatgttcttgattcagagcactttggttggaatcttaagaatgagatggttattgtttgtgaagatgttagctttggcagggagaaagttccagttgtctgtgccattgatgtagatgcaaaagaatttccatatatgaaacctggagaaattttgcaaagtgaaaattctctgccctggcaaggtttccactacgtcacaaagcgtttgatggattcatctcttgttgattcagaggtattttctggattttgcttttatgatgaacagaaacttgcatattaattgaacgaaaggaaccaagactatttttctttggtttttatatattgcaacttttttgtctcctgcaacttagtcttctaataagttgcttacctgcagaacactatggttgggtgtgcttgttctcatgcccattgcagtcctgaggaatgtgatcatgtgagcctctttgatagtatctatgagaacctagtggatctccatggtgtacctatgcgtggtagatttgcatatgatgaaaatagcaaagttattttgcaggtaataattgttactggcgtatatttttacctacacatgtttttttgacaagtactctagcatgtatggctttaggaacattggaaatatgaacagaaatgtgcactagtaccaccatcaatttctgttcaagaatgtgggttttgaccaacgcaagggaagtcttacatttgttttctccaaaatgaccaaactatcctaataaataatctcttgtccacttttctccacaaatgggatgaggatgggagatattaaataagagcaaaatgtgaagctgtgctttggaaaaaaatgacatgtcctccgtatcgtgaaccaataaagtagtcaaaagtggccagtatttgtgaatggagttgtgctggctgttcttggttgtgatatccaaagcgatttcgaattttgaagcttggcttttaagaataattttaggtagattttttagttgtcttcttaacagtcatgaacatagagctgggcaatgaaagagatgaaataacccttaaaagttaatcctaaatcgaaatctaaaatttaaaatcacctttggattaatccaaagcacaagcaagcgcagccccattgatctgatcattgataccttgatatctgtgactagctggtaatgcaaccttttttttctttatgatgcaagcacactacatttttctcaagaagtttgccatcttattttgaaatttagcttaaactgcgattaaataaatacctatcattgtgtgttgccatctccctgagctcaatatcatgtccacttatatgttcttattaaggatgtccttatccactatggtgttcgtgtatagcatactctaacctgttttaattactaatgcaatctctgagtcccatagctgtatcaaaagccttctgttgctattcacccttaaacttacttctggagagctgcagaaacaatagtagattggttctttaaccataatttacaggctccacatccatggtgacattatcgcatacaacggtttcatctaaaaaacaaacctctttattttgtcgtgatttgacctttacatccatggtggcattatctcgttcatcttttatggtgacataactaattccaatagctatctgccaatgtcaaaagggatgtgcgtgggatttgggctcattgatattgagttgttcttcaggtctgcagataatgtctgactgagtatttgtacaccttttgcttgagctcatttcaaagatatccatcatctaggcattcatttctcatcattttattgtataatttgatgtctatgtgttgttaaatttgcaggaaggatatcctatatatgagtgcaattcatcatgcacttgtgatgcctcctgtcagaataaagtactgcagagaggactgctggtaaagttggaagtcttcagaactgagaataaggtgaaatattctccacttgtttttttggtttcctgagcgttgcaccttacctttgacgtcaagataaaacctgcttacaagtgatatttttgttttgtcaaatgctgcagggttgggctgttagagccgcagaacctattccacagggcacatttgtatgtgagtacattggagaggttttgaagatgaaggatgatggggccataagacatgtagaaaggtttgatgattctcttgttatttcttttatttaggctagaaatctattggaatttctccggtgcattccatgtaagcttcattgaattttcttggtcattatgatgcccagtcttgcctaaatgcccaatctctgcctaaactatattttcatcttgcacacattctggtttcacgctgttcttgttctatagtctgaacatttggagtattattattatgctcagaaactgataagaaaattattggatctcagggaggcaaaaagtggtagcagctacttgtttgaaatcacttctcagattgacagggaaagagttcagactacagggactactgcatacgtgattgatgccacaagatatggcaacgtatcccgttttattaatcataggtaactggactattttatgtctgtcccaaaatatattaacttagaagttaatatattttgggatggaaggagtacttgggaacatcttactacgggataaatttgttctggaaccaatgcttttgccccttcattgcagctgttccccaaatctcagtacgcgtttagtttcggtggagagcaaagactgtcagcttgcgcacattggtttgtttgcaaaccaggatgtaagaattttttgaccacctcatcctacatcgttatacgtaccttgctaattgttgtttcactgttgtccagatcttgatgggagaagaattggcctatgactatggacaaaaattgctacctggtgatggatgcccctgccattgtggtgctaagaattgccgaggacgtgtgtattgagtttgcagtggggcagaaaatggtaacggagcagtccaatccttagcatatctccagaagttcctacaatggcgtcacttagcaagggatagcaatgtttttttctagagcaacaatgcagtgctaggatctaattccccatgcatcattaggaatcatcatataggtctctcaacagttattaggcacaccatacgattgattttagtgtggcacacttatgcttaactgatcatttgttaggagcaacctgaaatgaaagcagttcaggctgcattgttcgtaggccagaagtgaagtgtcgttgtaacataccttcattcaatttttactgctcataagcgccatcgtcgaagttgaaccaaaatagttctgtttgtgttgcagtgcatgtttaatgtgttgtaggaatttgttaatgcattttattatggaaacaaaaaagatagaaacaaaggaaagctgactttactactggaagtcgaagtagttgtcgaaaacattacgacgaaccgatggaaacaaaaaagtcggaagtagtcagtttgttttctcgttaaaatgtgatggtatgaactgggctgataacgtgaatttgatcaatcagaaagtggtcgtaaacaccttgtggcatttctttgttcaacatgtttttaaactaattaagtgcttcgttgacggccacaaccaaattttaaaggcaaaattggttctatggcatcgaaagttttcgattttgattctatagcattaaaagtttatggttcactttaatagcactgaaaactacatccgttactatttttagcattccgtcagcagttccgtcggctcaccccatcctacctctatcttcttcctcctgcgctctccctcctatggttgacgctctccctcctatggttgaccactcttcaaggcatcaggcgagctcgaccatgacagtatagcgctgagcgagttggagccttggatggtggcagctggttctggcatgctagaggcggcggctcttgggtcggtagacaacggatccagggcaaggaggagcgggtcggcactcaggcgagcccgcaacgagcgcgagggtggtgcttcggggcgaatttgagggccgatggatgagcttgatcgagggcagcatgtcggagagagctcaagggcgccgacaataatctggagggctttgcttccgtgcggacccgacaatgccggcgacgagctggacaatgacacttcgggcgttcatggattggatgagcttgaggatgacgcatctaggggagaccgagggcagtgcacgcggacgaactcggaagcggcacggccgcggaggaaatggacctggttgagcacgcaagatttgaacaagctctagcatggccatggcggcgcggtagacgagatcgatcgacgatggcgctgtccgggcaaagctagaacgtggatagatcacacctagcaagcgcggatgaacacagcggtttgcggatgagctcgtgagggctcacgtattacatgacgagctcgtggagccagcatactgtgttcgcaccatggctgaccggcctgagctcctgtatgactgctgtttcgagatgagaaggaagtggaagagggccaccattggtgtttgatctaattttttgttgaaaaataataataagaaaagaaaactaactggagtttggatggaatgctaaacagaaataacggaggtaacttcagtgctatcaaaatgagccttgaacttttgatgctataaaaccaaaatcgacaacttccgatgctctagaactaattttgtcaattttaaattttaaagttaattttaaaatttatgataatctatttgtgttaaatgaaacatgatattcaaattgataagactcttttttagttatcctgagggggtgtttaggtgtcacatcggatattatatagtgtgtcgcatggggtgttcgggcactaataaaaaactaataacaaaatctgtccgtaaaccacgagacgaatttattaagcctaattaggccccgttcgttagtcctgaaaagtttggattaaattttggattaaagtggcacgcttttcaaactaataaacggtgcgttttgtgcgaaaactttctacatgaaagttattctaaaatatcagattaatccatttttcaatttcgtaataactaaaactcaattaatcacacgttattaacacctcgttttgcgtgaaacaggagattcaaacaccaccttaatctgtcattagcaaatctgtagcaccacattgtcaaatcatggagcaattaggcttaaaagattcgtcttgtaaattaatcgcaatctgtgcaattagttattttttagcttatatttaatacttcttataggtgttcaaacattcgatatgacaggatgtaaagttttgggatggaatctaaacatggcctaaaatatatccaataataaattcagaattacattgatgtctaacttgactgtcagttttgtattttgttaacttaattaacttgaaatttgaaataagaattagaaattgatagttaacgtaggatcttctttaaatcccaaccactacagtttggagaataaacaatgcattcaatatataattatcaagttttttactgatgtgtattctttttaatcattccaaaaataaacaatgcactcaacatacagcgcctgtttggcagggtttcagcttctaaatttaatttatgaagttgggtctaaatttgagtcatggagcatactaaatcaaaactctacatttctaatttattttataatacttttatgtggagctgtttgattgtgatttagctataagagccctaccaaataggcttatcattaagtacttaaatacgggttatctactcatgcctcataatataaaaagattttagttatatactggaatagccagattctcttatatccgtttgtttttctcggttataaactgtagcttaaaaaatgccaccctttgattactcctaatcagttcaacacgtctctggctctctccgcaatccgagaggcggccaatatatccggtcgatcggcaaataccaccgagagcgtaggtaggccgctctcagcctctcatgactcgtgagagatcacccggtcgcggtgccagctggacgctgggggtggacgaggagttgaccttgacgtacgtgggagccgtcacggcgcgtggtaccaacctgcccggagaccagctaggccgccgacaccgccgtggcagcagcctggatactccgcacgccgattgtttccaacttaatcatgcatgcatgtacgcatgctaaaaattaggggctaatttagttgccgcgttcgctactttatataggaacacacatatcaacttaatttaaatttgtgataccgcacaaaaatacatgcaaatattttttttagaattacacattataacgcagaccctcgtaacacacgcgcactcacccctataaacacacacgcaaaccctacccttatgagcatcttcgaagactcacaacgcacgcgcactcaccactatgagcatcttcgaagactgggcctgcaaatcctggagaactcaccactatgagcttcgaagagcatcttcgaagactgggccggcaaatcctggagaactcaccactatgagcatcttcgaagattgggccggcaaatcctggagaattgacaagtcaccacaggcgcttcgctatcgatgggtacgtcgcctaccactgaaaacacagcgccgttaaatcctgaaaaattcgctcccatggggagtcgaacccaggacctcatgtgctattgaggctcttgtaaccattaggctacatgtcctttcacaaatacatgcaaatattagaaaatgataaaaatttatttggagacaaattgtatgggtggatttacattttctcaacgaatgatacaaaatatattggagtcaaaatgcctcgaaagactaacagttctttttctacaaaacaatgccgataaatgcagccaattgtttgatccaatcaaaataaaatatgttattttataagttaattactccactgttatttacagtaacttttaccctctcttgatcaaccgttcatattactccacctcttattatttctaagtatcgcaaacaccacgaaagctcggctcgtgtgatttaaaactgttttgcgtttagtacaatccatatatccttcaccttcagctattatgctacaactacaggcaagggtatcctggcgggcaaaacttttggctgaggacaaaagaaggcacagagaatatgatggcctccagaaggaacaaagcggccgtcttcgatctgctctcagatactcattgaccacctttctcgttcgcaactaccaaaagtcacccacacatgtgctccatgcgcctatctccccccgaccctaccaacaacatctatacaaccaatgaattatagccagaagagaaaaaaaatgcgcacactctcatcaagggtcaatatcaccatttaactaggctaatctcatatgactcatttaaagatacacttaatagtacagtgataagggtgtatagttttaattgtgaggtcttgtgttcgatcgtaaaccgtgtacactacaccagctggtttattataaaaaagattaatctataatgcgaaagaccggataattcacttttaatctcgataaaattgattctccgataggaggaggaagaagatgacgatgaagaagaaaaggatagctttgaaaatctgtagccaagaatgcaagagacatagctaggcagccaggataagcgaatgaattgaagcacctctttactctttagatcgaaggtgcagcagggaatcccattcaacgctaggcatatctgttaaagtatgaatctgtttcttttgcgagctaggaatcttctcaaagttagcacatatgtatatatatagagagagagatggggcacaaagcttgtatatctccatggaaaatatagaatattactattttccgccgtgaggaatattactgatttgaggctagctgcatatgcgctcgacaacgatgccaactagtcacccacacgtgtagtcacgacagcatcaccagttacattatccggcacttgatcacgtgataagatcgacaactgtttcgtataacttagatttttgcattagatttgctgttagatacttctttacaaaattttccatgcctctggaataaaacacattcatgcatgtcctttagttcacttcaattgcgaggcaatataattcatttatgttttcaaagaagaaatgtttcttaggggagatttggtttgcccttttctaagatttatctagctataggatcaaagatgagagctactcatctcgctagcaacctagcacatcatggagaaccaagacaacaaccaaaaacgcctcgaggcacctcgtcgcactctacttttgactgatgttaccggaggcaggttcctcgccaccagcggcacctgcctcatagcggtggtgaaaaaataaatcctagatagccttatcatcaatagtgtctagagatggatctagacccctggtatccaaaccatggcctggggcctgaggttcagaaacccacaaatccagtagtcatttttttcactatggtgaaccgagatgacgaaaaatcagtataggtcggtccagatcttgtctttaaaatgagtctccttggtagtgtctttccgatccatcaatacggttctgatcattcatttgaccacgtcatctatttggggcatcggcggtgatgcctccacatgaagagcattggtacacaaccatgcgactacaagaaagtagcatgtagagtggtgattagtgatggtggaggtatagctttccctaatatccgacctccatatttgttttagataaataaagtttttattgaactcagccaattacgtcaagatgataaaaagcactgagcgcactttcgacctctgcataattaggatgcacccagccaaaacacacacactaaaaataaagattgtatatggtagcttgatggatatgtaatcggtgattggtctttattggttgtttcattgatctagtcatttgctactattgacatttgttagttagtttcggcaagacgtcaacttgaacggcgttctatttctaaaaacatttccgtgaagaatgatatttgagatttggggagaaatctcttgatcttggattttgcaataaatataatgttcttattggaggcgttaccatgaagactaaaatctcaccacattt

SEQ ID NO: 24046 - DNA, 564 bp, Oryza sativa
tgatgaggaggacgatgactccgaaaggcggaaccaatcaattgggaaaaagctatggtctttcttcactacatgacaattgcagagggctactgaataggttatttctagcgtttctgttttcgattcatgacatgccattcttggaactctaggttgtgtgcttggtgatgatgatgatgtactagtagattttcccacttcaattatgttctccccctgtaattgaaatatatttgtagtagacatagctttgatgggcgctcacagaagttagcttttgagaatgtacaatggcgcgatgcctgtaactgtcaagggttgaggcttgtaattgttgttcattttgttccaggatcagtttacgtggttgaccaccttgcgaagtttgtggcatttgtcaacgcgggaagcttttttttttctcgtccagacgaccagattgtcttccatgtctttgtgcatcttgaattataggactttgttgactggcagttcttcagcttgtgaaatagggggctcaacagtggcatccaggatcagggtaccgagctcgaattcgcc

SEQ ID NO: 24047 - DNA, 657 bp, Oryza sativa
  unsure (1)..(657): unsure at all n locations
cacataaagtataggtgccagaaaatcactcattccctggaagaaagagcgctcgctgcatgagcaaacaaacaaagaaacctagacaacgaaatttcatgctttataggtctaaatatttagtgtagcatgattaaccctgtcacttgtaataatatggctacaaaacaaatgaatattctgcagtgccttgtgattcagcatgtatacattccttatatttaacaagaatcagggttatgtgatctagtggaagctttctagcaaatgcagtgtttttcacttaaatgacttaaactggcaggcagttttcttcatcagctgatgttggataattgcgggtgaagggtaatagaacgtgcaaacttacttggcaatagccaaggtcgaaattatagaaggaatacgtcaacaggatatcccgtagcacaagaacattttgattgtcatctccttcataatatggaactgatctatctgtcctcaccttgatatccaaaaaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24048 - DNA, 470 bp, Oryza sativa
  unsure (1)..(470): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtagcaataggcataacatagaatttttgctacactttcaatttgtgaaatctatttttttaaaaattttcaagagccactgttatgttattaagttgtgtctcagtcatggccaatcaagtagttcaccaggaagaatgacttgagggccacgagcccaagtcttgatttggttgctgcaaaagatgtagtgaagcaaggcagcaccaatgacccatctgtggccgttattacgaagtaaaaagagagatgacggagctgttaggttt

SEQ ID NO: 24049 - DNA, 549 bp, Oryza sativa
gaacagcttggttggttgatattgcagcagatatcatgcataataaattgtacaggcatattacggttcaattttgattgtaagatttctgtttgcaaaagctaccagctacgaaagtgtgagccatcaattggatgatttgatatgtgaagctgaagttggataagaggcttagacgcatatgagttggaaaaaacagtagcagtagtacccaaaagatctgtgcaaaaagttataccgctggaacatcatgagcagaaaaaaacttagtaaatacgaactgctgcttgatttcagcgaaaataagtttgaggagattcgctgagctaccagcatgatatgtttctaccgaaaatacaagcctacccatcgtaatcattagttatcacttagtgctaatacttgatacgagaaacttgaagccgcttttgctcccgaaagagaattgtctagtgaccatacttctggaactcccactcgctgttgtctgcatagataaaatagaaaagtaaggcacggtgaacgagcagaggtaacaaccacaccaat

SEQ ID NO: 24050 - DNA, 908 bp, Oryza sativa
  unsure (1)..(908): unsure at all n locations
nnnnnnnnnnnnnnnnnnnnnnnnnnnnnnnnnnnnnnnnnnnnnnnnnnnnnnnnnnnnnttgcatcgaattggcgtgattgaactctttgttgtgtttacctgcaggcccgtggcatccccgaatttgttcaggattcccaatagggtttgcacttcttggcgtgaaggatttaggaacactgctgcatcatctgcatagagagaggttctgaattttagtgcccgcggggctacgcttgactaatttggttatcatttcaaaagaacagaaatgaatggagataagttaaaagtagaatgtttatctcacaactgacactaaaactgttacttattttggttggccatgagttgtaattcctccatagtattatacttgctctgagatgctcttcaatgagctaataaagtgttccgacggcaaaacactatcttcagtagacagtgacacttaactgaaaattattgagcatccttgtaactggccgtcagctactagtattatatactggactaaggtaaggtgaacgcataaaagtgcatagtattttttaagatgcatgaatttattagccatcagccaatgaaccaaagtttcagcatagattagcaaagacattatgaattagtcctgaagcacacagacgtgaaatgtctcacaaacagatagtacagcagcatcagtgcatcacaccaatgtttaccagattgatatattaagccccccccaagtgatcagtaatactgtacacaccttgacacccttcaaattacatgaaacccaagaaagtaattaacacaagccaaactatgcatgcatggatggatggattacgtacaattaattgcaaacatcaagatgatttcttctctcattttttcttttcgattttgctccatgatag

SEQ ID NO: 24051 - DNA, 22962 bp, Oryza sativa
  unsure (1)..(22962): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggagtagcagtagtagtcctatataaaaccgggagagggaggccgatggtgatggccccaccgttttaaccttgattcatctcctagtttccactgatctccagcgctttttggatcgacggcgacgccgccctctccatctccagagagagccctcttctccgtttcttcctactaggctactactactcctcctcggctcaaccctcccgtcccctcacccccacgcgcgccgccttctccccagaacgcgccgcggcgaagcgccgccgaagcagcccccactcctccgcgcgcggcggcggcggcgcagtctccagacgcttcctcctccggggatctcggtatggctgactactgggttttttttttcctttttcgcgattcctccccctgattaatctgctgcgattccgtacaattctgccgcgccctgttgcatatagattactcgcgcgggggggtttggttggttgggaggtggttttgttaatctgtttgagagttgagttgctagtggatgattcgtgtgcggttttagcattggcgggggcgcctctgctctcgctctctctctctcgcgcggcggcggaggaagcctcgcttcctcgcggggcgcggtggagtgtgacggcctcgaccactgcttccggaaatcagtcgcagccttctcccctgtgtgcgcggcgtgctcgcgcgcacggccggtgacggcgaggggagcaggtttgtaggagcacgcgggccggggcggcgttcatgtaaggttggaatcgaactgaatgtgttcggtttttctcgtagtcatcactccgccgcctccgcgccacgttaggtcggttccatgggtttcagttgtgtagtgcgatccatgtggtacacggaagagccaatcccttgtagatgcaggatccataccctgtttgttgtctggttttcctcccatgattgaatttagtgggaacaagtaggatcgttaagaaattctactactacctcgacagatggtgttgcattcgtacacgtttttactgtgttctactatggtggtgactggacttcagtttagaatgttgttatattcttgatagttaaggttaatgattgtaagtcactgtgttttcttgaattcagcctttgaatggaccgaagtgattccatggctgattcgccaaggaggcgtaatggccttctgcgggaccaggtccagttggtgaaaaggaaggacacaaatcgctacgaaatcgtccgctttcctgatccattgtcatttgagaaaggcttctttgttatgatccgtgcctgccagcttctggtgcagcacaatgaagggatgatttttgttggcgttgctggaccctctggggccgggaagactgtgtttactgagaaggtgctcaatttcatgcccggtgttgctgtgatatcaatggataactacaatgatgcaagtcgcatagttgatggcaattttgatggtaacccctaagttccaagcacttcgcatactatcttatcatcccgtaatttggacagaacttcctttacatttgaaagatttccttaataagcacagaacaatactttgcatacatctgaatgcattatcttatagttacttcttgcatctgcatatgtatgccctgataatagtatgattgttgtacgtgccttatgatataatcgaagtattagtgagtttgattgcttggagctgcattcaattgggagcggcagtggtgctaactaactacttaactgagttagtgatgtctgatctttgtgacatttgaacagatccacgcctaacagactacgacacactgttggaaaatattcatggtctgaaggagggaagatcagttcaggttccaatatatgatttcaagatgagctgccggactggatacaggtagtttgtccttaaataataattcccagtttgtcactttttagtattgtaaatatatggtcatatgtctttatgttatcttttcttatggcaaacagaacagttgatgtccctagctctaggattgttatcattgaaggcatctatgcattgagtgaaaagttacgatctgtattggacctacgtgtttctgtcactggtggtgttcattttgacctggtgaagagggtcctgagggacatacagagagctggccaggagcctgaggaaataattcatcagatatctgaaacggttgcttcacctttttgaacttgaccctatatatgcctttcccctatcttttgtttccacaaaagatcttaatacaaaccaaacattcatttcgcaatttatattttgtatgtatagtatctttttcatccatctgtgttgtttaacaagatgaacgatggcatttttcaggtttatccgatgtataaggctttcattgagccagacttgcagacagcacatataaaaataatcaacaagttcaacccattctcagggttccaaaatcctatgtacattctaaaggtaagcactccttatttatgttccttttagtgtccatgttttggcaagatggctgatcattgatctcttcaccaatagcataattttaatactaataaatacttgtcttgtggtttatctagatggcctaacttttggaaatgtactcttgcagtctccacgaactataacacctactgacatcaaagttgctcttggtgaagatcatacagaaagcattgaagaaacttatgatatatatttgcttcctccaggcgaagatccagaatcatgccaatcttatttgagaatgaggaatagggaagggaaatataatctgatgtttgaggtatgcaatttattgcaatggctacataagtgcatatgtgtgatggatatagttggttgttttgttacaagaattacctctctggcccattattttatatccactttgttagttgttccctagtgccatgctcataggttccagaaatatgcatcttattcctactagaatattttcacaacagttgcacctgtagctcataaaacaaaaaaaattaattgcataacgagcatagtaagggaaagatcagctgagtcttaattgtatttgcattcactagcagctttgtaactgccgtgtttttggcaattttgtctgctgacttatggtgttctctaccacagcagttagctacttagcttagatatatactcctttgctataccttattatcatatcgtatttgcaataattttgaaatttgtgttcactaacttgtgttattgataatttgaaggagtgggtgaccgataatccttttatcatatcaccaaggattacgtttgaagtcagtgttcgtcttcttggaggtttgatggcattgggatatactatagcagctatactgaagagaaagagtcgtgtgttttctgatggcaaggcaactgttaaaattgattggttggagcaacttaaccgaaattatatacaggtaagaacactcttgctatttgattgcagttctctttcaacatgatctttctctgtgcacatcttgactgatactctagttattattatttgtatctatccacttgttaacaagatgcataaaatattatgttgctttttcttaggtgcaaggaagagatagaaatcatgtcaaatttgtagcggagaagttaggtctggatggctcttatattccacgcacatatattgaacaaattcagctggagaaactgataaacgatgttatggtatgtatttgataattatatatatacacacttctcaccttattactagagcactagttgtatttcttagttttggggtggtttcaaataagtttacatgcaggcattaccagaagatctcaagacaaagctcagcattgatgatgagctggtttcaagtccaaaagaggccctttctcgggtttctgctgataagagaaacaaacacctgaaaaggtttcttcatgtcatctctgctcaaaatttattttttgtgaaatgctatactttgttgaaaccatggaaactgaatcaagctcgctgatgttaccttgtggattctgtgcagtggtctatctcattcatattcaactcatggagataaaaatattgtgaaattgagtaaattgacagaaaccaacagaaggtttggaagtgggcgagcccctgaacctcctgcaattaatcaggtggtcattctagaatacttgtattagttatagctaccatactaattaaaacatttttttcttgtgaaaaacttgacatagataacactgactcaaaattcctccttgtttgctgctgcttgtagggtgctatcactcagctatccgaacagatttcaacgttgaatgagaggatggacgagttcacctctcgagttgaagaactcaactgtaaatttgcaataaagaaatcatcgaccagtcagcaaaatttagctcttccaaatgaaacttgcaatggttctgcacctacaaatctctttgtttctcatttgggcaatggtaccctgatacctcattcgtcatcatcgaaccaacttttgaaggagtcccccattgtggatgaggtatttgccttactgttattataatcttatacatgaggtgttgtccccccacttttccacttggatttgtgggtttgttgaaattaagtcatacttaaggtaaaattgcatcatctgataatataatcttcgctagtctgtgttacagccatgtgtttagttgcattctcccaaaccatttcaccttaatcattgactaaaactatggcttggtcatctgcagaaaggccaacagtattttttttcaaaagaatttctgatgccagaaccagattcggtcatcaaacttgaaatctcaccaatagattggttatgatgggtccatttttttgctattattttcgagacacttttcagattttgtttgaaatttagatgtagaattggaaactttgtacaagtcactgtattaatttagtcagtattcaaataagtgaatttagactgaagtgaaaatttagtgggccatcagctactggtactattgtttgagaggagaaacaatagatagagaatagaatcatggtagtagtcagttagactcacatgaaaatagataaacagggaagtgtatggaacttaagtttatcttccaatcatataggaagaaaatcagcttctgtagtttatgcagtgaaataatgtatccataaaaaacagtggagttgtaacagttgatcttggcatgttgcatcgggcctagattgctaactatacatacttctatgctccaaattttttggcttcacaaaaatgttgtgatgtgatttgaaccatttttatttgctgacagaaaggctgtgaaagcttttttttcagtggcatgttttttaagatattgtactgtataatgtctcgaagattttatattcccgatgtatttaatttatgttacttatgtcaaaatcatattccaaaaaaaaaactctgtgttctgatgaatttgtttttttcctgttaaaatcatatttcaaaacaaagaacacttcatacatgattgctgactactacctatttttctagatatgactcatctttctgtatgaatcttgacatttattttggtggactttctgtttccttcgcagattaatgccatatcaagaggtcagcgccaagtgatacatcagcttgacaatctgaccagcttgcttcatgagcatttggccttgacccgccaaggaaatgcagtccgcagaaacgggatcctggaaatggacatgtccatctgcccactcattgccctgacaattggcggtttcggctatttggtgttcaagagcctcaaccggagctaaccgaagcgaatcaggcagcgacatgctgctttaaaaagctcaccaccaagttcaaccaagaaccagagaaagccaagaagtctcaaaacggatcttcattcttcagtactcagtccagacaccaaaccgatgttctcctgcgagctatagacggtcctcactcagatcattggtctcatggggaccatatctgatagattttacaatttcaagatagataaactcatataccagcacaagcaacagagcagtcttgatactcgggccaagttacttggaagcttaaaaactgtgtactaaagagcgtagagttatacaatatcgtctgtaatggatactggaaagcccccagtatcaataaattttggagacgctagtaatcccgatataatgtcgaacaagtcgtgggaaaagagcatagtcattttactggaattgctgttgtcttctttgtcacctgtgtgtgggaatgcctagtgatatttagcaagtcagctctgctgtcagcgtacagttggatcttgattttgcacctcgtcatgctatcgtctgaactttgacgtcacgccgttggtccaacctcacatggtcacacgtgaatcagcgattattatcgttctcgtctgcctcaggatatttggcaattgtgaactaccacgggtaacaatataattatatttttgtaatatttttaacaaagtatgatcaaaatatcactcaaaaaataaattactcccctgttttaaattacgtgttttaggtttgtcctaagtcaaatatgcatatctttgaccattagtttataaaaatccgtgtagttcaacaacacgtgaattataattcataaaagtatttctcatggtcaatctgaaaatataatataaatctaataatgctaagctaaatgagtttgtagaaattgatggtcaaatattcaaatggttgacttatgaaaaatctagaacgagataagtaatttgaaactgagtgaatagaagttagaatataagaaacacaaattttccatattctcatcaactagctactactccctccgtttcacgttataagacgttttgactttggttaaagacaaattgtttaagtttgactaagcttatagataaatatagtaatatttataacactaaattagtttgagcaaaacaataattaaatatattttgataataaatttgtcttgtgttgaaaatgttactacttttttctacaaacttggtcaacttaaagcagtttaactttgactaaatcaaaacgtcttataacctgaaacgaagggagtactcactaggtgattcaaataatcctccccaaataggccttggtgtgatatttaaaataaatttactctctcacacatgacacatgcaccaaaaagaattaagagaaaaactgtatcttcagcaagaacccaagcatggcccgttaatactttgggcttttgatggcccgttaatactgtacctacaagggcttggactgaggcctttattagactctgcgccgccgcctcctcttttctattttacctctcgtctctctcctcgcggtcgcttctcgtctcgtcccaatctactcctcctcctcgcgctcccctcccaccctagggttcgccatggacaagggcgacgtcgccgtggccgtgcccccctccatcgccggcgcctcctcctccggggccaagaagggcaagcgcttcgagatcaagaagtggaacgctgtctccctctgggcctggggtaagcgtccgcgtccgcgtccgccgatggcgcccgcgtctcgcttgttggctttctcgtgtgcgatctgatgcgattccgtcgcggttttcttcttcttcttcttctcgtgcagacatcgtcgtggacaactgcgccatctgccgcaaccacatcatggacctctgtgagcacgcgcgccgctggccttccgctcgcccccgctccgatctgctgttcctttagattctagggtttcttcttagcttgttggtatggcttgtgatgacgcgggtgcgcgtgcgtgtgttgtgtaggcatcgagtgccaggcgaaccaggcgagcgccaccagcgaggagtgcaccgtcgcttggggtaacattgcttcttcttaatctcccgttaattctaattctgtgccgatgcagcagtagatgtaagtgctgattcagccatgaattgcatggtttcagttagctgaagccggtcttgccctgtttattctgaatttagttttgactttgatttcatagttcgattgagtcaaattaatccatgtgtcaacctgttactgtgctctcagtacacgtcgccttgtgttgtttgtcattggtttgctcatttgataatgatttatcagaatctggggatcgtgctttcccaagactggttatatgctgctaggaatgtttttctctcgaatttcataaaatcctaacatctgttttgctatacgctattttgaatccttcgttctggaattgaggaatgcttctagttttcatgctctggagtattggtgaattgagttgtagtttaatggatcctgcattatctgccgcctctatgtcatttattggtaccagagcatgatttttaatatcgtgtataatatcatttgttgctgatcatgtgatttgcaataccatgttattattagtgattctgataattgcaagttcttgtgatctggagtagttttgactggacatgtatcaaatgagtgcaatgtgattatcttttctattcttttatatgtactggttatattcatagttggaaatttgtactataattatgcatggtttgctatattggtttgtctcttggttttttatctaagtctataattatataatatgtcgcagttagctttggacgtgacatggcccttgtagaatatgttgaatttatctttcataaagaagtatgtagttatgataggataattgaatggctactggctaggagtaccttcttctggattaaccatctactgttcaattataattataccttgaactatgcacacatgaaactcaaatatgataatacagttcatgtctgggtttcctagttcctatgatttgtcaaagagaatcactggaatgtgggttggggagggtgggtgagtgttcatgttagctgtgtcaattgatggaagtgaattcttgcatctggaactagttgaagttagtggtgtatattttcatcaaaggcttttagctacaattgctttatatatttgtatgagattcttgtgtgtggatcttccttggctacccggcatgttaatatgttcttcttctgcccacagtttaatctactttgactgatcttatgtttacagcatgttgttgtttagggatatgtacacttgcaccttctgtgtgccctctggattatatgttcaagtattgttttgaattaaacaatactgacttgcacagtcaaatgctatgttcaatatatttataatactgaagtttctctcctgggggagtattatggaactttgttttctttccgtgtaactggattcttctcgtctttttgtgttgcttttagtggatattgcattttcgcagtgaattaaatcgagctgtgaagtcaactatccatgtactgatgaacaatctatctttgttgtgtcaggagtttgcaaccatgcattccacttccactgcatcagccgttggctcaagacccgtcaagtgtgccctctaggttggttgccctggaaaatgccacttaattggtgtggttgttacctctgctcgttcaccgtgccttacttttctattttatctatgcagacaacagcgagtgggagttccagaagtatggtcactagacaattctctttcgggagcaaaagcggcttcaagtttctcgtatcaagtattagcactaagtgataactaatgattacgatgggtaggctgcattgttaatgtttcagaagcttgtattttcggtagaaacatatcatgctggtagctcagcgaatctcctcaaacttattttcgctgaaatcaagcagcagttcgtatttactaagtttttttctgctcatgatgttccagcggtataactttttgcacagatcttttgggtactactgctactgttttttccaactcatatgcgtctaagcctcttatccaacttcagcttcacatatcaaatcatccaattgatggctcacactttcgtagctggtagcttttgcaaacagaaatcttacaatcaaaattgaaccgtaatatgcctgtacaatttattatgcatgatatctgctgcaatatcaaccaaccaagctgttcagtctcacactgtctacaatataaagttataaaagctcagctgcgtatagcatggaagcagcgctttacttcccaagcacggtgaagagccatgagcagggaacaagtggtagcgaatcatactttgcaactttacaacaattaatcagaacatttgacatttctagattctcaaaacaaatcctattttcaattacccctctcaccaaatctgaaaaaagaaaaacagcccaatttgatacaccttagcgtcatgcttgcatcaagcttctcctcgcaaagcagtgtgtgcctcatgctgcaactgtacctctcttcgtgacagtatatgggttggtctcgagcagattctccagggattttgccttcctgcttctcccccgaccagcctccttgagtagctctgcaagcctccgcttttcgtcatcgacgtctgggttagctgtgcccagcttctcttcgcgcatcccaactacatgttccaagatctcaatggcctcatccagcctggataacataggaaagcaggtacaccaacatgttattctaagaaacaaatcaaaaaccttttcgcattgagcaaacaagctgatgtgaaatacattttttttccctttagatactcattagtagtttttaagaagtatctcagaaagattgctatgcctcttcagaattctgatctagccaattaaactagggtgttagttcttatcaagaagccagctgtattggtaggtcaaaacttgcatcataattataaagaatattataaagctgacaatccacatgacatacaaagtagcatgaagtttccacacggacaattgaaagcaaatgggcaggataaagcaagaggataaagtatttgcaactcttcttttacagagcagctggctacatgcaattaaagattgtcttaatatggtcctacttcaattaaattgatcccactttataacaaccaatatcagctcaattcaattgaagctgcaaaaggctgcacaaagagaccaatcatgtccaagctggaagatgcaaattgcgaacgacaaacataaaagaattggcactcataagagtctacacaccgctactgtctccagggcataaagagcaccaatatactgtgtgaatggtcacatggagcagttatcagtgccatagttgagaacaaaccatattgatttccatgttcacattgtgataaatcatcgaggatattaagataaactgtaccagggaccctttgcttttgtaaattttaattggaaaaaaaatattatctagatggctggtgataattagatgtctaacagaacaaaagtcagatgaaaagctagcagttaatttgccgaagtccaagatatactgcgagatgaggaagatgtccatattcacagctttgctaccgatgtaagagtctattaaccgtaaaaaataaaaaactgatcaagaatcaatacggagcttaccttcccatggcatcataagttccagcaagattgctgtacactcctaaagtatctggatgataaggtccatattcttgctccagaacagctctagcttcctcaaacagttctgcagcttcatttatcgagtatctttgaacacatgccaaccccatctggttcagggcaacaccaaagaaggccgtctttttctcaccacaagtgcggagctttgcaatcgcactcttgaatgagtcataagcttctccatagttccccaaaatatagtgcaagacgcccatctgagcctcaattccagcaattgtgctctgttgaccggcagaattgttgtacatttttaaggccttctggagtaacttgagtgcttgctcatgctcattcatggtttcataaatggctgaaacatcagttaaaccggtagcaatttcttccaatgaagttcctggaataggtttctgataaattttaagggcattttcacagtatgattttgactccctcagcttccctgtcttgttgtatagatccgcaagccgcacaaaaacagaggccaccgttgcatgattctcccctttgctagtcttgaatacagtaagagctttctgataagaaaacacggcctcatcataccggcccaaggagagataaatgtcaccaatgctgcaatctactgatgctacctcagtttcctggccattggccaccatggccatgctagccatcaccagatgctctaaggcagcttcatgatcaccctttgtgtcacagataagacccatcagcctcctatcagctgtttcttctaatgaggctggctcaccattctccctgtggatatcaagagccttctggcacaatctttgtgcttcatcaagttgtaatgcctgcacatgagcttcagccaagtaccgacaagtctctccaactcttggatcctgctcccccaatgtctgcttctgaatttcaagccctgcggcataccattgcagtgatagcgcagtctggcctagcatcccataggtgtcccccaattgcatgcacccagagaacttcgcaagagcatgctcctgaccttcttcaattacagggatctcaagggagcgctgtagtacaggtacagcctcgtcatactttcccaagttgcagtagattgctgccacaacatgcaaactcattaccaagttcaagctcggttttccaccagcacatttctcgaatgacttggtggcacgaagagcatatttcagtgcccgacgaggattatcggaggcaatcaaatctctcgcatgcttaagaagaaatggaccaaggtctggattattaagcccagcatcttcagtcccattgtgtggattaggactagctttccgtcgacggccaactcggcttccgggtttgctgacctcggcctcaccttcctcggtggatgccttgccattaggaccaacagaagactcagattcaagctgtgatttcgcagcctttttcgacgacttcttcgatgaattcgaagacatcgccttgacgggagtcccattctcagctgcggttaccgcattagcggcattaccactcccttccccttcctcctcctcaattaccttcatggcctccatctccccagcaacaaggtggcgaagctccgagtcgatcctcgattcctccccgtcggagccgaagctctcccgcgagggggatccaccctcgcttgagctctccatctcgcacacattgttgtagagctgctcaatcgatggctccccggcgccggaaccctccacatgcatctccagcgcctcgctgtgcatgcttttcgaagccaccggcgatcttggggcggacgaattgtccttgttctgcgaggagttcacctcgttttgtgcctcctctgtgacaactccatccacgataattccaggcattttgcgggagaattgtaccaagatctttcagctcaagccccccaatttctcctggaaacaaaccgctactactatcagcgaagcacaaacgcatcgaaagaaagaaatcccgaagaaacatggcgggtcaaattggagggaaagaaaccaatccccggatggatctccaatctacagcgtgtcccatcaagaaatggcgcgggaaagggagggaccacggatggaacaacgcgtaccttcaagctcgatccgagccggagatgccggccgcgctcgcgcgcgaggaggaggcctgcggctcaatggctccggcttttcctctcgacgccacgcgctctcctctcctctcgtcttcctcttcctctcgatttgcagccgcgaggagagagagagaggggggaggggaggggaggaggacgaagcgtaattaagagctccgtatttatttacgtgtcgcgtgcctcgtgactgtcactcgactggggcgggccgtgaaaatgtactagtagttccattattaagcgtttcttaatccattcgtggctaatcagcatccttaatgattgtatattagtgcaaatgaccgccgctaagccacaagggtaacatggtcattttctcttaaagctatgtttaagcgcaaagtatagaacaaaaaaattcaaagctactggcaaataaataacgagcactgctatgcacacgataaaatcttttacaatcaacgtattttcgtggtccaattgtacgcacgcaagataggattgtaataaaatcgtatcaattttatcgtacgcataacaattttcaataaatgatactacagaattgcataatgtgtttaaacgatatggcatatgcataacacattgacaggcataataatccgatgggcaccaacgaaccgaacgatcgaccgatgtgtcaacaaaaataacggtcttattcagtttgagcgacgtgtgtttttctctcttggggttgcaggttaatttggtttcgcggttttgctgggttgggttggtgagctgaagccgtcaccgccgagctcgcgaaaacgcttgtcgttgaaattggacgtcgcatctgctggcaacatatatccaccaccgcatttcgagctcgatcgatcgatcgatcgctggttggtttgttccgtctaacgaaaagtagggaacggatgaaccacaggcagagagacagacaaggaaagaatgcgaacccactcggtatcatactactatcattcccatcagtgattaatttgttctaagtacgtccataatgtggcttaatccctacagggtttgcaatctcggtacaagaaattgagaattttggacccccccctagcacgaaacaacgaaactatttcatcagaaaacttgatttttatttttcatttttttgttaatttagaaaaaatattttaattaggtaaaaaaaagtgccaaaatgaaatatattttttttcgttttggagtaccccctcttttttttaaaaaaaaaaatcggcttcctgtagatttgtgctctccgagattgtaaacccttgaccgacatgctgcttcattttgcagcacagctcttatacttaaaacaaatacctttgccatgattgcaagatcttttcatcgatatgttattgcccttttctttctcatctctgtctctacatctgttattcctcttaaaaagaggagaagaggcttttgtctctgctgtttctcggttgttagccggagagaagaaggggcacagcagtaggccagagtggacgattggttggcaagacagcgatggaacggcagaaacgaaggttgccatgttgcaattaacaaacaaacaaaaggcatcatccgcaacgcaaattgtggatttttgtagggaggaggaggaggagaacgtttcagggtaggcaagacttgctcatcaccggcaggccggcgagctatagcttatcttttcctattggatgggttcacctgaaccacctcgagaacgtctcgtttctccagtcacgatagagttcgtggtggctggtcaattcttcgattagtgcgtttttttaattttaatgggggtgtgattaagctattgacatgttgctggagacagacagtgttaagtaaggcgagagagatgtagtagtagtatatgatctgtggccgtgctgtaccggcagcagtagcagtagtatcggcgcgcgatagtttcgcatgcgcagctgggatcgtgacacggtcggttgtcgcgatgccgtgacagccgcgtcgcttcatttgttttctcgtcatccaccgtacatcggcaacgaatagaaaacacatatactattggtcacgaccgttaaactgggtaaagctcggttggcatgttataatttcgaatctggatcatctgtagtgattgcaactgagcggtagtagcgggtaccattgaatgtaaatcggacagtctagattgtacactgttctagccatagcgatgtacttcctccgtttcacaatgtaagtcattctagcatttcacacgttcatatatatgtctacatttgttaatatcgatatgaatttagaaaatgctaaaatgacttacattgtgaaatagagggagtaataatagcgaaatactatagcatgggagcactgatcacaggtttacggtagcgttgaatctgaaccattaaccataaaacatacggctataattatataccgtcgttaacttgcagttacacgtataactgcacctaatctgaattccatccactcctgtatgcaaaaggaggtaaagatctcacactcgagcaactttgatcgtactttagctgattaacagcagacaggaacgaacgggatcagctcaaacatcttggctgaaaaaccaggttggtccttacctgacgaaggaatcctctctgttccaaagcaacagcgcttagcttccgtcttccgctacgcgtgcgcaccagcggacacacacattctactcccggtggaggcggccgcgggaagctgggccacgcacgggcgcccgcgcgtgaaacgaggccggatcacgggatacttgccgcccgcgaccgtttaagttgggccgcgccgccgccgtctcgtctcgtccggcccaaacagccgagcggcccacatggcgacacacggtgcgctcgcaggagcatatgcgtgggattcgcggcccgggccggtgaacccggtgaaaatttctaattcccccaatatattttttttctctctcccatttcccatttactgcggggaatcgcgcacgctgcctgcctgcccacctcctcctccccccatctccctcccctcacgtcgcaggccgagccaggccacgccgcaaacccttcttcctccgtcgccaccgcccaccgcccaccgccacctccacctcctctcgccgccgccgccgccgcccgacttccccgctcgacgccgtacgctgctgggccccacccaccgtcgaccccccctcggtgcgcgagcgctccggtcggcctgcgcccgccaacggcgtccgtggactgctgcacccgccgccgcctcccccgctgcttacgcgggcgcctcgccgcggagggtgaatgagtaaatctctcgcttctcctcctctccctctctctctctctctctctctctctctctcgcaggatcggttacgttccgcgctgttttggggggtttgggtcgctgggcgcactaatacgtttagggatcttagtttcatcgaccaaacgcccgaggaagcggtggttgctgtggtgagggtcgtacgggcgcttgaattcccagtgtatttttttcctctgccgcgagaacctgcctgcacattgaaacaagccgttagggttttgatgagttgggtagagttaatgctgccgacccgccctgcaacaatgcccacgtattcgcaccgattttacacgtttaaccaactcctcatatttccgatgtgattttgcttcatctgtttttgtgaaaattaggggactgggatttcatgccatatagttcaaacccaagcattgtttcctctgttaagttcatattgtggtgctatggttctcattgttaaactttccagaggaatgtgccatatctttgtactagtctaactattagtgcattatcatttgattgcatgtattcctgattcctgaatacctttactgtaatatgttttttttattacgtactgtaaacaattgcagtgctatttgttattatggtgtctatccactttaccttctactgtccggtagagcaagttttgttcagggcaaactcttaatagtttatggatcctaagaaattaggatgagaaacaaaaccaaataaatgtatcgatgcatatatagtacagtgggcaatccacatattcatattacccatattatctttaatgataaggggaaattccttattttccattggaaaatctcttggtctcttatatgccatcagccaacccttgtttcactgacatgtggagtgatggcatcaaggggattcgggaattttgcagtggaatgcaatatttcttttaattactgcaccgtctttgacattttgtttaaattacaggtctggtttgatctattccagtttgttttgtttgttgtcccacacttctgttgtacaatgtacatactataaacaacaccttttttttttcttctaggtgttgaataagtcactagtgtttatggacttcaaaccagcaggagattgttctttcagtgctcacgctagtcctgccttatttcatagtggattggcagatcataacataccaaagaaatgctgatggaccctcctgttatgcaagtagattgccaattacagaatgatttggagaaaacaacacctattacctacaatatgacacatgccttgtcacatgatgatcatgggtggcaaggttctgatgctcatcctgcaagtgagacagttagctgcaagcctgttgaagttaacaattgttctcgaacaagcatatatgagaacctggatggttcttctgaaaagtctcatgctaacttgtcagatttacctcagaagatgcatgccgagcccccaaaagagatgaatggttctgatgcatacttcaatgatgttagatttcaattgagtctaagcactgaaaatgatgcccctcaaagcacgtctgttgacgtcaatcaacagagtgttagtaatcaggatgcacctcattctcgggaagagacgcatccacctgccaatatagtgactgtacttaggccatgccagtccaatggagatgctcagccttctcaagacaaggacattactgaagaacaagtcaaagggaacaaggaagttggatctgatatggtaagtaataaagctggaactgatacattagaatgtcatgcagtccagaaagaattgcagtgcacacttcaagatctgtcagaaatagcttgcagcattgatccagtacgtaaaatatcttctccacaggaagagaatgagacatctgtctcacctaagaacaacatggatcagcttgttcttaacaacagttgtaatggcaatactcattatagaagtggtcatcccaatacaggaaatgttggtgcagaagatcagactgttgcactttgggtaaaggtacgatttgcttatttttaactatatgaatctggctgaatatttaacatattggattgttgagacctttacatacgccgtggagataaattttttgctacatctagtcatagattttcttgtgaatttaataagaacacaatgtgtgggtgccgtaaagtttctagattttttaaagaactagattggattgcctggaccctcaggagtagcaataggcataacatagaatttttgctacactttcaatttgtgaaatctatttttttaaaaattttcaagagccactgttatgttattaagttgtgtctcagtcatggccaatcaagtagtttaccaggaagaatgacttgagggccacgagcccaagtcttgatttggttgctgcaaaagatgtagtgaagcaaggcagcaacaatgacccatctgtgaccgttattacgaagttcaagggagatggcggagctgttaggtttcctcccccatatatagccagccgccagccgctaggcagaggataagctcgagaggtgatgactcagggtcctctcctctcatccattaatttatttttttcatttcctgttctcttccctctctattttgctctcgtgctcagcagctagtagtagtacaagcaacaactgtacctctcccgtgcgtttatttttctatcttttccttatatgctccctctttttcctgggctcctctgttatctctgttttattgccatgctcatagattaagggcatcagcagcagcgaaccacagtagaacaacccaagtaggaaggaatgtggcagtagtctaaaagactgctcttcaacttattggaactagtcagcaagtcggttgaaagaccacctgactcgacctggctttacaacttgacaaccttgttaagaacataattagttcaaagctaagttatggtgtccaaacccaagcaccgtttgtcccaatatcatcaattatattaggagatgtttaataattggattggatgatttgattgatccaagggtcattgttaacttggtgatgttacatactccctccgtttcaggttataagacgttttgactttggtcaaatcaaactgctttaagtttgaccaagtttatagaaaaaagtagtagcattttcagcccaagacaaatttattatgaaaatatatttaattattgatttgatgacactaatttagtattataaatattactatatttgtccataaatttagtcaaacttgaaacaatttgactttgaccaaagtcaaaacgtcttataacctgaaacggagggagtaacatacacgctaggtttgtactcaactttgtattagaaaaggatacagtcctagttttagttgccgtcaatatcaattgtttaatgtctaaatataacacctgagtgtccaagtcctgtaatcttctgaaacttaaaaaattttctggaaaatacacaagcatttgttttatacacgattttagctgaattagcagacctgggtataactgtgctagtttgaagagataggatatcactcgagggttgtttagttgtagttattgctcctagagaaaaaggctgtccaatgcttgagattcgatctagctgtaattttcttatttcaagggtcgttcctactaggtagtttgtcttccaagtcgaggcatttcttggtattacataattttcgtagcttgatctctctctgtcccataaacatatatgcattttatgtatgacttggactaagttctctgatgtattgttgtctttgatttttattactgaaagaaaaatacttcaactttcctctatttattacttcattccattcatttatatcactgttctgaggtcaacaaccagttttctgcaatttaaataactgtatatgagttgcatataagcataaaaacttgaatatcatttatttctagaaaaaaggggattttctgatcagtgagctgttcagaagattggctatggacccttatatcagccattcaccagttcctaccttttctactcctttgcgtgctgatttctcacaactgttcagtgatccttctctgaactatcatttttcccttttgtttgaaaatagtggagaggaaaatggcaaactggaattcaatgctttagagtggactgtcctttatctactctaaaggcaaaaccaacacatggcaggaagagctatatcattgttttcttcccccgtacaagaacttattcttgggtagacatgctacttgtccgtccaattgaggaatatcctctgccactggttaatggaactcatcgcaaatggcgaaagctagtgaaggatctgagtattcctcgacgattcatcatgcagaaacttgctatttccatgctaaattttagtgacgagcttcatacagaggtctgctatttcttctatgaatcattggtattcctgtagcaccgatgacttcgtcttgacagtctttctgatgtttaataggctgtagttgagaatgctcggatggccacaacttggaaggagtttgctcgggaagcatcttgctgtagagattatactgatcttgggaagatgcttgtcaaacttcaaaatgtaaatctaagcactctattccttaaagatatatcatggaacctcctttcaattttcttgtagcaagttttatatctgttttgttcttcttacgatgctctatttcttggtcgctcactgttttatgaatgatatcctttctggctgctatttatcccttttatcactgatgcacattctggatagaacaaagttaatttgtgtacctttttttattttatctatttgtaggacatatcatgaactgttactaccatgatactagtgtacataactatgccagaaaattgagacgtacattttgacacaacgcctaataggaattattttgcagcattaatatgaaaagctaaatcattgttataagcagttggttgggaggttgctcaatcccaaaggatacactggatgataattatcctggcaaatttcaattttgtttatggttgacatgatattgtgaaaaaagggaaattggttttatggctcgaggttgtatatcttattgatgagaatgaggtcaaatgttatacaaatatttctgcgcagtattatgttcattagatcatccgcttcatcaaatttacgccatctagcgatattacagaaataagataaatgtatgattctgcaatagcctcttccagttgtttcttggcaatagtttaccttagctgtttaatttcagatgattcttccagactacacaagttgtcattggctgcaaaattcttttcacttgtggagccaaaagtgcaataatgctcatgatgccgagaccgttgaaattcttaccgaggtaatatggatttctgttattgtctaggtttcaccatttttttataagaaccttgatttagtttgtatgagttgtttctgctggttagcggagtgagtagttaatatgttt

SEQ ID NO: 24052 - DNA, 594 bp, Oryza sativa
tcccccgctgcttacgcgggcgcctcgccgcggagggtgaatgagtaaatctctcgcttctcctcctctccctctctctctctctctctctctctctctctcgcaggatcggttacgttccgcgctgttttggggggtttgggtcgctgggcgcactaatacgtttagggatcttagtttcatcgaccaaacgcccgaggaagcggtggttgctgtggtgagggtcgtacgggcgcttgaattcccagtgtatttttttcctctgccgcgagaacctgcctgcacattgaaacaagccgttagggttttgatgagttgggtagagttaatgctgccgacccgccctgcaacaatgcccacgtattcgcaccgattttacacgtttaaccaactcctcatatttccgatgtgattttgcttcatctgtttttgtgaaaattaggggactgggatttcatgccatatagttcaaacccaagcattgtttcttctgttaagttcatattgtggtgctatggttctcattgttaaactttccagaggaatgtgccatatctttgtactagtctaactattagtgcattatcatttgat

SEQ ID NO: 24053 - DNA, 4357 bp, Oryza sativa
  unsure (1)..(4357): unsure at all n locations
agactccccacccccggtgagtgcccgcccgcgcagatccgcgcggttctttttttgtggggacaggcggggtgngggtttcttgcggttcttggggttggcgggaattagggtttcgttggtggggttttttcatggtggctagggtttttggtcagatggagcttcggttggtgatttgggtgtttctttgttcggaattgcagggagggagagggcggttcgtttattggatgagccgtgaggaaattgggaggaagaaggcgtgatgtttactccgcaggggaaggggtggaccgggtggtcgacgccggctccggcgaaccagcggagcggtggcggcgctcccgccgcgtcggcgccccttggcaaggggaaagggactactctgcgggtcgccgaactggaacaagaggtgtttttttttaacccaaatcctggcttttctttctgttcgtggatgtagcttttgaattccaatctagggccatgtttctttgctcaccaaatgcaatgtgcggtttttcatggcatgctatcagtcgatgagaagtggaagcagtgaaattgagtgaaaaaaaatattagtgtgcctcgtgatttcattttgaaccgtaaatcatttgaacattccaattttcatttatttgtgcgaggccatttctgcacttgctaatgatttaaataacgtggtttcttatgaactgcttaagaaacagagcgctgcctagggtgctacattacattggtgtcattcttatgtccttttaataactcttcagtcatgttaatctattatttgaatataaaataggcttgtagaaactactgtaacaagtagttaggcatgcaaatacctacggaaggtggaatgttttatgtgattgacttctatgttccattataagcattcgatctaatatatatttttcttcagttcttatctctctcacgctggcttcctaaatcatatttactacagttgcacatccattttcttgtttgatcataccattagtagttattttcttttgtgttcatgtccgcagttacatgaatatcagtacaatatggggctgcttttgattgagaaaaaagagtggacagccaaacttgatgaaatcaatcaagcgctgacacagaaagaagagattttaaagcgggaacaagctgcccatttgaatgccatatcagaatacgaaaggcgggaggaaagcatgcggaaagcattgggtgttgagaagcaatgcgtaacagatgtatgttattctctaataatttcttactcttgctgtttatcagtatttcctaatattcgtaatgctgttaactgttgatgactaagcagttttttgaatactatactgcatatactggtgatatcatatactggtgatatgtaaattttatcacagtcatgaatcatgatgtaataatatctaatggtcaaatgaattggttgaataatttctaggttatggtttctccagccaatagtttttaacactgcattgtccttatgtttatgtttaacaaaagttctatgtatctgagcacacagcacttgtcatctgcagtcctttagccttcggaccatgtacttttgaacgcttcattcttgtttcttatcacttcatatttctgaactttgcagctcgaaaaggcactgcgtgaaattcgtggagagatagccgaggttaagtttatgtctgagaaaaagataactgatgctcaatcccttgaggctagtttggaggaaaaaaggttggagatcgagggtaagcttcatgctgcagatgcgaagcttgctgaggcaaaccgtaagaaatctcaggctgacagggatttagaggaggtagaagctcgtcagcgtaggctggagaaggagaagctatattttgaaaatgagtatggcattcttgcccgttttcctttgtctgtgtgctctctactgtgccaagcaattgattattgtatgtcattgatatgtttaggaggaaggcaggggaggaccggatcaagcgtcaggaggattcattacgtgactgggacaaaaagcttaaggaaagtcagaatagaattcttgatttgcagagatccctaaatgatcgagaggagagagcaaacgagaatgacaaacttttcaagataaagcaagaagagttggaggaagcaaaaaaagctctggagcatactaaagctacactcaaaattaaagaggacgacattaacaaacgactagctgaattacatttacaagaaaaggtaatccatatatcactgaatgccttttcctttatcctcatttcacattattacaaattgatagtggaattaaaatacatatcctgtttctattcgattataggaagctgaatcaaagaacaggaaattagaagaaagagagaaaaaaatagctgaaagggaagaaaaagtcagtgcaagggaaaaagtaagtatgataggctaatattgtgtttcttcttcaatatagttatacacttgatagcaatgtctagaccatgttggattgttggttgtgttttgttctaggtaccgtttggtaaactcgattttgtgttaaatatgtgggtttgatgttttatgttctctgttattcagcttgttccctgttttatgcattcactattgcataaagttgcttatcaattggtgcttttatctcttttgtgatctcttctttcaatataagtagcatcatgtccgtgtgttgcaatgactcctaaataaatatactatactctttcatataattgtaccaaccaattctgttgcaggttgggcttcagaagcttcttgaagatcataatgtgaagcttgaatccaaaagacgagattttgatttacaactggagaatgagaagaaatcatttgatgcaatgttggtacagaaggaagctgatttggtgcagagggaaaaagatgtcagatcttcggaggagaagctttcgaaaaaagaacaagtattaaatgaaagtaagaaaaaattggaagaatggcaaaatgatcttgatacaaaatcgaatgctctgaagaagtgggaggaatcactacaaaatgattaagaaacagttatcggaacaaaagctgcagattgaaaatgaaagaaagcaggctgagatgtacaaattggagcttgagagtttgaaagccacagtggttgctgaaaaggagaaaatattgcaagagcagaacaatttgaaacttacagaggaagagaggcaagagcacatcatgcttacagcacaactgaagaaagagattgatgaatacagaatgcgaagcaactctctttctgaggaaactgaagatttgaggaagcagcgtcagaaatttgaagaagagtgggagcagctggatgaaaaaagaactcacttggaagaggaagccaagaaactgaacaatgaaaagaagaatctagaaaggtggcatgacaatgaagaaaaaaggctaaaggatagagaggatgagttggacataaaatacaaggagcagggggaaaatctcgcacttaaggaaaaatccttgatcgataatatagaccatcagcgtttggaaaatgaggaattgctaaagagagagcgtgctgatcttcaacgaaatttgcagctccatcggcatgaattggagatggagatggagaaaaaacaagcgagcaaagagagagaacttgaagagaaggaaaatgagttaaataggaagatggactttgtagaaaatgagctcaaacgtgcagccgaattgaatgaatcaaagattcagaagatactattggagaaaaaacagctgcagaaggaaaaggaagttcttgtggaggataggcaaaaactggaaactgacaaggcagatatcagaagggacattgatagtctgaacactctcagcaagagtctgaaagagcgtagagaagcatataacagggacaggaataacctcatcgatatatttgaaaagtacaaggtgtgcaaaaattgcggggttattatttttgagggcttggatgccctagctcttaaagatagcactgatatagaatatcctagtcttgctgttgaggcggatgatcgttcccccaatcctgacaccttagcccaagagaccggagcacttgttaattcaggtggccgtttatcattgttgcagaagtgttcaaggattttcaagttttctcctaggaagaaggctgagcaatcatctgaacagcaagcagtgaagaacacagactttggtgcaagactagaggaagcatcgcagagcgatgatgattatgnnnnnnnnnnnnnnnnnnnnnnnnnnnnnnnnnnnnnnnnnnnnnnnnnnnnnnnnnnnnnnnnnn

SEQ ID NO: 24054 - DNA, 11852 bp, Oryza sativa
  unsure (1)..(11852): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttcttgcggtagttgaagatgctaaagaaatacttggtgagaatttagaagtaaaaaaggatgatggccagggagattcagttactgtgggtggtacacggaagcggcgctttgctggagccacaatcagtgagcaagatgaggacagtgaagctcattctgaaagtgtttcacttggagggcagcgccgcaagaggcgccaaacagctgcagcagttacgcaagccccaggagaaaaacgctacaacctcaggcgcaccacagtgtaagtttctgtatttatcccacgtttaatttctactcaaggttatcatcctttttttaactgacttgtggagtaaattgatttcctttttgctttattttgttggaaagtgcaaatgcggcaactgcagcccaaaccaacaaaaagaaagctgcgaaaaagggaagtaaacagacagtagaggctaccgcagatgacacagaaggaacctcaaaggctgaggaacctgccactgggagcaaaggggcctcccaatcagctgatgatgcatctcaattacccgagtactcgcaggtaagatccattctgcattgtttgctattctgtattttatgtaatactttgaaaggctttcagtatcttggatgcatgcctttctgggttgaggccaagctttctttttgggtttgtgtggcatatacattcaggatcacagctaactcgaaacttgctcttgttaggctgaagctggtgacacacatggccctgtagaggtcactagtgcagagggggtagatattgtggatggtatagatgcagcaccagatgcgatgcctatgacaccatcaggaagtgaacttggagctgaacaggatgatgaggaggacgatgactccgaaaggcggaaccaatcaattgggaaaaagctatggtctttcttcactacatgacaattgcagagggctactgaataggttatttctagcgtttctgttttcgattcatgacatgccattcttggaactctaggttgtgtgcttggtgatgatgatgatgtactagtagattttcccacttcaattatgttctccccctgtaattgaaatatatttgtagtagacatagctttgatgggcgctcacagaagttagcttttgagaatgtacaatggcgcgatgcctgtaactgtcaagggttgaggcttgtaattgttgttcattttgttccaggatcagtttacgtggttgaccaccttgcgaagtttgtggcatttgtcaacgcgggaagcttttttttttctcgtccagacgaccagattgtcttccatgtctttgtgcatcttgaattataggactttgttgactggcagttcttcagcttgtgaaatagggggctcaacagtggcatccaggatcagttacatgcaaagtttgtggcatttgttgacgctggaagcatttcctttttctcgtccagatgaccggattgtctagcatgttcttgtgcctcttgaattagaaggcccttctgttgactggtagttgtgcagcttgtgcaatgtcttatcagtgctacctccatccctcccagtaatacctctattccagatttttaggggtaaacatgattattaaaaaaatatatgtagatttaaatggagatgttgtgattggatgagaagtataatagatagaattaaatagagtaagtttgtgattgtatgcgaaatggaaatatatggtgtaattgaacggcgtagagccacgagttgggaagagaatgttagtgaaaaaaatattatattttaaaataaattttaaagattaaaaattgctatatttggcaggagtagtgtatttttggcttgtatatacgtcagctgtctgggccttccaatggacgtctgcttcgatgcaagcaatcgccggtcttctggcttacgcggctaaggaatatctatgctggactctttgcctttgtccctaaggcatgctgttctgttctgttgtgatattttctttttctttcgagacggtttgtttgcagcatgtgctcactttcatttggcgtatctacgctagcctaaagcaaatgcatgtatgtcatacccacaagtaactacaaattctcttgacttcaccttgcagtatactaaataaaaaaaattgtctgtatttccagccataaattttgcataaacaaatcatatttaccttctaaaaaagaatagtatttccagaaggaaagcacatagtacttcaccaatcttttgcccaaaaaaaaaacaattgagagcaactcggtgtcccagtctagtagctttgtttcttgtggctactttggaacgcaaaaaatctcacaaaaaaatatttttcatataaatcagtttaatacctaaagaaccccagggggaattcctcaggagtacgcctaaaaatacatatgcattgttccaatatttatacgtgttaataaaataaaataaaataaaaatacgtgttaaatatctcattatcccatgattcttaccaggttataggactccgtatagcactttcgtatggtgttgtaatcgcttcattgtccaattttatttagacgtaagcaggcagtactacttatgtacaggtgcggagagttgcatcgggagaaaaagcctactatatgataattcgacggatttgctgttaaatccgagttaaccaaacagaagccgatcagagaccctaccctccgccgatgcgtcgagaagaagcctccgccgccgccgccgccgccgaggctgggaccccgcgctcaccggacctccacgacctctccgacgactccgactacgccgccgccgccgccgcgtcctccagtcactcggtgcgcctctctcccccaccactcgtgtgcttcctgccgttccccgttcgcctcgcctcgcttgctcccgacgcgagcgcgcgattcggtcgcggcgcgagcgaattcgctcgattaggtcgatgatttttgttgggaggttttggggggatttgggatcccgctgctcatcagatgttgttggggcatcggggttcgggggtagtgctctagttccgcacgtaactagttcggcagctgtcacctcttcctccgtacattgattggttttattggttgggtgggtgtgtgcgtgctatggatggcgatgaatgatagcctatgttgagttcccaatttggattgaattgacgttcgtttggttgggtgaactgaatttggtgtttgtttggtgatcgaaggcgatgcggagcgatctggtggatcaagggtcgggcgagacggcgaaggtggatgtggtgtacgagaaggagcgtgtgacgatccacccgacgcagtatggctccggccggatcagcgggaagctgcgcctctacttgcagcagggctccctgttcctggtgagttagaaccccagttagtctgaattgttgattgttcatgaatttgtggtaggttttgatattattgttaccacatttgctgtgaggattgaaccatggtccttttggcttgatggccagggcattcgtgttgctacttgaattatatgttggttggcttatatatctttgcttatcattgtactccatatatgctaatgatacaatatgctactattcctgcatagacgttccttccacattttctgctaaatgtctgatattagaacaagagaactgaaattgaaaatccatatgattgttgttggttggcacctgaatatggttttgttacacatgacatgttatcatattggtacccaagttgcttaattttcttcttcatttgcttatgtctttgttcaaatctgtgtgacagagttgggagccaaatgagggagttgattctttatcaagcaattcagctaccatggaaatagaaaaatgtaggaacaacacaatatatttcttttgtcatacttggtaattgaagtgcagcagtgattacacttgactctttctttacttgcctgactatgtacagatagaaacctgtacactataaaggccttgccattaagtgatgtacgcttcatccgtaagcacaccccgacatttggattcgagtacataatcattgttctctcatcaggtgaagtgctcttctagttgtttgctttcttgtggttagtttgaaactttttggaatttctatagtcacggtgatcactgatcacattagcttttaggtactttatcttacaggctcattgcatttctgcttcttctagctacataatacacatgctgacaaaaatgaaaaaaaatgatttattgtattgatgtatcttttcaagttttgcaggattggcttttcctccattctatttctacaatggtgggcttcgtgaattgtttgcgacactaaagaagcatgtttttattatcaggttttctttctgggttcactctaattaaataattagtcaagctgtcccttgtttgttagtgcctaaattgctcattcctggaaatgcaaaaattgctatctggattatgagtggactataagtgaaatctacatacaacaaatctaccaagtatatccataactggattttcaaagcacttttttttccttctatatgataggatactgtcataaatatttaatatttatgatctaattaacctacacttgggaagatgcttcactggacatttcaacatatctaggagcgtttagtaactcagcctacagaaaactaattaagtaatggagcattagagtgtcatactacaaccaatcaaatgtttacagaagtatcttttgctgcatatatgattggattttctctactctatctcaaggtcggacgatgatcctaatgtatttcttgtcaacgactttcaagatcctctacaggtatgttattatactttcttgtagccagacccataatttctttaagaccaccatgccctcaatagaaactttactgtccttgggaatatgcaaaacaatccttttagtaggagtcccttgtaaagctatatagtcatctttgtttagaagtccatgttctggcctatgtcttgcataagtttaacttagaacgattacttacccatgaacctcaaatccactttatttgatgccttatagaaaagtttgtcatcactggagcttcctggtgttgccaccgtagcaaatgccatgtcacgacagaactcactcagtttcactagttcagttgatgaagccagacatgggagtgatgccaaacatggggcatcttctagcatgactgaatatgtctcaaagcaaaagcacagatcgaatgatccgggtcgtgatctttctatccaagtactggagaaattttctctggttacaaagtttgcacgagataccacgtcaagtctttttcgggaaaaccacagtagtggtggtcatacttatggaaggcagcagcaagaatatgttttggacaacagagcaaatgataagtacaaagatcagcaaataacaccagataaggattctttgctgtcagattcaatggaggtaaccatatctttttttctattgttctttgttattcgtccactacaaattttggaagagagcaacaacagaacaactttttgaagcactcacaagtcatggagacaagcctttaaattttactgttatggttaattcatttttattctaattttttttgtctgaaaacagtaggggatgcacctgcgatatatataaaagaataagtaatacatacagagagagtaaaactaaaatacaatttcatattcacaattaggattaaggccatctgtaatgagaagaaacctaagctaaactagtattatcttctgtcatctgctcatgttcaaaaccattatctgccaacttcctttctattactagaggtagtattagatgtatcttctatgtattatttagcacatatttgttgtcactttagttggaaaacttaaaaaaaaagattttttaaataaaaaatagtcagtttttttcttctgacccctggtactgtccaaagctattacaattttgcatactgcaatgtgtgtaacatcagtttccttgatcttggcagtctaataaaattctagcgtggggaaaaccaagagaacaaccgttgagtgttgatgaggtattgaattctctgagcacttattttacatatctgtccccttatgttcaagtgctctatggtgctaaaattccatgtgctattattctgcttagcgttgcagttcaaataattactagatctgtaactcaatccacaagatacatcagttgtctaacctctaacatacaattggatgagttcaacatttgatttcggatgtatttactatcacagtaaagtattatgatcctcaagacagtcatacttctgttcaatcttgtgacctttgatatttaaacctcttgtttcttggagtcattatgtctttggctcagactctaggcatatgccttggggcttcaagcaagctaagaaatcctgcaggattttagtggaactcaggaactgttgcctcataatttgcaagccatgcttctcctggcaggagaattagcctttagcagatactgtatatttgatactaacaacttgttttctggaggtataaatagattgaaagggatagttacatggaaaattattccttttatccagtaaacatctagttatctgatcatgtcaagcagaggagcattgtgctggatacacacatgaaatattgtgctgcacacacttccattagtgaaaagatttgttttaccaaatggtagtttgacctttttcttcaactcaacggaaggctaagatttagtctggcattttacattaattaagaactgtatgagtttacgctgcacataatgtctttagtttcatggatcttctccaccaaccatctaataattatcatgtattgatcatgttgtaccactgttcctctcagaaacgtcttatgtttgtctgaaatttttattgcacagtggagatccttcttagatcttgaaggtagagttatggattcgaaggcgttgaggaaaaaggttttctatggagggattgaccatgttctgagaaaaggggttttatacttaactttgatttgctataaccactcaacaaggcattcttgtacatgagttttgatgtttaatatgtaagtctggaaattcctgttggggtatcatgaatacgattcaacatatgccgagagggaatatcttgctgtcatgaaaagaacagaatatgaagccataaaatcccagtggaaggtcagtcaaggttcataggttcaatgtgctgcaattcagtgtgcttattaatgctggctaggacatgctactaccatatatattgagtatatttttaaagtagagctcaagtgatgtagactgtcatttgcttttgctcagttttgttagatctgcggtatgtgattttgcttgatgggagcaatgtttctggacatatgattatccatttgctgttctctttatccctaagatcatgctgatagtttgcagtagtaacattacaaatgttaagacactttcagctgttcgtcataacaacaattcatgattcttttacattatggcatacattactcatcttttacatgactattcatgaatcatgattcttcttgatatattatttgcagagtatttcgtccacacaagctaaaagatttaccaagtttagggaaagaaaaggccttatcgacaaagatgtggtatgaatttgtctacttttttttctatctgaacttttcctccttatttccattttagcttcctctctgaccactttttatttttaactgatatccaaactgatcacttgttttaactgttttttggatatcaaggtgaggacagatagatcagttccatattatgaaggagatgacaatcaaaatgttcttgtgctacgggatatcctgttgacgtattccttctataatttcgaccttggctattgccaagtaagtttgcacgttctattacccttcacccgcaattatccaacatcagctgatgaagaaaactgcctgccagtttaagtcatttaagtgaaaaacactgcatttgctagaaagcttccactagatcacataaccctgattcttgttaaatataaggaatgtatacatgctgaatcacaaggcactgcagaatattcatttgttttgtagccatattattacaagtgacagggttaatcatgctacactaaatatttagacctataaagcatgaaatttcgttgtctaggtttctttgtttgtttgctcatgcagcgagcgctctttcttccagggaatgagtgattttctggcacctatactttatgtgatggaggatgagtctgagtcattttggtgctttgcaattttgatggaacgactaggagccaattttaaccgtgatcagaatggcatgcatgctcagttacttgcattatccaaggtattttagaattttccattcttcgagtagataagcagtatcatagtatcacaatagaatttttgttaatccgcatatcctgtgcaaatcttgcaaaaccgttgtgcttaagtcatatcgattgattatgtgtgtatcatttgttatatggcttcattaattgccttcaatcatgcgatgtggccttcgatattatgccaaaaatacatattatatagattgtaaaaaaatgttcaagtgacaagcagttcatgtttatacttcttaaacggcataaaaaaaatcccctctttagttttcataacttttcattattccttattactgccttcaatccttaccatgttatgattatccattatacaaatgtgtctgacaaacactgccagcttaggtgtcagaataactacttttatcaatataggagtattatactttttgtgactgcacaatactaaatttatgtgaaattttctatgtacctcatgcagctcgtggagcttcttgatcctcagttacataactattttcggaagaacgactgcttaaactactttttctgttttcgttgggttcttatacaattcaaaaggtaatatttctatctttccctatttgagttgtatgcattttgcaccttaaacagaaaatctaagttttcgtctttagctttgtaacactatattgctatgttctagttccctgcagagcccattatcttatatagaatccataaaaaatattgaaatctagatgatgaattaatgaaattctctgtagctccaatatttagctacattaagcaaatctaattcctccaaaatgttctcccgaaaatggaggtgcattttgtgtctaagaattagtgacacggattttcaccaaagattttgcctagaagcatgtttcattgttcacacctgttgggctgtatacagactgtatgatagtacgctgctgtcacgtatatcgggtaaaaaccacaggctagtaggaccagtaccttcaagttaccttattagttggtcggttggtccaatggcatcaatcatcgcgcaacaattttgaaagtttatgagctattcctacctttattaacaacaaactgcttatgagctggtgctcaactgaaacctgtaaacttttgacatgaattcaaacctgggttaacctgcaataccagcaccagtggtaacttgtctagaagttaattatcttctgctatctactatacgattttaattacattagtttgctaagaaattttacactgcatcattaatgcagtactccccacccaagcacttgtagaggaaaatgcagcctgcactccatcccctctaatagtctaattaagttactccaatttcttatggattgcagggagttcagtttcgatcaaatcatgctgctgtgggaagttctgtggacacattattggtcagaacatttccacctctacttatgcgtcgcgatcctgaaaaggtaccggtcgcggataataggagagcagatggatttcgacacccttctcaagttcatcaatgagctcagtggcgagataaatcttgaccgggcaattcaggacgcggaggcattatgtgatcaggcaggccctaacggggctgcctgcattcctcctggaaccccgccttctatgcccatcgagacggacggtggcctctacgtacaagaagacgaggtcatgtgagataccggcgattcagtggtcacctcatacgacaactgccatagaaagcattgcactggtttccataattccattgggtgcttggtacgttggtatatataaattatgaaggtgatcaaaataatgaaatctggctgttgtatatatgtacgttgaaatatcagttctcgatgaacccaacaatagttaacacaagtctcttttttttgcttaatggaaatggattgtcttttagacgcctatgtttggcttcactgcgtaaatatataatattatgtcacgtgatacttatcaactggcaaagttttgcagttgggtatttggataccagtaaaatcgactgtctgagtacgatttatagccttcaaggctgtttggactgaagtgatgttgagcacgtaattcgtttgtttcacatatcctccagttctctgctcaactataatccagcaaacctgcgagctgaatgaacacaaagcgaccttgtgaatttgtgatattaacggccattaattttatgtggctctgtgtagcttagcctgcataaaaccgtgatgatattgttttcgtacgtgtcttcctctcgcgtgataatcactctgttgggaaacaccacatccacacgttggaattctaaattcgtttcctttgcatcattgcacgaattgggatcacatgcagtttcattgcactaatctttataatttgtgctttgctctataagaccaccctatgtttgatatgaataaataaaagacccaacaaaacacacaaagtaacataggctagaggtcaacactaataacgcgataatgaaatcgtggatgtgggactgcacccactatagaatctttttaaggatgtgttagagacaacctgtttttttcttaaagataatgtaagttttttttgaactcagtcaattacattaagattaaggtgatataatttttttagaacactttcagcctttgcattactaaaatgcacaaagccgagcatataaaaccacactcaaaaagaaaaaaaatgacatagagcgttgagaataaagaaattcttggagctatcattttcctctagcattaataaaattcattggtgttaagaaaaaacttcttgtgggaaggttggctagagatttcttagaaaaagaccagcccctgcaaaggcaacagtctagaacgaggaatgagtggaggcgagcccggatccagagatagatggatgaatggtgtcgattcaagggttttttctattaattgagaattaaaatgtaactaaatagtcgagtgctattgagggccatcaattcaaagactaaatcgtcacccatgaacaactccttggccccctccttcaaaaggtcggagtattaagagccaccaatccttacgactagatcgtcattcatatccctaggtaaaaaactacttgaccaccttctccaaatgtagacatgccgcaaccacatccaaacac

SEQ ID NO: 24055 - DNA, 8109 bp, Oryza sativa
  unsure (1)..(8109): unsure at all n locations
nnnnnnnnnnnnnnnnnnnnnnnnnnnnnnnnnnnnnnnnnnnnnnnnnnnnnnnnnnnnnnagccccacatccacacgagctaaacgcttcgcttgcctttaggaacaaagcggaatcttaggttggatctctcggtctgttcaaggggctacactgtaaccatctatccatccatgaacccccgacaagcaatcacgcagaagttcagtgtccgggcaagattttatcaccctgccccacaaaacattctttctcctcttcttgtcatggcaatgcacaccttttctcgagaaattcatctccctttccctcttgtcgccgtcgtcagatgagctgaaattcagagctttttttcaggggaaatttcagagttcgttcagagtaaattgctggtggctggatatgtaatgtgttgtgacgacgcactatgactatgctgtttaaaaatgagaatcgtggactatataatggcgaataattagaggtttgattgtgagcttccagctcggaaggcaactgacaacttattaaagaatttccttttgggaggaactaacttgttaaaccaaagacatctcaagcagcagcagtattaaactattagttaagaactgtggataagttagctgcacattccaaggtagtccttaatccaagggttgaggtcccatgtagtcgtgcacaggctctaataactgaatcacactttctgaagaaagacgattaccatacttgtacaacttgtactaaaaggtgtagttctacaggtaattataagggcaagttttatagtagaggtgactaccacatccaatttcatgcataacatatatcattaaattaagaggtaacatgtattataggttacctctatcatacaatccccaatatctctaacactctcacatgtttattgaagtttgtgtaggggttgccccttgtatgagaggtaactatttctctctcatatttcttctctcctccacctcattatttactcctatgtggcatcttggggcttatgcttagatgcccatagtacttgccctaagggcaagttttataaaagaggtggatgttgcatctaatcttgaccacatcatcaactaataaatgtagaggtaacatgtacaatatatcacatctatactaattctaatacactagccccaatgtttgtttgcccaatctactcttatcctctctccttttgtcttgaattttgtctggtggttgcctcttgcatgagaggtggctgcttatctctctcatctcttctctcctccacctcactattttagcttatatggcatttagaagattgtacttggatacctatagtacttgtcctaaccattgttcttttggcgtactgtgtagtattcagtattatgaatttgccaacttttgtctcctggagagcagaatcgtcagccttttcacttcatgagcaccagattagggtaatcaagacaccaggttagtactagtattataatacctgcatgtagaggatgatttgtaattgtgttagtacaaatggacattagaattttaagggtacaaagtgaatgtttgtgaaggacatcatgagtgaaacttgatgggaatactggaatatttccactctttgtatgtgaaatcctgaggcaggattggacatcgggctatgacgttccctgcatgtgcagaattccacttctgaaaaagagatactccagtaaaagtcatgagattaatcagtggctactgccactagcttagcttagcagcgcttttgtctttaagctgtggctaggctatgacgcgaggcctaaccctgattagaggttcggacactaacacggtcggccatgataatctgttccgagcctctgtgatttctgtatcctgaagcatcacttccttttgtttcaatcggttcatttgcagatgtaggtagtttcagtctcgttgcagaacctttccccctcggatgaacatacaaaagcctataatgcgtcctcggagacctaagcttacaaaaaattgcaagttgcatactgcccgctgccctcatatatgcgaatatgcgatagattgtccaattgaaaagacattttttttcgaagatacattggagatttggagataggcgcatagcttaattagcatggagccaaagaaattttcagagcctgggcaagttgtcattcattgtacatagatgcatcgtaccaagattttgaatacatgtttcactgaaaattccggtgttgcaaagtgaatgtagctattctcaactgtgtagatttttttagtgggatctgtccatccggattcaactcctacatttagcataaacacgtagggatagtatgtatgcataccttatgagggtgtgcacagtgtgcatgtgagtgcaaaagaatattgccgcttttttcttagcactacgtcattgatactaagggctcattctaaactacggtttggataagctaataccttgatttcgttagcaagtttttcaaactaataaacaacatgtttcgtgtgaaaacttcctatatagaaattacttttaaaataatcaaataaattcattttgcaaatttttaataattagtattcaataaatcatatactaatgctcctcgctttacatgcaactaataatcaaaaaccaactcctcaaaggtttcgtggtgttcttttctcctgatgaagataagataaagtgttttacataaaacaaggttgtattaacatatgattaattgagttttaattattacaaattaaaaaaatagattaatctgatattttaaagcaactttcatatataaaatttttccacgaaacgtaccgtttagcagcttaaaaaatatgccactgagtatccaaattttcatccacttttttcaaaaccggttaccgacggccgacggggttaccatgctgtctcacaaaggcgtgagctaactaacttctttgtcaatccgacaaccgcgcatgcgcggccggctcatccattccccagctcaccgccgtccccacccctcccgttccgttcctaaacacaacacaacaccacggtggccccccaccacggccggccgaaaaaccagctcgccgccgccgcccggccagccggagtggcgtgcaagcgacggctttcccctctccgccgcagcaaaatcctggccgtaacagcagtagtgcagtacagtgcacactccagtatggcccaaacagcaacctgggcctcctcatgacgtctactctctctgtcccataatatagcagcctagtactggatgtgacattttatagtacaatgaatctagacatcctcctgtccagattcattatactatgaaatatcccatccgatactaggttgctatattatgggacggagggagtattcatttgattgggccatgctcctgggtagacctggtccaccgccctggtccatgaaccatgatgcttttgcacagccaacaagagaataaagttttttttttttttagatcagcaggagaataaagttggcatggatgaagggaaagaagtagtaaaagaagaggaaaggcagaaggaaaagggaaaggatagttccactcttaaaaaccctaatgatgaggaataagtgggcttatgagataaacaaatggctaaggccactttcagttgtgtgacttgtgtcttagctttgggacaaaagaaaattagagagagaaatgttttggtcccacgttgttgagagtatttaattagtgatggaggaccatggtttggaatatatagttgcaaaacattggttgtaatgaaagagatctcacttagtacaggcctttgtgatctgccaaaaatatttttcagatgtcatttgcgaatttggtactatgtttaatttttttgcagagtggccgcgctgataatcattggttatgcttagtgagttcggatgatgataaagaaggtttaaacaaagacaaaataatatagcattacattttcataacaaggacaatcatgattcggaaatgggaatctactaattaaaggttccatccgttaggtttggtacatcaaaatctctgtagtttattgcaggttatcttcaagtgagtaaaccttcagtcttcttgctcccaattaaaagaagatgcagaaaaaggcgatatatgtatcttaccatctggtttacttcgctatcacttgttcatagtttaggacaaatacgaccaagtactaatttggttatcttttcttttttttgaaagaactcagcaagctggttttatattatagaagaagtgagagaaactgtacagaacagaaggcaggggagacgttcccggaggaattcttcctgcctgcactccctaaaaaacaaaagcctaatctcttaatataatacacttcactcccttggcacctgccatttcccacaaacgaagctcatctatgatcttgctagcaagtgccgatggtgtagattctttccctctgaagatgcgattattcctttccatccaaatctcccaaagcgtggtcaagactgctgaacgtagccctttctgttgcaacttttctgcctcatctgtttgctcgcgctgccaattgaggagagtgttgtctgtggtcacatgtaggaaacattgcggtctgaatttgcgaccaatgtcccgccatacctgctgcatgaaggggcactccatgaagaggtgctataccgtttcgagatttctgaaacagagttggcagaaatagttatttggccagcccctgcattgcaaacgatctgccgtccatattctattttgtgccagcagccacgcgaagaatttgtgtttccctggtgcccaagtttccatacaagctcagcagaatccgaaaacgttttgcccatgaactgcatgacatatgctgattttgccgtatacaagccactggccgaccacctccagaggattgtgtcctcagccccttcatggatcacctctcctgcgttgtggagcacttcccatacgcatatatattcctgaagcagctgtattgtcacccctccgcggatgtcttcgatccaagcatcattagttattgcctcaagaaccgacctgtttttccttttggagtgtttgaagaggtttggggctaggtatttcagcggctgatctcctatccagttggattcccaaaatttcgcctttcgtccatctccgaccgatactttggtggcagcagcaaacagagcacgatcggtgtcatcacagggcggcggggttcctatccatgtttttttccgggcttgtccactcataccagagccaacgtagcctcagcgatcgtgagaacttctccaaacaaggtatgcccaatccaccatgtattgtcggagaacatacttgctgccaattcactttacattttccgcccaaactttcttggtctccggcccaaagaaattttcgttgcgctttgtcaacatcatttaggaatccttttggtggtttaagaacggtcagcaagtaggttggaatggcattgagaactgattgcacaagaaccttccgcccgctttgataaaccagcttgtttttccagccccccatccttgctctgattttgtccattaccggctgcaaatggacccgctttaacttccccgtagtaagaggcagtccaaggtaggtttggggaaaagcacccagctgcccatcgaagttttgagaaatatcttggagatctatgtcgttgcatcgaattggcgtgattgaactctttgttgtgtttacctgcaggcccgtggcatccccgaatttgttcaggattcccaatagggtttgcacttcttggcgtgaaggatttaggaacactgctgcatcatctgcatagagagaggttctgaattttagtgcccgcggggctacgcttgactaatttggttatcatttcaaaagaacagaaatgaatggagataagttaaaagtagaatgtttatctcacaactgacactaaaactgttacttattttggttggccatgagttgtaattcctccatagtattatacttgctctgagatgctcttcaatgagctaataaagtgttccgacggcaaaacactatcttcagtagacagtgacacttaactgaaaattattgagcatccttgtaactggccgtcagctactagtattatatactggactaaggtaaggtgaacgcataaaagtgcatagtattttttaagatgcatgaatttattagccatcagccaatgaaccaaagtttcagcatagattagcaaagacattatgaattagtcctgaagcacacagacgtgaaatgtctcacaaacagatagtacagcagcatcagtgcatcacaccaatgtttaccagattgatatattaagccccccccaagtgatcagtaatactgtacacaccttgacacccttcaaattacatgaaacccaagaaagtaattaacacaagccaaactatgcatgcatggatggatggattacgtacaattaattgcaaacatcaagatgatttcttctctcattttttcttttcgattttgctccatgatagtatgatccatggtcagactctgagcaggtagatgctgagctccgggccgccgctgccgtcagggttcatcatgtagaacgcctccgagtccctcgacccgaccacccgctcgaacctcgcgcgcatgtacatcaggtcgccctcctcggcggcggcggcggcggcggcgtcgtcggggagaacgccggcgccgacggacaccggctcgacggcgccaagaaccctccactcgtcggcgccgcactccctgcgcaccgcgaagccgcactttcggccgttgcagtaggcccgccacgtcggctcctccagcagcgcccgccgcttctcgcctgtacatggtgcaacgcaacgaacgtcgccggtggccgacaggccggccgtcgtggtgttagtgctcgccggcgctgaagaggatgaaggttgattaattcgtgtgtgtgcgtgtgtgtgtacctgggttgattggttgcttctcgcactcgagcgcgaggcggacgaggccggaggacatctccctgacgagcgcgccggtggagtaggcggccatctccaccagcagcaccggcggcgagcgggtgtccgtctgcagcgcgacgtgaacgcggccgcggcgccgcccgaagatggtgcccgtcaggctcgaccccagctgccgccgccgccgccggtgcgtgatcgccgccaggaacgccgcccgcagcctcgccagcgcgtccgcgcgcttcctcgacgacgacgacgactgcacctcagcaggctccgcggacgacgtcgcggagaaccgcgcggccctcgtcgtcgtccccatccccgccgcctcatctccacctccctccctctcctgtccacctcgccgctgcggcgacggcggcttggcgcccagccgcttcctgctcagccacgggaagttcccgcctccgcctccgccggtgccaccgctcgccgcggccgccctggagctggaggacggcagcggcagcggcgaggccgcgcggaacgctctcgccatggcaagccacacctccaaagcaaccaagcaagctaagctagctagctctccctcgacttgtcccctgcgcgcgcgcgcgtgcgtcccgttaataatgggcttttgctgctggctccaagcccaccagtatttggtagggggtttttaagcgggttagaacaggtacaatagcagactataagctagctgtaaacatagtttaagaagataaataagaagagagaaaaacatcgggctatagatttgtagccagctatagcacagactttaagatgcagggtgtgtatgacaggtgagaccaggtattaatagtgtattatataaatattgtatgaatgagttattagattagctgtatatgaattggagttagtaggtggctataatattaaacttgctcttagccgagcagcgcgtctcgctctcgctcccgcgcttttgcaggtggctcgcggccgcgcgcgtgcgctgtcgggtgttgttgggggggggggggggggggg

SEQ ID NO: 24056 - DNA, 12501 bp, Oryza sativa
  unsure (1)..(12501): unsure at all n locations
ggcggcgcgcgaggtgtaggacataaataccggcacgagacggggttagcgtcgcgagaccgagacgacgattgctactaccgtgcgcgcgaggaaagcggagttggggcggtcgatcgatcgatcgatccgcgggcgatgcgatgcgacgcggcgacgcccgcgggcggcagatgggagagggcacggggcatcgtcgccgccgtacgacgtgtttacggcgacacacgatcgcggggcaggcagcaggtggcgtctctacacgaggtgcccgtagcactgtagcagcagctagaagccggcagccggggggcgtcgtcgccctggctgattggtcatatgctgcattgctgcctcgtgtcaaatgcatgcgtgcaaaaagaatgaaacttgcgtgtgtgcgccggtgcaaataactcggctgcctactgactaacgggcagccatggatcgtgccaaggaaacggaaagcagtttggtgcattggtactgtaacaaactactagtagcaggaggaaaccacgagatcgttggaaggcagcgggtagcagtgcaggcgcaatgtaaattatggtcaggtgggggtagtacgtataggagtagtaggcagctagcggtcccggtgccggcggcacgcgtgaatgcgtgataccggtgtgcaggggaggggaggggagggggccggcgacgttccataaataaccttcacctacttgggcggcggcagtgcagatcagatcactctatacgtacgggtgtgggatcgccgggttgccagataaacggcgagacgcatttggaggtcccttggattaaaatgggttaattgaattcatatattaaaaatttacaggttttaaaaatactattactatgtactccctccctacaattctaatattgttgacgttttgggatagaaaccaaagtatgcaatttttttgaagttttaggccctgtttagatcccactccaaaatttaacaccatgtcacatcgaacgtttgaacacatgcatgaagtattaaatataagctaaaaaaataactaattgcataaattgcggctaatttacgatacgaatcttttaagcctaattgttctatgatttgacaatgtggtgctacagtaaacatttgctaatgacagattaattaggcttaataaattcatctcgcagtttactgaactaattagttttttttattagtacccgaacaccctatgcgacaccctgtataatacccgatgtgacgcttcaaaactttacacccctgtatctaaacacccccttagtctctgcctaagccctgtttagattcaaacttttttctttaaactttcaactttttcatcacatcgaactttcctacacatataaacttctaacttttccattatatcgttacaatttctttaaacttccaattttgatgtgtaactaaacacagccctatatataaagaacttacttgctcctgcatgcatgcatcccattacttcagagtgcttcgtttctcgaagataggttccaaaccacctaggatatacaacttgttgattccaattagcacaccggcacatttaatatgggtaaagtagaaattaggcatataataaatcattccttggtacgtaagattatgtctaaaacgtcaattaaattagaaccggagggagtatctatttatagttatgctattaaaatttaatggttactcaatacattcatcataatatttaggtcattttgttctcgtctctctgtttttccctgttacctctctctcatttctagtgaacccgacctgatgaattgatttggattggtgcccattaagacctttcctaccgccggctatgtcactacgctgcaaaacaagatatcttcagctgattttgccgatgcatatggtagagaaggtgacagacaggcaacgggcatgcatgctgcacatggcaccaccgcagctgcggtaactagggttgaggaagctgaagagcatcccctgttagtacaagtacgacatgagcgtgcattgccagatctccttcacctccgcctgcctgcttgccttacagctactcgtgtgtgtcgacctcacctgtcatcacgatttctcctaggaaatgcacagcctctcgccgcgacatcccccgccatgacactacctgtcactccttgccgcctcaccggggacccaggcatctagcgcacgtcacaaattttcaagagaaatttgataaaaataccacctaatactcgcaatttggttatttaccacctaatccgtacgttttctttaatatgcaactagtattgcaaattgctctattttgataccattttttcctttttttttcttctcgggttgttggacatttttatccctgaccccacatgttgtatgaaaggaggtttttattacacatcgatcgatggaaaaatatatgatggaaacttagaaactatcgttggatcaaaatatgtacgtctaagatttatccacgtcatcactgagtaaaaatattactcatgagtaaatctaagaataaaatttttagttgtgatgacttggacgaatagcatccatttttcgattcatttgcactacacatgtggcttgctatacatattttccctcgatcgatccattcaccgctcccgcgacgccaagcgttcgcaccagcggcaccggtctcgccgccatgcgcccaagccgccgagcgctactccagccaccggcccatgccccatcccgcgctgccgtaggtacaaatttataatggcatgggtataattaacctaaaaaagcagacatttgtaggaagtgcagactgcagacgggtaagaaccctagaccagatcagagttttagccgaagtgcgagaggatagagggaggcggcgcgatcattcactaccggagcaccccttatgtggggcgcttccacggcttcgtgatgatggcggctagggctagggccaagcgtaggtaagatacagatagggagttctttgttgatgggatcgaagagatggaggaggagggtacaactacaatgtcgatgccgtggccatggattgtcaaataccatggtaaactttaccatccataacttgttatcatgggatttgatctggaaattgtaacctaatcgatgcaaaatagctaacgggcaatcgatcgcccctagcgcgcccccctcttctccacgtggtttccttttttgcaccacattacttttcaattttagtaaatttatgcacctaaagtttgtacacctcaagtttacatatctaaagtttagagacccaaagtttataaatcaaaagtttatatatccgattcaaatttgaatttgaattcaaatactttttatatatagtatttctatacatctaaagtttatacacctaaagtttatagacccaaagtttataaatcaaaagtttacatacccgattcaaatttgaatttgaattcaaatattttttatatatagtatttctatacatctaaagtttatacacctacagtttatagacccaaagtttataagtcaaaagtttacatacccgattcaaatttgaatttgaattcaaatatagtttatagacccaaagttttataagttaaaagtttacatacacattttaaattttaatttgaattcaatttttttatatatagtatttctatatataaattttttcaactttatttttttaaaaaaaaattatggtgtactgtagtaggaagagaagaaggggaggaggaagggggagaggaagagcgtatagggggaaggacaggtgatcgctaggaggatagggaagcaatcacccgcccactagcaatatcctaatcgatgtatgtattcccccgatttttttttattttttagaccttttaatgctttgattttattaatagactttctaaaagtatttttaagaaataaaccttttggccacgcctgcctggcagtggcagggtggtttggccatgccagctacagtgcgtggcagacaccggctgcgtgtggcgtgagagttatttgggcaccaaaagaaagattcatttcttgaaaatacttttagaaatggtctattaataaaattaaaacattaaaaggtctaaaaataaaaataaaattatattcccccttcacccttttgttcgttattgatgaaatcttagcgtgctgatgtgctaaatttcttaatgctccttgactttctattccgcccatgcccattaccttttcctgttagcgactatttccttaattgtttttagtcttgttagggcatgtacaatggtctttattagcggtctctttttattgtcatgcaagcatatttggtgacgtgaaagagagaggaagaaggaaagagaaagatagttgctacacatgacaacggcatagagtcgactcttaacatttattagaattttttttgttgcattaagtctaataaaggaaagataactagtaagaaagtattttggtacattaatagttagagaccgtattgttttaactattgtaaacgtgatagtctctaattaatgtaattaacgtaccggtctctatctttatacttgcccttataatatttttgatgatctgtttggcaaacatgataagtcaagagcttaccatgtcaatgatttcatctttttttttccctttttgggtagtttgtactgtttggaaagatcttttggcgcgagcattgggatggaacaaactcttgctcacaaacttgaatgggacaaagatcttatcggtatcgataacagatcacttggatcatttcaatttgcgatacggtagctcatggcatttacctatatatggtcttagtgcatttttatatttttgaagaattccatctatttttagataatgtaccaaacttgtttttggaaaacaaaggcgtaagctctgccttagagatacacatcgacggctcacaccgaaaacaccatcctacaagaccaaacttagggcccctttgaaaagcaggataggaaaaatacaggaataggaaaaacgtaggaattgaagttgtatgtttttccaatcctacaggaattgaaaacataggaaatggagagaagagccatttgattacaccacaggatacactcaacaaaggaaagtttcacaagaggtctaacctcttgcttattttcctatggaattgatcataggaatacaatcctatggaagttttcctatcctcttcctatgaatcaaagggctctataggaaaaaatccttaggaaaataaatccttcaaaattcctttgctaatcctccatttcaaagggacccttactctcaaaatgcaaacacggcaagcatagctcaagcttttgcggtcttcagtcttcaccagccagttctgctctcataagcaaaaaccgtgtactagaacacgtggtgataaaacttctttgtgcataattttcatgtcttagctcactattgtattttttaagagtaattcaagcttttagcaagatgtacgtatatagggcatttagtttattgtggttactccatcgatgttgcaacttgtaacataatctccatactggtggtatggatgaatagtgctatgcctgcatgactgcgtcctttgcttacctggttacttcacttacccttttagcacaagcaagaagacaagattacacaagtcttcaacttctagcaatgttgaataaatgctggtcattagtcgcacttgctgcgtcacaagtatatcatgaaggaggcttcaatgcttcaaagggtaccaaaaaatagcttccattgaatgagatcagatttcgattacatacaggcaatcaatgaaaacgctatggccgacgactgctcgccttgatcagcaaaactgcagcatgctaaaatggtatttcccagctgcacaagagctctatttcgctaacaggaaacgacaccacaaggttaactcatctaattctatagtatgtacacggtgacatgggatacctatacacgggatggggctaccaggtctaaatgttagttgccaccactatctacaagcatcgactagaaaacatccagagtcatgcacggcgatcaaatgattctgatgtatcaacaccatgcctgctgacagaaagattgcctttcctgtcacgttaggaagcaatcaagcttatgcggttgcatgtagcgtctgatgaagcccagaatgttcaggttcaagagcagagctgctgcttcatatctcccaggtaccggcatattgctgcagcaaacacctgaaatggttgcgaggtcagttagctgaatccctttatttgcatccgaggcaagctttttgcaaaaactaattccagtttggagccggactaaagcattaaagtagcactgcaatattctcttgcactgatcgagtaggaagcatggaactactcaaatgttttacaaggatcatctacttaccattatctgatcctcttgaacccacagctggaatctgcatcacttgaaccccaaaggagcctgggccagcaacagcaaggcacagctaccagcagcgaacacatctagtatgaatcttgcattaaacagcttctagcttgattggtgcttttgtaaaaactgataaaacaaaaggtgcttcctctccaggatggatggttgtgggcacaattgtgtatccttttggataaggctccaacactaattcacatgatatctcccttgagttaacataatctgttccacccactgattcatgcatgtagatattgtaagcagcacggcagccccgtgtcttgagtatcctcattccaatgtaaaacatagaagagtcatggctagattgatagttccggaaaccatttgtctttctagaaaaaccaacaccctggcaaagcatggaatttgtttatatcaacatcatagtgaaatctccaagtacattaacattcaggatggaatatacctgcgtaagggtaataaatacatgtacaggatacagtgcatcccgtcctgttactctaagccggtactgaggattttgatgccatgagtcataatcttggcaaccacctgcactataaccacgccattggccatggacagagtaacgcatctcgggtggataaacacgacagacatatattgaccgaaagtggatctgaaaatcttgccaagacatccagaataccccattctttgactgcaaaaacaaatatgggtagggtcaaaactgcacacggaaataaagttgggaaaatatattttgtttttgtaggtacaatgccttaagctgaaatcaacaaactggaggggtgacaatcaacacatcggtttttttctcattctattttaaattaaactgtagtgtgctcactcaagagcacagtcaacgagataagcaacagaccaacaattttatcatgctaaaaggaaccagtatttggtgggttcatctattaaatttgacgcagttgtgtatctttctaatcacaattagtggaataccagctgttcaagtacacggtcacagagaagagcaagtacctgtggaacatgcttaagtttgtgcttcattcgctcagtccactcttgtgatgagtctgaccacggaccattccattcaacttcatttgcccacggatttctaatttgcacgagcttatggccatcaacttctcttacctgtaacatacaatataaatttgtctagcgcaaaaagaatgggaactaagtgattgccaaaagatacagacaagtcagagcaaacctgcaaaattgagtaagcatgtccctgaacaatgccacttgatgaaatatgagcatccgagccagaaggacttccagcaccaagaagaaagccctcttgtttaaaatgcaacaactgagaccacaatcttccactagcaagatcaatctgcgcttgggggctccgcatgtcaatctcttcaccagctcctcctgtgagatccactagagcatcttgcacaagcccaccctccaatgcctcataagagccatgaagctttgcataagctttttcaagaatggatacccacagctcattttgctttctactagtagcaaatgccggtttccccggagactcacaggggatccaatcatcaaccaccactgccacccattcaccctagtaatttacagaacattgaaatataagctcagatcaaactggtcaaagatagttcttcacaggacaatctcaagtcttttttgtgttggtgggaaatactccctccttcccaaaatgatcatcatatatgtttgtgcaccaagaccaaggataatttaaatcacatcaatcaagacaccatacacacattctcccacaatgcatgcatcgatcaaaacaccatgccaattacacctagcatgcacacattctcccatgctgcattaattgtattctgataaaatccgcgtctatgcggttatatgatgatcaatttgagaaattttgaattccattacatgatgatcaatttgggaaggagggagtaatccacaaggtctggtgaatatgagctatttatactattatttcacttttatcaacttacctttgagtttcatcgtaaaatttacaagcatatactgcatatgtaagttgtgcattagtgacttgttcactcatggttttcaatgttgtttatgcagggcataatgcacatgtgtaattgtatatattgtgtcattccatttgggaatttccctaaaactcgagcaagataatggtatgcattatgttcttcatggtggtatgccccttactagggtctcgcaatgttagcatttcagaagacgttggcattcttatatgcaccctatggaatatgaatagcaaatctaaagtcatgaatcccatttttcttaattaaagcatataggttgtaagcctatgtataaatatatattagacagctctaacaactgtttatgtatttatgtagtatcaacttgtccaaattaattatttcgaactagcggaatttatccaaactaaaatctgcaagtcaaggtttcactgagcctctaacagcactattaggtagcacacatatccaccatagctctagtaacttgtggctgttgtattatttctgattagaacttctttcccacaatgcagaagaaaatggcttgttgatatatgttgaacacaaagtaacaaagagaatcaacttgcagctcacaaatctgttagtttgcttaaccaattcaactttgatatttaactctgtatgagactaaaatgttaaatctcaccaagatggtgtgctctaccaatatactttaccaaaggaacaacccaagaaaatggaatggaggacagatgggtcagatcattgaatacctggatacagaatctgacagtgtaaatcccttcttcattatactcaggagtgattataacttcagatatacgggccatctctgtcaaaactgcaacagcgctcaagaaccaacagtcgcccaaccgaccctgaaaagaacaatcggacaaattggattgtgtgtcatgtataggaagatggaaatgtataaagttgaaattctagtataggggaagaccccacatcagcacaaagcaaaatctgcgtacctgacacacatctgacgaattcacagaaccagaaaataagcacggttgtgaactgatagatacctccttcgcaatatcagaaggcctcatccactcagagacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagaggagaagctcatttttcacaagaggatgatgctaacctcaacacattaagtgaagacccaaacaaaagtaacctccccagtatctccatcattcatgaagctgtaggaccattagagtcaagagatcagaataaaactgctgccttccccagtacttctggtgtccaggacactggagaaccaaatagtgctttacacaatgtcagacatgaattggattcattcaagagttctcggcagtgttctgcatatatagaagcaaaaggaaggcaatgtggtaggtgggcaaacgatggtgatatttactgttgtgtgcatcaaagtatgcattttgctgaccattcgtctagggaagataagtcacttactgttgaaactccactgtgtggggggatgactaatcttggtagaaagtgcaagcatcgagcccagcatggttttatcttttgtaaaaagcaccgcttccaaacaaatccagatgcaatgagctcagatagtttgttaagttcgtctgagggccgtaagtgggaagagtcacagaaaagcgtggagaagatgtcttcctcaaatgcaacttgtagtgtaggctcagagcaggcaaataatttccaggttgctgtgcacatgaaagtgacaccaaccatggctgttgagacaactagtgataaagttaacgtgtcagagaacgctgatctctgctaccccatgtcaacttccatggaaaactctaacttagatgcttctatttgcattggaattcgctctcatgacaatattgctgaatgccaggattatgccgtacgacacacactttactgtgagaggcacataccgaagttccttaaacgtgccagaaatggaaaaagtcgactcatctctaaagatgtctttatcaatcttttgaagtgttgcacgtcaaggaaagaaaaactgtgcttacatcaggcatgtgagtttctttattggttcttgagaaacaatctttctcaccaacgcccgggtcttggtagtgaccatatgccccagatattagctgaagtgtcaaaaaatcctgatgttggagaatttttgttaaaactgatctctagtgagagagaaaagctttcacatgtttggggctttggtacagatagctctaatcaaatgcattctgagaaccaagatggatcagtgatggtgttacgtgaagatgggacacatccttcacctggtctgaagtgcaaaatatgttctcaggagttctctgatgatcaaggacttggattacactggacagaggttcacaaaaaagaagtgcggtggcttttcagaggctattcttgtgctgtatgcatggactcatttaccaacagaagagttctcgaaaggcacgtgcaggaaaaacatggcgctcagtatctccaatattcgacactcttacgttgtatatcgtgcaacagcaactttttgaacacagatcttttatggcagcacattgtttcagatcattctcgagatttcagccttctggatcatgtccctcgacgacctaggggtcaatctatcaaaagaacagaaagggcaagtgatgagctcctttatgataaccataaccttggtaaggatgatggtttacagaagttcacctgcagattatgtgggatgatgtttgatcttttgccagatcttggccaccaccatcaagttgctcatacaaactcaggtacagtcagtgatatcccttcaggacgtgaaaagtatcagtttaaccgtggtcggcactattattcagccttcaagaaaagtttaagaccatccggctcattgaagaagaggactagttctggagttgagaaacattttaaggctcaaagcttggatctatctatggatacatcacacattgtggaatctgagaccaccacccttggtaggttactggatttccaatgctcagacgtggcattgactttattttcaaagattcaaaagacaagaccccacccaagcaaccttgatattctgtctattgcccgttctgtttgctgtaagacaagccttcgtgctgcattgaaagctaaatatggaatcttgcctgataacatatttgtgaaagctgcaaagctttgtagtgatgttggcatccaaattgattggcatcaagaagaattcttttgccctaaaggttgcaagtccaggtctagttctaattccttgctccctttacagccattgataattatattcgatttttaaaatctcaatgataataaaaaggagaagcagcaggcacgatgtataggagtatagttgcagagccgccaacggttggcgggatttctagaaaataaaaaagaattccaacgatacttatgttcgatttttcgaatcccaatgacaataaagagtaggcgtcggatgggtcgtagaggaatatagtggcatcgtttgacgtgacttctcaaaattataaaaaataaaacccaacaagacaattaatttttaaaaactacagggtccaatttttaaagatacgaaacttctaaaaagtaaaaaaacaatgataatcatgttcgattttaaaatcttaatgaaaataaaaaa

SEQ ID NO: 24057 - DNA, 2185 bp, Oryza sativa
caattttagagatgggttcatcggatctacaaacagagatcgatcatccggagggaactcttgatcagtaaaatttctctctcccttcgcaataagagcctctctaacagccctttcgacagaaagcatgcgctgattgacttcctctcgtgtctcaaatcttggtttccttggtcttctagcaaaggagtcaatgtcaatagctacagaatcacgcgcatgacgtttcctaccactggagtactgtccatcccattcaacgtcctcttgatcatatagttcaaaatttgcttcttcactttcccagtcatccacctgttgaaacaatattagatgtatgaatatcacatgcataacttcataatcccttccatttcatggctctcaagaaaggtagaaatgagtaattgttcaggccttgttcgtttaatccctcccaaaagaggatttggaggggatttgttccacacctattgtgttgtggaatcattccccctcaatccctcactattggggattaaacgaacaaggccttaggagtttcatgttcccttctaattaatgaaataaaagcaagataaacagtaggaatagattggtcgaaacaagaacttgcccttgcagaataacttccatgccaagcatcctcagcagcaagatcaaaaaggccatattcagcagaacagatggctgtatgcaacatagcaacctcatcttcagtcagacatcttccccatagaaaagcatccatgatctgcatctttgagtctgatccctcgctgtctgacctaccaaaggcatctaagtccgtgggtggcctagcaccaacccaaatatctgtcccaggttcccagatgccattatttctaggcaatggcaacgcattctgatatccatcgtagactccgtctatgaaagaagttgcttcacctagatcagcatctatagtcacagtgacaagatgccacctgaaaattaacattggttacagtcaggcattaccaggaaaaaaaaaagttgatgaaatgttccacccaaaaagacatgcgacaagtccatgtaagactagtatttcgatgtgaatctgaacataaacaggttggctctcttgattctttttttttcatgcaaaagaaacagcagttgtcacgagctggtacctgccatcagcaatacttgatgcaccaatattccactcttttgcaacggttgtcatcctttcacccttagtcaccaatcgaagaccaacttggccagcttccattccctgttctgaccctgccaccaagatttcccagcacacttttttctggaattctgttccaaaaagacagactggacctgacaccggctgcaccattactgcaatggagaagctaacttttttactttcacaaagacacaaatcaatctctccacaatgacgcccagtactccttggttcatcatcaagtatgcaaacagtgtctggaatgccagtctgcacagttcgtaacaagtaaaagatccaaagagcatcagtaaaaaagtaattacaagaactgcatgtataacatatggtactaaatttataaacagaagaaatgattccaggctattacacgtaactaactgtcatgcaaaaattgatgctttgtcagataaccaactccaaaatggatggcaaaaacagataataaatatccaaagatgaatatgttcagttcatgcactcaaaaggtacaccatgagaactatatcatcattaaggtgtgctttagaagttgataaaatctaatgattacaggaacagtaacagaacctgctctgctcgccgagccaattgtgcctttcttatgtgacgagctattgacgagaccctgtcccttgcaaaagaatcttccagagcagaatcaccacccacagctctgacagctgctgccatggctgcagcatccctgcttccagcattaggaatagaagatagcagtgatatttcaagctccttccattttcgttcctctctctccaacaatgccttcctcctttcccttcccttcccttcttcctcgcgcctttgcatcaagacctcctcttccatttctttttcccttatgtagctgaataagcgaataagagaatttagatggcgggcacagaggtttacagggttgcagatagaaacattgcatacataaaagtttta

SEQ ID NO: 24058 - DNA, 15922 bp, Oryza sativa
aaataataaaaatcagagtcataataatctcattgataagtactggtcctggatattggagtagataacaccagcagcacttatgtaagtgtcaaggctgacaaggagtgggaacatacatgattgaacttgatgcactagattaagaaaacatagttctgatctcagcgctagatgctaagtggtaggcttactgaggcaggtttaacagaaaagtatgcaagcaagaacagcatttacctatgttacgcagggatatgttgaatatctgaataatacaaatatacagcaaacttactttgttagcagaacgtgacattgcttgtacaactgtatccttactgagaaagtgaacagcgtcctccagcatctgacaaaaatttcacaattaatttaagaaggatcaagaaaaaagaggaaataaaggagtgtattattgccattggtattggcacttcaggatttgccaaccaatgtgccactgatgtgagcggctacatgtggtggagttgcaactggcaagtgctgaagtgcatatttttgggtgacaaatcctagattttcctaagagagagctcatttcaataatctgctgattttggataaacagaaatactaaccttgagagtcaggcatggtcgagaaacagcaaaactgaaggcaattacaagagtgatagcagaaatagcagccccaataaatggtggattcaatattagactggcaatgacaccccaaacttcagtagccaatgcaatcccatacaagataaggaaggcataactgtaaatacagcaatgttagggtgtgtgctcagatgacaatagtacttctaaaaatagcatagaagaaagaagttatgagttatgaccaatcctggtcaaaggaaagatatataagcatgtagaattagaaaggccatatcctgatatccgtacctaacatttttagcagagtctgcatgggcatcataaacataaacaggtaataccctcggtgaatacacgacaattggtggtgatagaaggacctgagaagagtacagtaaattcaatattacaagcataactcttgagataactcacaagtagcaaaactagcatgagatgttcaacagaaattatcttaaacatgtagctaacttaagttaagaaaaaagatatgaaacttacagtcaatgctcttcctgtgagaagaaatagaaacgagaaataacctatagatgccccaacgaaaggtttctctgcaaaaaatcatcagctgatttaagctatgtgcataatatgggaaactattatgtaactcggagaaagaaaaatagcaataacaggttgaaaagcatataagaagatgtagtcaccctgaaataagcccatcaggaaagcagccaaggcaaggagaaaagcaagggagcaaacaagtaacatttgtgtccttgttaaatagaaattgttagatgtccagtagtgaatgacaccaatagcaaatacaaggaacaagatgacaaggaggcatgcaactccaacctgcatagcaatgacagatcaattatgctgtctcttatcacaaatgaaatgaatattatgataaatttattttgaaaaccaagccacaaactttacttacagtccaaggtctaattgtaacaattactgcagatattgcaccaagcaataacagcactcccatgccaacaaataggtaaactccacgggaaatcttccaatcatcatccttcctgaaattatttgcaatttcatctcagaggagcagaagtatgcaaggacgtacaaataataaacatggtttccaattttccataccatttatacatcccagtaaacaacgagaacacagcaggaatgcaaagtaatggaagtaaagctgccaggaaatcagccttcagaggaactccatcctgtcgtgaatttaccactccccagtaggacacaccacaaaaggatacaaggacagctgcagaaagtcaccagtcaagtgccagttatccaaaagtgtgatgtgctctatttaatatgcaatgagaacggaaaagaagagtagaacatacttgcaaaaaggccaacacatatagctgatgaaggtgaaaatcgataagtagcaaaccaagcgacaataggtatcaccccagtggcaagtacagcaatcgttgatgataatgcccatccaagatacatcgatgttgcatagggagaatagaaactctttttatcagcatcccatcccttgtagcccaatgcatctagaggttttgctgatactattgcaccaaggccaattactgatgcagtgaaaacagttatgctgatggcaaacagagcgcgctgacaagaagataacaacgatcagtaacatgaaaatcattaacaatgctggaaggtctgaatgcgttctacactatttataataacattagagaggtcaagaggtatgtgctgtaaaacagagcctgaattcttttcagtaggatagcctacaaaacaagattttatctaatgctgataggaatcacaacaatacagtgaaaattgattcagtaaacatattcaggcattcatccagaagttgttaacagtatattgacataaggccatatagttagatgatactggttacagtactttccttacaactacgcaaatagcttatacagacatttattggatatccaaatatataaacaaaagggtgtcctggtggtgaattaaccaaaaccaccaaccttttttttttctggagcttggcggatattttcacggctatcaagctcccctcccggaatccagaaacggtaaccgttacgcatccatatgggaatagcaaatgagagacaagccaccataagtgggaccgtgagtgacaaacccaaaataactgatgacttgctgcagaatggcagaggtagtatttcagacaaaagtgtaagtacttccccaatgaaatgaatcaatgattataaaaatctagtggctagagagtcatacatatgtataaacaaggcatatgcaagatgctgtgaatatgtcaattgtcaaaacaggaacaatagaataatcaagaagcacattttagcaagctaggacaccttatccagataaaaggagtaatccacttaaagctaaaactttgcatactaggaactcgaggcagcagctatgactggaatcttagaggcagcagtgaccaggaactctagatggtggtgttgaccaagacctggaggtgacaaagatggggagctcaaggcggtggtggcgactaggatgtggaggtgacggcgacagggagcttgaggcggtactgcgttagcgattgggacctagaggccgtggcaaccaggagctcaaggtggatccagcgatgatcaggaccttgagtaggctaatggaatggaaggggatcaagtaagagttttcaggctgagcgctggcagtgggtatgatggcaaaggtgggtaaattactcaaacaaatcccacaaaagccatggaggagcaaggaaatgagatctccttgtcttcatgaatgggcttccttttgtgagcaactcctgggatgagctagccgtgtgagaagtttgctagcttttttctgttcaaaagctggctaaaagctgtcccaaaggaggtctaagacaagactaccatatagcagcgcaaagcacgtcagagtataattttatgtacatcaactcaaaatgagctgtgcatagagaacttaacaagtaattgtaccatgatcagataacaagtggtgaggttatcttcatgaaaatagataggtctcttttgtttgcaacaaacaaaagaatgactcgatgacatttattcgtactaatgctaataataacacacatgatcaattctaccaatataaaaagattccaagcacaaggtggcgtagcaaatgaaccaggcagagacacagtattatagtaacagacttatacaataaaatgtacttgtgtagaatatacgaaacaagtggacatggctattatgctgtgcatgtatcatttgatacccatgtgaaacttctagtcaaaccagcaagacaccaaagcagggaaggaaaacaaatgagtactccaggatttacacaaggcaaaatgcagtagtaactaagtgaagttttaaatattaaataacaaacatgtatacctcaagaaagacagaagtagaccaacacaagtactcagcaaccatgcgatgaagccatactgtagatgggaaaagaaaggaaaagtcactatagctgaaaatccacgaagattttgaaaaaaaaaatcaactacatggtcaaagtaagataaagcacacattgtaatcagatttgatattttgtagacgagttaaggaggacagaacatatctaaatgtctagtgaagaagcaaaaggacttgtcctgccatgattaaaaaataagtgcttggtattaatacgacaaatatatttcttttgttcaacatcaccttccgaggtttggatgtcatcgtcatctcttctgcacacagggaccaaatgaatgccataatggagcagacaactggtgatagaagcagtatcgagaaaccaaactcaaactgccaaattcgaaaaaggacactcttgattaacaacacaatcaacatttcaaagtttttatactgtctttgcaacaaacttacctgttcatgagttgcatttataaccttgatgggcttcggtcgatggacagccacagtaactgtttctatgatgaatattagggtaaaaacaacaaaagcacgtattggtgaacctgctacttgatgaaacatcagccttgaaagatttagccaattttctagcccacttctcctaagttcctctgatagcgagatctggtttgcaatagttgtatctaacctatctgaatcagtaccagtgacatctacatcatcttgatgctctctgtctgcatctaagctgcttctctgcagcaaagctaaaattcgtgggtccataaccttgtctttcatcatataggaaaaatttggatcaaggcctttatcctgaagaagattagccaattctacatctcctagtccaccattcctttttagcatagatgtgattcttggatcattcagtctgtcctgaaaaattgcagccaagttcaaatccaatagctgctgattacccgaggcagtagctgatccactagactcgcagccttgactttccaaaccactactagagcaaacaacgagtgaagcagttgggtccccatgcctgtccgctgaaactacagcagtttcagggtcttgtacagctacagcagaaaggcacgaattactgcgatgggctaaactggcacgtccactatctatgttcttgtcagagctctgtccttcttgacaactattcgatcgatcaaaaggaacattgttccaattgacacaatcgctttgtgagttgcttctgtacatagaatcagtagcattgccatgaggaccagcttcaacactgccactactacgcttcacactagatccacagccatctgatgagtttgaagaactagtttgccccttccttcgaaaaccttctcggagttttatcactgtgcttcttaatgcatctatccttgcaactgaggggtttgaaatagaaagccagcaagagacagctgcagctaaaagcacagatgctacaaaagcataactgatgcaatgtccaaggtacctaatgtaacacattaattagtaaacacaaagtactagatcataaatatgttcaactataaaagcataaagatgaatacaaaccagtagtgcaccccaaagcatataaggaaaacccttgatgttccagctacaaatagcgctatcatccgacttttaagaagctcaaacctaaatgaacacaggcccaaattccagtctgtagaaaagaaaataagatgtcaaagaaatagatacatcatgcacaattagagatacaaggccaaatcattaccgagaatcactactgcaactgaagttaaagcacccagccagcgtgcttcttttgatgtcagaccatataagatggaatagacaacaagaaccatcaatgagcaaaggtaaagaagccctagatgcaagaccctgcattttaaggcattgatatgttaccaaaactactagaaattattgcttaccccagtaacagcataatagaacaagcacgttacttggggaacatatatgcctatgtagtatttaagagaggaaaaggtagtgaagtcacctgctggattttgtcatgtataactcactaggatctggtgggtcaggcgagcatgaaacaggggccacttcaacacaatcagaatatgcaaatttgtacaaccttcggacatactcatcaacatcgaatccacttcctgtacatgtaatgtatgaaaagttatgtttctcaaattttttatttacaggtgataagaaattcagcaaataaagataacggataagaattttaccattgaacagtattttacttataaaaagcatatttatggccaatgaaattgcagataccccaaagaagaagccagatggggaattgagctcagaagcactagcaccggttgtaacataaacagcacaaaactcataagcgcacagtagaccgactgccaggagtagaagataagcaacagcctctgcaacaaccaacatttgttaacatcagtaagatattaataaagaacaatgagatgatagagcggcccaattttgcagaaacagcacatacaaaataccacatgaatcaaagagttagaaattgcagttttataaagtgagaaaagttcaaatttgtagtagcatactagtatttttaatcctccgtgaagctttaaaagttttcctttgagtatgccaaaatgttccatttataccatttcctagttacaattgtctagaaacaaattggacccccaaaataagcagagaagtcctagacaatcatcgcctattagaatatcaaatttaatgaacccatgacttagaagtcatgaataaacagccacttatcagaatatttggtttaatgaaaccatgaccctaagtacaagcacattgagtagtcatcacaaaatgtcctagaaaataaaagcatgtaaacagtagaaaacttactggagctttgccattgcgttctccaccacaacattatagagtagaatgacagaagcaaagcaacaccgaccattataacagctagcccaattatgttcctttccaaaagagcaataaggatgcctccccatactaacaaaactgttattggagaaacgacgacaagccatgcaaaaagagtgaaaaagctgcacagtgtgcttagttgaggtccttgcacatatgctggccatttccttgcatatatccaactgagtaacaaaacaagaacgaaaatgttagtagcttaatgagataatccagctctcagaacatcaggaacaaatcaacataaacaaatatgcatagaagatataagaatagaaaaacatcaacgtttttcagggcactacttgtgattgtagttagacacaattacatgatcgtattccataatctacatatgaatggcaggcttaaaatatataaggtgtggtgttggattagcagcataataaagacacaataaataatttcagttgttagagtgataatgataccaaatctacattgttgtatgcactctgctggctgaaatttatggaaacataacgtatgattaataatgcaacctcgcagactacagatgcaaatgctagatgccaacagaagcacgcctaatctcgagcatacctatatagcctccacggcctccagttcacagcccataggatccaaaagctgagagggccaaggacagcgaagaggaaaccgcagatgctgcaaacaagaacaaccccgcggtgttcctcctcttccatcctccccctctgcaatcaccttctggaagctgatatcatgtatacaggctcaaacaaacctgctaaaaggtagaacatacaaggtccaatgatcaaaagaccaaatatacataaatgacactaagtatgcaggcaaccagattagtagtaattactaagttaattaagacaaactacgttgagttcaacgcatatggtaatattttctcaaaatattggcctaaatcagtccactacaatttacatgtaacagatcaatatatattctatatacaacaaacacccccaaagtcccaatgtggacatggctttggggttttccttaccaaacctaagcaccgaggatgagaaacttaagcttaatgcattttaatgaagccaccagcctgggtgcggctaacaactaaaaacttcactacctaaaaagggttattctgtgcatcacccaggtgctatagccctctaaatatggtatagataaaaaagaaatcccatgtatttgttctttatgcatacaacactacagattaagcccttcaaatggataaccaataaactaaacaagttgattgaaaagcaccagcctgccagctggagttaaaccattcagccagggtgctaaatctacagcaaatttggtggtaacccgataaaggttcactagttaaaatttattgaggtacctcgagttcaataattgaaccaaatattttcagggccacagaaaatataccacaatcagatttttagcacgaatcgctaaaaattaaagaataaggaacattaatatcacctgccccaacatttacactacacgttaacggatattaaataactgcattctgaggcttcaattatctaggagaccattttgccacgtaaaacatactaaatccgaccgttcctagaccgttttatgcccagccttatcccaaacatgaagtaagttccaaaggttgagattaaaccatccagaatgcatgctactgggtcaggacagatccaaccttcattgcccgtcataaccatcaaatctctatgcccagaatatcgcgagctgtacaaacacactaaatttcaccaagccgtttgctgcatgccctcccaaaaggccaccaaatctgtcaccgcgcgccaatacaatcctcctaagcaagcggcctaatataggctagaggacgagcagccatcgcgacctataagccaaatcccactaaaacctcaaccatcttccgcccccgcagcactccaaacacgccagaaagaacatctcctcagaaatccgcacctcccagcagccagtccaaccgtcggaggcagcagcctccgcgcgcacaggaagcgcacccccacaattccaccaaccccccgcaatgcggcggccccggagcccgcaattcccgcgaggagcgcccccgacagcacgccagccccgccagatccggggcgccccgccgcggaagcccccgaatttccgcgcgaaaaccctagccccgcggccgcagaagcagaaacagcagcagcaacggggcggcggttacctcagcttaggcgccgcggccccccggcggcggcgggcggggcgggcctcctcgccggcgaccgaaaccctagggtacggcctctccccacttttttctctctcctcctcctccctctctccctcccctctctctctctctctctctcccctcacgggatggcttcgattcgattcttctccgtgcgcttgctcgcgagcgagacctgtgtcgtgagcgagcggagagggggggagagagagagcaagcgcagcgcggcggggtgggggagacaaagagtgacgtttgtcaacttgggtgggctgcgtgctgactggtgtttggttggtgcggtgcggtgcggtgcgtgtgcgtgtgcgcgagcgtccgcctgcgcgactgaccgctctcgcttcggcctcggcgcgagcgagacttgggctctgctccgaccgagcgcgcgcgtccgcgtctccgcgaccgagggggagagtccactccactccacacaaccgcgagctagacgcggagccagcaaagccagccagaccagcgaggcgcgccgtttcccgtgcgataacgtgcggcttttcagcgtgtttgctagtgcgaaaggccgtattttgctgcgatttccgcgcgcgtactcgcagtgtctttctggactcactgtatcttgtgactttttaaccgggagtgtagtactttgtatggatggcagtttgtatcctaatgaaagaagatacgtaaagagagtggacatgatgaaagtcatatacgaagtacttgacgtgagatgtaacaaaatacgatagtttcctagcgtaagaaattttggaagactttgaaggattggaccgagaggaataaacggtgtactctctctgttccataaaaaaactaacttaatactatatgtgacatattctactacgaatctagacatacatctgtacagattcattgtattataatgtgtcgcatctagttctagattcgttttttgtgggactgacggagtatcttttcactatctttgttaatataagattatatacaaaacgtggggccatctagcaatatatggcgggaatgacaagaaacatagtggatatgctacatgatcaggagtgagagtaattctatgtgttcaccatgttgctccgtaaataggttattaagaaagtggtaggacagataaaaggtaactagctaagcgtgatagtttttttcaccgtacattatgttttggatcatacgctagagtttaatacttattttcttgtgcataactaaaagacataacggtaactctaactaggggctttctccatccaggatgatattattagtcatttaagctcaattggcagtctatggtaaaatttatcgctgaagcgattccattgaggtttatcacaagtttgtccctatgtattccgggtgttattgtttactatatcaacttttctgtacacgaagtgcatgcatggctcgcgttcgactcagttacttcagtgcttcgtctattgcacctgtcttgggacatagtggttatgttcacgcacatgtatactcataaagagaatttaagcgggagtatacatgtcccaagttgtgttaagggtttcaattgagagtagaaccaataaaccatagtttctgactcaatgtacaaggctaatgatgaggagatccatattaacaactccatggtcgtagtcatgaattccatgtatgaggtcgacaattaaggcttcatggccgctgactcattgggagaggccaacgaaaaagtgcccgtggttgccgactccatgatacatgcattaatccagctgagagcaatttggtgttggcttagatgacacgctcgacagtatttaataggagtcgtagaataggaaataggaatctcaataatttattgcttgtgaggacatatctaaaacgaccaatgatatcaatccaaagggagtataaaattaaggtggcgatatgtatatacgacggtctagggtaaaattaacgagtgatccgtgactatacatactataatagttgccatggacaacattttcaaaattcaccaaaatcatccattaggacctgttggtagaggtcatgatgacatatcattataatctaatctacactctggttgatcttcagttgctttcatatcaaaaagtataaaatggattcgactttgtacgaaagttcaaaagaaaagcaccatgttaacatacgcaatcaagaagcttagggacgtccttcctctatatatccattccgtttaagaaaaatatgcttcattcatccttcatttatccaaaaatatatgtattacattaacatagtcttaagacttcaattctgaccaccaatttccatgataataaaataatagtactgccgtgaaagtgcaacaactaatgaaatcataacgtcatggagtatctttcagacaaacatacacacgtcgttaaatgaatccaatctaaaacataaaaaaggtatcgacctaggaatgtttttcacaactgacaggaaattattaacattttaccatacacagtaagtaatacagtaagtaaaatctcaaacaagttcatcagataggttttccctgaattcctgatacctaggcaaatagcccaagagaaagaagaacgcccggctagcatgggccgggccgtagcattggttgattgcagccatcttctcgtggcagttacgagcaaaccttgttgcctgcctgggttctgaatcctttgacaggccgtcgtcctactgtccgaccgtactccctccgttatagattttgagtttttacttgcactgtttgaacattcgtcttattgaaaaaaattaaaattattatttattttctttgtgacttactttattatccaaagtactttaagcacaacttttcattttttatatttacataatttttttgaataagacgagtggtgaaacattgtaagtaaaaacttaaaatctcttatattatgggacggagggagtaattccgtaaacacaacaccttgccgtagattgtactatactgctccagtaataatgcttaccactactcctaccatgaaaaccaactgcctggagagcctggacttctgctcaagaagtgaaatcctttacaatgttagcttcagctgttgccgactcgctgtcatttgtcaactaccgccgccttctggtcaccctggacttctactacactgattttgatagcaacaccgcacgtcccatttcgaggttgatatctttcgtacctgcagaatcagccgcgatagaagccaactcggcgatgcttctgctgccgccgccgccgaacgatgattgtagcgtggaattagactggcagagtggcaaatgtagcgagagatgtggccgtggatagataggctgtgtttagttcacactgaagtttggaagtttggttgaaattggaatgatgtgattaaaaaattatgtgtgtataaaaggttcgatgtgataaaaagttagaagtttggaaaaaaactttggaactaaacagagccatagatagctggttggtacttggtagcagtggtctggtacgtacacggacaattcttctgccgtccatgtggtgggtaggcgtacatcctttattgtgatcaccaaccgtgccatgcacgcacacctaacattccggcacaggtctgtctgaaaatgtaatcactgctaaaccagcttaattatcacagcggagaggggtcgccagcccaccacaacttgattatgttattaatcactagtgctgtccacagatgatctccactaattagctctcttatatatctcacagagattttttttaaaaaaaaacagagtcaataactgaagacatgtttccttcaaaaaaaaaggagagaactgaagaaatgaactttggtatagaacatccataagtttgtatcaagaactgaatgtataatttatccattaatcagtgtacaaagaaggggggctgaaatctaagaacttctaatggtaacatgaagaacagaaggatttcaaagaacatttacgattacagactctaccacattgacatacatgtgtgatcctcttggaagcttggagcttggatgtgtagtaggctggaacaacctgggaagccgaggcggcggcgatctccagttcatggctccggcggtggcagctcggcggcgggcgccacctcctccaccacgggcggggggggcttggcctcccgccgcctggcgacccggcgaggcggcggcgacccccagcagcaccaccggcaagccagcgtggcgcagtcgtaccgctcgtcgggcccgtcggcgtggcgcgcgcacacccggccgaggacgcaggacagcagggtgagcaccagcaccgccgcgagcacggcgaagaacgtgccgatggaccccccgccgccgtggccccgcgccgccgccccctcggcggcggcggtgacggagccctggtagtccggctgcagcggcgccgcgaacgtcgcgatcgccggaggcggaggcggcatcgacgacggcatggcagtggccgccattcttgcatccagtgggggggtgtgatcgatggaatggaccagctgagtgggatcgtcgtggagttggggaggagacgatcagaattcagacgagcatagcatgggatgggatgggagcaggaatggaatattgagaggtttcgtcgaaagcgtcagctcgctttgcaaaactactactactactccacgatggtgatgtgtcgaaggatcagaggaggataggtgcagaaaagttcagaaaaaaaaaagagggagagcaaacagcaaagtctgcatttctgaaactgcaaggatggcttttgtttggatcgagtggaggactacatggaaagggaacaaaagtgtgatggctggtagtcatactatccgtggaaaattcaggaagatgcaaggggttgcgaattaaccttgagaaatgtatacatcagggactttactggtgttgtttgattaacatgcaaggtggtttcccatgaaacatttccaactttacgtttgtctttgtgactttgtccaggcacagggtagatgcagttatttctaccatttgttccatactctcgcccttttccgtttctactttctgctgttgttaattatggatgaacgtcaactttttcttccttgagtcgatgatgtgctgcgccagtcgcaaatactgccgatcaagcccaagcaaatcctactttaaggaggcccaaaggaattggcctgaaagtttaaattgggtctaaacatggcccaaaccaacataaaaactggacgctgctgggcctcgccccacattctcgaggcccttgcactcttgcaggcatgcacagccttatttatccaggccagctgtaaatccttaaaattgagcttcagatttcgccatgaatcagagatgtttcgcgtaatcagaactagctgggtggcccgctcacttgcgcggctagcacctaaacaaaatcatatattttttaagtatgattttactttaaatttattaaatagttatccccgtatcatccccgtatttctaattatatagtttttaaaagtcacatcagctgctaccccttacttctgtcatatccttctttatttgcttgctcggtctaccactatttctattcattctccttgaaacctttaaaaattggatctgttttttgagtttattatttcgttgggtttcgtttttataatttctggaagtctcgtcaaacgctgccattatactcctctatggcccgtccactgtcttttctctttattgtcattgggattttacaaatcgaacataattatcgttcgagttcattttttttactttttataagtcccgccaaaccgtcagcgtttttgccattgtactttttatggctcgcccgctgtcttctttttttattttcattaagattttaaaatcgaacatgattatcattgtttttttactttttagaagtttcgtatctttaaaaattggaccctgtagtttttaaaatttattgtcttgttgggttttattttttataatttttagaagtcacgtcaaacgatgccactatactcctctacgacccatccgacgcctactctttattgtcattgggattcgaaaaatcgaacataagtatcgttggaattcttttttattttctagaaatcccgccaaccgttggcggctctgcaactatactcctatacatcctgcctgctgcttctcctttttattatcattgagattttaaaaatcgaatataattatcaatggggtttattttttttactttctaaaagtcccggcaaccgccttacccgtttgcttcacggcctaccgatggttggtgggacttcttga

SEQ ID NO: 24059 - DNA, 20488 bp, Oryza sativa
  unsure (1)..(20488): unsure at all n locations
nnnnnnnnnnnnnnnnnnnnnnnnnnnnnnnnnnnnnnnnnnnnnnnnnnnnnnnnnaccgatggttggtgggacttcttgaaagtaaaatatgaattccaacgatagttttgttcaattattaaaatgctaatgacaataaagattaagcgacggatgggtcatagaggagtatattggcagcatttgacgggatttctaaagattctatttggtgtattactaacagtttttatatgtcgaatcaaccgccaccactctactcttttataggcttgttatttaatttatctcaccgtgtgttttagatggtctcttttttaataatctttatttttatcaccagttttagttatttataaattgtattctattttaaatcttttttctttttctttttctaatttcagaattttttttaaaaaatatttaataccgtatagtgttcttttaatatttttatttttcatttttgaattttagttgtttcaaaattgtattcctacttgaactctcttttaatttttctaattttggatattattttattttttattctgaattttaattaatctcagatggggttcttatatggattcttctttaaatattgcttttttttaattctgaattttagttgattttaaattgtattcctacttgaactcttcttttattttttctatttttggattttatttttatttttatttcgaatattaactaatctcgtattgggttattatatggactcttttatcaatattccttatttttaatttctaatttcagttatttttaaattatattcctacttggactctcgttttatttcctaatttcgtattttattttatttttatttcgaatttcgattaatctcgtattgggtttttatatggacacttctttcaatattgctttattttaattccgaatttcagctatttttgaattgaatttctacttggactcttcttttctttttctctgattaatgtgggaatttatagccctacagcgaacgtagtgccttagcatcattatattttctctcatataataacatatatgttttctcaatgtattattcaaatatattaaaatgacaatataattttaaatttctaaattgtatttctatatggactctgtttttatttttctccgattaatatgagaatttcgcgcaattacgcggctagcacccaaacaaaatcatatatttttttagtatgattttacttaaaatttattaaatagctatctagctatctcattgtcttaagattttgaaagaccaaaccttatcatcctcgtgtttctaattatatagttttcaaaagtcacaccagttgctaccccttatgtcatctccttttttatttgcttgctcaatctatcactatttctattcattcttcttggaacctttaaatttggattttatagtttttagagtttattgtcatgttgggtttcatttttataatttctagatgtcccgtcaaacgttgccattatactcctctacggcccgtccattgtctcttctctttgttgtcattgagattttaaaaatcgaacataattatcgtttgggttcattttttactttctagaagtcccgccaaaccatcagcggctttgccattgtactcctctacagctcgcccgctgtctcccttctttattgttattgagattttaaaatcgaacatgattatcatttgcttttttttactttttagaagtttcaaatctttaaaaattggacttgcagtttaattttttataatttttagaagtcccatcaaacgatgccactatgcccctctacagcccgtctgccgccaaatctttattgtcattgtgattctaaaaatcgaacataactatcgttggaattcatttcttattttctagaagtcccgtcaaccgtcggcggctctgcaattatactcttatacaccccgcccgctgcttctactttttattgtcattgagattttaaaaattgaatatgattatcaatggggtttttttttactttctagaagtcccggcaaccgctttccacgtttgcttcacggcctgcttgacgtccctccttttaatcgtcattaggattctattttggtgatttattaacaatttttatatctcgtatcaaccactaccactctactcctttatagctatgttacttaatttatctcgtcatgtgttttagatggtattttctttcaataatctttatttttatcacaaattttagttatttataaattgtattccaaattgaaatcttaattttctttttctaatttcagatttttttttaaaaaaaatagttaatatcgtattgtgttattataatgtttttattttttattttcaatttcagttgtttcaaaattgtatttctgtttgaactctcttttaatttttctagttttagatattattttatttttattctaaattttaattaatctcgtattgggttcttatatggattcttctttcaatattgcttatttttacttccgaatttcagctaattttatattgtattcctacttgaactcttatttttttattttcttttgccaattttggatttatttatttttattctgaattttaattaatctcgtattgggttcttatatggactattcttttaatattccttatttttaatccgaatttcagttatttttaaattgtatttctacttggactctcatttccttttttaattttggatttttattttattgttatttcgaattttgattaatctcgtattgggttcttatatggaaacttctttcaatattgcttatttttaattccgaatttcagctatttttaaattgtacttctacttggactcttctttttcttttttttttcttttttttccgattaatgtgggaatttctaaccctcacagcgaacgtggtgtctcctttcaaagctgttttaataatataatagatagatagatatggacgctcagctgttcagtttgcctggacaatgccttatgcttttctattttctgtttaaaacaggtttgaacaaaattaaaaagaaaaaagttgatctctcccccacgcaaccacatcatatggtccataatgtttatatcattggctaatttttagtctaacagcagctttcaaaccgcattcttttttatttgactatgttgtactactttatccaagcctcagctgatgaagaggttcagagagatatttaattatttacactctttaattattccatatcttataaacaacgagtggtaaatagttaaacatgatatcttaaaagtagtaaatagttaaatgtttaggaattaaaagagagaaaccggtttacgggccgtcataccattaccagcagaaaacgctcgttaagattcacgggaaatgcgtggctttacctgacgcgtgcgtggcttccgtgcatgccttattagctccaaagaccaaaacttcagtacaagaaacgccaatctaggctagctgttagttgcctgtttaagggagatgagcaatgagttggcttgaaagaatcaacgagatcgatccgtcaagccactcgagcttctcaagcaacctaaactaacacctccgtctcactcctccaggcacgctagccacgatgcagttaggcatgggctagctatagctaatagctaagctcgatcgatctcttcttctcctcctcctcctatccactgtccaaaagacggtgatcgatctgtctccgactgccgccgccgatgtcgtcgtcgtcgtgcgcggcgggcgccgaggccaccgggctggtggccatggactgcctggtggtgtgctgctgctgcccgtgcctggtgctgcagatcaccgtgttcctcttcgtcaggctgcccaagaaggggttgtcaagtccaagaggatcatcctccggagatggcacgggagaagatcatcatcatcggcggcggcggcggcggccaagagaggctgcagcacggtcgacccggctgcaggcgtgaagaaacagctggaggagctatttgacgacgacgatctattccaaggcgcattcggcggcgggatcaacggaggcggcggcgacgacgaggaggggtggtggaaagagaggtgcttcgccgtcgacgacgacgacggcggcgtgtgggaggcgctgatcgagcaagaggggctcttctggttcgggagcttctggggccggacgacggagcaggtggatcgtccggatcagtttggagacgacgaacatgcccacccagccttgaggtttcctctcgttctcgagagagtttgtgactaaattagctagagtacttaatttatcaatgcaagcttaattagggacagtcgcaacataattcaggcgttgagctcggtttctggctgatgattgctcattgagttcttaatcaattacatcctgttccggccatttccatttgcatcgctcttcagtggacaactaacaaatcacaaatgtacatgtcacaatattaacttcagagtcgagaagggacaatgaataaaaaacacacggcattaagtctgtaacacagacgctgacggagccattttctctgctggcctgcatgcatgctcaccctgcacctgcagcgtccacttggtctgtatattttcagaggactttgaatctccagacggaagtgtatttacaacttcgcgcacacttaacaaatcacaaatgtacatatcacgatattaccaatatcatatatgacatgtatgattaaacatatcacttcacagacataatacatagaatgtaaagttcaatctacacaatactccaaaatacacaaatttggctatgaacaataatgttgattgaatctatttatgttcttttttggctgtgtggattgaatctgtatgtttacggtgttcacattctaaaaaaaagagtaaaaaatcaattgtagtgaatgacatgtatagaattaaagcattggtacaggtaccaaggataaaaatatgattttgctagtagagaaaaaaaagaacataacggtccctaaatttaaatcggtataccgcgtaggtactagttaagtcgtttgtctggtattggcgtacatgttcttatttgcgtcatttcccctagatatacgtcacgttctctaagattctcattcacatggtttcctatatatttttgttttattccaaataacacgttactagtgtaaaagttctcgtttgtatggttttctttatatttgtgttttgttcccaagaacgcgtcaaaactcctctttttaattattcgtgtcacttagatcttgccatagcttctaccatgtctccttgcgggtgcacctgtccaaaatgtagaagaaaaacatagaaggatatctcattccagtcccttatacaacaaaatttatgaactatatgtaaataactaatcaactacataaaataaatcttatttgataagattcgcttagccattaaccgttcgatctcgtcccatgttgaatcctcaaccatgtagtgcttttccctttgtttcattccagtgaaccactttcaaccctataacaagaacaaaccgaaaagatagaagaaataagacaacctatttttccccataagatctattcaatgcccaaattaaacgcatgatttacattttttccaccaaatgctaccgagcaatgcaaccaggtattcgattcactcaaaatgcccatattttatatagttaattactcaactaccatgatttttattctatatcttaccacttttttgatccatggtccatactgttttacctctcaatacctctaagtagctcgcaggtatcataaaagctcttgttgtataaattttttattttgtataaccttttgataaaagctctcgttgtatcaatggtatcacggtttttattttgtacaaaccttttgattgatactcctccgagaagcaaacgagtacgcatgcacttggagttatagaagcccattccccaaatccagtcaccgatccgttaggttccgtgttagctagctcccagagcgtgccggcgacatatgtatcgctgccgaccgccgtgcacacagaatccatccagtcggtgcgcggtgcgccgtgtctcggtcgacaagcgacaccggacaacgacctcagctccacgcacacgcacgtgatgattggattttggatcgtatacgtaccccacgcattacgccaatataggctcgcgtaacaacatcaaacacgcccgcgtccgtcacgctttggtcccctccgcaaccagccgccgcctctgcaaggcttcgtccgcgggggacgctggtgagctggtctgcgcagctcacgcgccgcgcgcgcgcgagcgaaaacaacgccgccgtgtgtcgcgactcgcgacgagccgacgacggcgactacaacgcccaggcgaccagcggcgcggtgacgggccactcctaaacgcgagcgtcgtgagtgggtcgacgtcgacccgactccctggcacgaatctcgaggcggtcgcgcgcgtgggccccgcgaatctcgttcctactcctctcctctcctctcctctccgtctcgcttggccctccgtggtgacacgagccgtggccacctgaaaaacacactccgcccgggccgcacctcctagttgatggatttcagcgtccgagctcgcatccagagcccgcaccggtcggccgcccacttcgtcgccggcgaggggggacgccgccgcccggcaacgtccagggtatccttccgctccatggcgtcggccgcttccgtggaggagcctgccgctgctgccggcggcggcggctgagacgaagaggggaccgagcggcgcctccttcatccgggaacacctcaggagtctcgccccgtaccagcccatcctgcccttcgaggtaggagcagcactctttcccactggtggttgagtttgtggagaacgctgcaccgtttcccgtgccgcgcgaggtgtttgtggaaattcccccgaggcccccgaggctgtttggttctgtattgtgaaagacagcagtaaagcttagattactgagcttatataggagtagtattaccaagcttactgttggttttgtgatgcgccacttttatagtggttttgctgttatctgaaatttagaactctccttgctaggtgttgtccgctcggcttgggcgtaaaccagaggatataatcaagttggatgcaaatgaaaatccatatggtccacctccggaggtgagtttcttgtaatacccaaacaagagtagcatctacctctaatacttgaaacaatacattcttaagaaacagtagtttgaccatgtcaacatgaaccatgtgttataagaaattaagaatgaatcctaataattcaaattcaaaatagtactagcatattataaatcaattcaaagtggcatattagaaacactagctatctttgaacttccaacagaaaatttaacagatctttgtatgagcatacgaagggctggattctcattgtacataatttataccttctctccatctaatgcatatctcttttatacaggtagctaaagcattaggaaatttgaagtttccctatgtgtaccctgatcctgaaagccgtcagttgcgtgctgctcttgctgaagattctggtcttgaatctgagtacatacttgctggatgtggtgcagatgaattaattgatttaataatgaggttagcatgtagcttgttttatacctgctttttgcacgagatttttgtatccgagttgagtaatagcctagttttttttttaataaaaaagtaatagcctagtttgaatggtgaaaatgcagatgtgtactcgaaccaggtgacaaaattgttgattgccctccaacttttacgatgtatgagtttgatgcgtcagtcaatggtgcacttgtgatcaagggtaggtagttctttcttgagctgtacttctatttactgagccttctgtaatgtcttaattcggtgttcacttcttatactgtttgacatgccagttaccaccctctaatgtaatcctgatttgaactcttatgtagtaccgagacttcctgatttttctctagacgttgcacagattgtcaaagtggttgaacaggaaaagccaaaatccatatttctgacatctccgaacaacccagatggcaggtacacctttctcatgcgagaatggggctgttttggttgtatgttgtccagattctgtatcttagtatttcgctgaattacctcaattctatttttcagcataatcaatgatgaggatcttttaaagatccttgatcttccaatacttgtagtgctggatgaagcatatattgagttttcgagtcttcaaacaaggatgtcatgggttaagaagcatgataatttgattgttcttcggacatttagcaaacgagcaggtctgtagtttctgtttgcctttttcttctctggtctgcaccgggctatatcctctgaaaaatccaaaaacctcacccgttttctcatagtactgcatggaaatcacttatctgtactagaatttctatttttcgttagataattttttttagtgctgctgcattattatgtgatgtccagacattgctaagggagcatttaataaaataatcaattcttcttatgttgccaactcattttactgaatcatgctaatttttagtagttactagcatggctttgtctagctgattcattgaaggcatttttgccacacaattatgaaccaaaaatgacacctcattacaaattattgataatgcaggtttagctggacttcgtgtgggttacggagcatttcctctaagcataatcgagtatttatggagggctaagcagccctataatgtttctgtagcagcagaagtttcagcctgtgctgccttgcagaacccgacttatttagaggtatgtgctctggaaacatatcataaataaatttttgtttagtaatttggcatctgctaactttgtgcttctgttgaacatttcattactgaaggaagtgaaaaatctgctactacaagagagggacaggctgtacgatcttctcaaagaaataccattcctaaagccatttcccagccactctaactttattctctgcgaggtcacatcaggcaaagatgcaaagaaaataaaggtttgcactgcttgttagtactccctccatttctttttgtttgaagttggttagtttgaaattgaactaaccaacatcatacgtttacagaggtagtatatgttactcccttcgtcccagaatagaaacatttttagcatagtgtcaagtcaaccattcttaattttgactattaatagcaaaaaaataaaaaaaagatcaataatgtaaaattgatgttgctagatttatcattgatcaaactatcataatatgtaactctttttatatttaaaacattttattttgatagatattattggttaaagtagcatctcgaagactgtgtcgagatccaaaaatgcttatattttgggatggagtacaagtttctgctgtattttgttgtggtacaatgtaataactgcttctgttgttatattcttaggtggtaaaatgtcaacctggaagtcaaaatatagttattgtgtctaagaccattactattcatactttgaaaggaaatgctgatgatttagtttcaacaatataatgcctgcagcatcattcacataattttgttcaaaaacaattttcaggaagaccttgcgaagatgggagtaatgatccgccactatgacaagaaggaactaaagggatatattcgtatttcagtgggcaagccagagcataccgatgcactaatgaaaggcctgaaagcacttcaactgtgatcatcccatctgtttgacggaagcactgaagcacttgcccgtggtagtgcactagatgcagtctctcaatggaggttgcatcaatctaacacaaataaggtgcatcctctagggtcgattatgtctcaataatacactcttctgttttgaccagtggcgttttgtccagcatttttgtgttggtcgacttgggtttcttctcaaggtgattgttcgaagcaagaatttgtactgccgtgccctgattggaataaatatgagcgtaaaagtatggcaagtctactggctagattgtttatgcaccttctttttaaaaaataaaaataaaaatcttcagacattgcaaatcccatgtgacatcacaaatatggagagtcatgttcaattataatttttcagtgaggaattgaagcacatactccctccttccgaaaatgtttgacgctgttgactttactaaaaatgtttgaccgttcgtcttattcaaaaaaaaaaataagtaattattaattctttttctatcatttgatttattgttaaatatacttttatgtatatatatatttttacacatttcacacaaatttacatttcacaaaagtttttgaataagacgaacaatcaagcatgtttaaaaaagtcaacagtgtcaaacatttaggggaggagggagtattaagctattgccattatggttcgcaacccggtaggcctgaaaagggagcatcaccgcatctgattatccttttcgtgtcctagcgaatagcgaggctaaacgccatcaaaaggcacaagttctttccatgtgagcagaagaaaaaagttcgatgcggcacaacatttgcccatacaacaccacaagcaaagcaaagaacctcccggagggcttcatctaaagcttcttccatcgccttcgtgcaggcgcaccaggagttccgcagttaacaattaatatcgaatcccttatataacaattaatatgtttaatttgaaaaaaataagggcaatatcataaagttagaaaaataggagtaaaatctctgctaaagttgaaaacatggataaaacataaccaccacaaatatttcatagctatattgcatttttgaaacacaaaaactaaatgcaattacaatacaaatattcttaaatatgagggtccacatgactaaaaccattgtcgaggacatatctctttaatacgggtgagggtcctgtaccataatatcacaactggtatatgggtcccaccctcctattgtccacacgtcagtgtctataatggtagtgccattatagtagaggatgtgaatccccttactacataacggtttcaatgggtcaaaacaaccataatgacgaaactgttcacacattgtgattccttgtgcattagctccgcacactaggttactttgatgagagctatgttcgcacaatgtgatttcaaatgtccttttgtgttggtgcctgttttatcttatgcctaatcctatttcgcccttttgtatgagattgagaggtttgctgctttcatctagttgttttcacctattggtgtcatattgtgtttcctttgtaaaaatgggtaacccccatatcatgactcttccgtatgtggctttcaaaaaaaaaagccgggccgtgaggccttctctctaaaaatacaatgtgatttcaagctacattctaagccaaagcttttatacctttaatatgatacgtatatatacctttaataatctcggatacaaaataaatgtacaaggccacacatcatgtattgtaaatacgataagtagaataccacagctatcaaaatttataggttgcaggttagtacaaatgacgcattccccgacattccatacttgctcgtcatgcagcttcgtcgaaaagcctccatggaaatctcctccaaatcttcgcaaaagctttgccactgtgcctccatggaactgcaaacctgcgatagtagtacaacaaatgcataatttatccacttcaagccctgggaaaatcccatattacaaaagggtccctcccttcttttcgatgcccataccgcggcttcccctcctcctcaagatcgccgccgcgaccgccgccggcgcgttggcgctcattgtcgcggcggggctccggcgggatgacgccgtcgcctccctccggcgggagatacgcgacgccgtcgccgccctcgtggcgagcaacgaggacggcgtcgtcgagggggagggcgaaggcgaggacgccgccgaggccccggcgccgtccgtgctgatcacggggttccgcgcccacgggaagagctcgctggtgaacacggcgtgccgcgcgctcgcggccgaggaaggcccgctgctgctgcgcgcggaggcgtcgccgccgggcggcgggtccgacggcacgcggaagcggcggagggtgaaggcggcggtggccggggatagcggtgacgcggggacggacgaagccgtggtggagcttctggacgcgcctccgctccccgaggcgacgagggccacgagagctgacatcgatgcggcgatcagcggggggaacccggagtgcgtggtgctggcgctgcgctgcgacgcgcccgcgaaggagcggaacgccgccgtgaagcgcctgccggagatctccgccgccgtgagggcgaaaggttagtctgctcagcttcaagaaggttctagaactcggcaacttagcaacagtagcattgaagcattattctcaatatctcatttactatgttagtagtattccttttgcgcgtttgcgaaaaaaaaaaactatgttagtagtataatttttcgtagatatctcggatgcttagacaatgctatattgctatgtccttagaagaaagaagatgatgcgatttcgcatcgtccaatgtaggatagttgtgaattgtgattgcttaaagaaatagatgcaattttctaccatgtaggtaaaaggcaagggatggtaatttctgcaggtttggtttgtggacacttgatggttaactagattgtcagttttgaatagttttctgatagagatttgctatcatttggactggtcccctggtgtcatgttgtcatctttatgttcaggtgtgaccgtcagcagttaccaaatattgactgtttgatggagctttttgtgttattaatacacgagcacagatgctgtgctgatatatgctaatatgcatatttttcgaaaccatgaagtagtgcagtatattttgtctataatgtcctgaaagataaccctttctgatccaaacttgtgtagttgtgttagaatcagggtattgcaaatgttcatggagattcctttgtttctctctttcttccacatctatgaagaccttgctattaccatattttactcagcatatgttagcaaagatgaatatatttgttgacgagcacttgttaacaggtctgaatttgattgttgtattgactttcaagaaggccatgagatcagcaagacaagctgaagagctcatacgagaggtttcattcagggcgagaacagattgtgtctacttcatcgagaactacacctggaacaataatggtcccaaccttcgccatcctcctgtcatcaagaacgactttgagacacatttcacggttctgacaatcattcgacagtgccttgagttcatcaaattaaataggagtcaatccaagcgggaggaaaatggtgagaagggtaattcaggagatgttaaaggtatactggaaaaagtcttaacagcaaatgctaaatcttcaggagaacttagcgttaaacctgcactggaaaaagtcttaacggcaaatgctaaatcttcaggagaactgagcgttaaacctgcagatgtcaaacctgttctgactgttcaatgattattactgaaatgtcagagcaattcgtgcgcacactcaatcatcacacatttgcacaggtatgacttactgcagtactttgtatgcgttgtatgaggtagtttgctacactgcacaaagtgtatgttcattcattcatccgttctgtatgatgttatataggtctttttatttgggtgtgtggcacataactgatttgttggtattgccatcatctagagacataattaaagaaagtgcctagaaaaaagcaaagtggaaagcctcttgctatatatcatcgctgtttaacatcactccatacaactctaactcaccaatattatatgatagcattacataggataactttatacattatagtcaattccactataatcaagtcccaagatatacttataaatatatagagatttggacgaaacatgaataaaccatcaatgttggctcttccttattctcttcaaccgatcagttcagccttcagaaatccaggcaccaacagtagtaatctgaacccgagagtgccaggagttcttctgggctcatcctctctagctccctctgcctccaggctgggtagttgttctgcgtctcacctgaaccggaggcgtagtctctcgggtgggcttgcgatctcatcctaatgtacagcctcatcgctgccacgcaatcttcatagggatcctgaatgccagtgtggatatcatacctgcaatagggattcaaggatagtatcttcaacattaataatgcaaagtctaagagtctatagagattgtacagctgacttagcaagtttgcatacccaagatatgcctgtgtaaggtactttagggagttgctcagcttgctagttttcatcagtggtgggtactttgcagtatccctgaaaaaaatgcagagataaattgtgtcagcaagggagaaactggcaaggtctaatttgcagcaaattaatttgccttgtgctgctgacctgatcatgaatgccgggtactccagtcccaggcgctcaagttcatgctccaggccatggccaacgaggatccttgccctcccagagctccttggccgtatcttccatagtggctcaccgttgcacaggatgtcctggatcctcctctgcacaagcttcagtggcattgcgtccctcaagtactccggccttatcccagtcatttcatacctgaacagaaacatcataaatcatcccctcattcatcatctcataaaactatccatcgatctatgcctttaatttctactgctagtttctatagcagtatgtttattgctcggttttccattatgtcttttctgcttttctggtccgatagatctacacatgcgaacaatgacagctaaaaattgtactactagctaacactcagaaacatcatcagtaataaaataatggatcatctcctatatattttacctgtagtttgtgacggtcgtggtgggtttcacataggtctggaagatgacgttctcgtcctctccgatcaggcacaccctcgcgcagatgtcgagcgagccatcgcttcctcctccgaccatcttacacgccatggccaccgcacggcctccgtagctacccctgggcatctgcatgcaaacgcaagaaaaccacgggcaaattcagcaacaagccttgcaaactagcatgcgcagtgtaactgaggtgagaggggattacataccggggcggcgcgggtgaactggcaggtggaggcgcggtggtatctgacggcggcggcgctgtcgaagaggttgaggcagatgctgcagccgcgggccgcgaacacgcgcgcgcactccaccttgggcaacggccctgcatgcgcacggcgtacgcgagaaaccgtcagataccacgcgaaaactccacaaaaactagctcgttgcatcaaccgagcaaattaaaaacggctacttgtgtactcaccgatgaggtgctcgcggagggactcgagggagcggcagtgcttggcgcagacgccgcagcggggctcgtgggcggagtggaacgacaccttcatgtgctccaccaggtgctccatccggttgtactgcctgtagcacgccgcgcatttgttcctgcgagatcatcattttcattcatcgattgagttcgatcgcgtctttagaatatcgcgagcgaggcactatgcacgcatttatgaaattctgattctttgcaccggcaataggggataagaaagttgaaaaggtactcattcattcgtgcgcagaatatgtagtatcatatatacatgcatattcaaggtattgaatggaactagctaggacaagaaaaaaaagggtcctatatatctagctcgatgtttagagcacgagaagaacgtactaccatgcatgattaaagcttgattaattagctagttcatcacacaccagtcttgcatgctcagctcatcttgcaatactactgtagtaatggcattcagtttgtgaccatcttacctcagggtctccgaggactccctcctgctgtccatcatatatagcactactacaactcctgctgatcgagaattaaggtttctgtctctagttgctcttactgatcggtcgaccaaggtttctgatcgatcagttgtctccctgaaacctcgaggggcgctagttagctaggttggtgaggacggtaggcaacatggagaggctatttatagaggcaacaaacgttgaaaggatggaagaaccttcacgaggaagaaggaatgacccctgggaatcaccgtcttgtcgtcactgctgcatgcattctgaggaataagcctgcagtttatcgtaatctagctagtttagtatgggatatatgcttcctagtatctaaggttcctttcttgatctgtctttaccttttcttagggacacacagacacctaggctccttaagtagttgtcactcctaaaacacttttaacacgttgtttggagactttagttaatgacatgtgttaaacagtgcagcatcaaaacccagccttcaaaccttcacgttggaaatgctacatttgggacaacatgctagctagctagtgcaagtgtgtgtaactcatcaaggtaaagcacatatatttacattctgttgatcgaaaatcgggggcaaaggtagaaaagatctgaaaaattaaccgcgcagaattttatctccccatcggtcgaaagcgggaaattctggctgtcgctacaacgtactcgttcacattctttcagcaacgatatgtaaattcagacgccgattttttcttttccccggcctctagtcatcaagtgtcgactcgatcggtcaagcgactcatgaaaaatatataatctaggttcgctgttctgaatcttgtaaagaccaagttgcgcgacggcgagatcagttttcgatcgatccgccaaggtgatcacatcaggctgcagtgtatacgtcgagtccgcttgcaagcaacgctggtcacctcatctgtcgatcggctatacgtcgatgagaagaggagggagctggcccgtacgtgtgcaactgtgcatggaggaggagaggaaagcacagtggcattgaccgtgtgcatcaggtgcagctgagaggagtggcctttaatttgccctaactaatggagtagcagcaaccagcagctagctagattgttctgtgctgtgctgctgtggtttgatcgatggatggatctgtataggttgggttggtcatggggagggaaaaggtagatattcccggtcaaaaagatggccgtggaaaggggccggggtggggggaatgagatgagcgggcgacggcgacggatctccgggaaagagagataggcgacgaggagcgagggctccatctctcgtttctctccgtcgcggattggtggcgcgcggggcgaggtgggccgaggagctaagccccggcccgcccggaattccaccgatcgagagagagagagagagagaagccgcgctagtcaaaggaagctcccgtgacggagacggggccggattccctgtcccccgcacgggccgtcgcgcgcctgtgcatggtcggtcggtcgatcgctcgcccgcgcgacgtcgaccgcgacccgcgcgctgcggtatcggaaaaatctcctgctgcatgcttttcactgcaatcataggagggaggaaggtagatagcccagcccggccagcgcctattcttgcagctgattgatcaccatgcagcacagttcttctcttcttacgtatatactacagccgtcctaaaatattactacctataatagcgccgtgtttagatacaaagtttttcttcaaactttcaactttttcatcacatcaaaacttttctacacacacaaatttctaacttttccgtcacatagttccaatttcaactaaacttccaatttcggcgtgaactaaacactccctaggtaataaattaaataacaaattaatctggactcactttgtccaaattctcgtattagaatttattacatgagaacattttcggagggggaaagtatctctcatgtcgttgatgcttctcttccggctagctccacaaggtggtgggttagacgacctgggttcgaagcctctccccttctaatgatttgatattagttccttccctaatattcacgtcttttgttgatgcttctcttgtttgtcccacggatgcttaatttaccgagttatttgcagctccatttcgataagtttggacttaattaacttgtgatatattctatcatggcaaaaggaacacattttagattctccatgtcctaaatcctctaccccgccatccacaatctggcatgtggctcgcatctgtgcatcagacggctatacttacaatgacatataaattttatgagtttttttattaaaaaatatacatctaaaacagttttaaaagaagacaccacgttcattgtaaaggttagaaatttcaacattaaccagagaaaaaaagtttacgtaagaatacaattttgaaataactgaaaattaaaataaaaaaagaaatatcgaaataatattcaatatgtataacacaatacaagattagttgcaatttaatataaaaaatataacttagacattacaaaaatataaataatagtccaagtaggaatacaacttagaaataactaaaatccagaataaaaaagaatattaaaagaagagaccatatggaacacatcacaagattaattaaaattcgaaacaacaaataaaataaattctaaaattagaaaaatagatattttaaataggaatacaatttagaaataaacaaaatttgaaataaaaaaagaaatattgaaaaacaatccatgtagaacccaacacaagattaactaaagtttaaaacaaatacaaatataaaattagaaaatagaaaaataaaaataagagttcaagtagcaaaacaatttaaaaataacaaaaaaataaaaataaaacaagaaatattgaaacatagtctattttagaacacaacgatggcaaataacgacaaagagatgaataacatacaagatgtaaagtggtagaatggtggcggttgatgggaaatctaaaaactataaaacaacacctcaatgatgattgggtatgattttaagaatcacaatgatggttaagaggagggatagtggcaggccatgaagagtagtgtcatgtgtcatggtggttgacaggacctctagaaagttgaaaaagggacccaacgataattacattcaatttttaaaattccaacaataaacaagatgagagcgggcatggttataaaggagtatagttatgaaatttgtcgggtactctaagaacttaaaaatgagaacctgatgagactgatttttaaaggtcccaaataaaatgaatagaagttatgtcagattgagcaagaaaataaagctggcaaaagagtaagggggtgaccgatggtgtgacttttaaaaactataaaattgaatacccgatgatgataatattcgtttttaaaaatcttaagacaacaagatgactatttagcaaattttaaagaaaatcatatgtaaaattttatataattttgaatgggtgcgccatgcaattgcgtggaccacccaactagttttttagttacaatgttatatttgtcaggaacatatcttgtatgcacaaacttcatgtgcacaccccatgcataccatgtcacaaaaaaaatctagaaaaaaaatcgtgcatatactttcaatagtgttacacctatgtgtaaaatcttaatatcaaattcattatattttagcggtataaaaaaatctgaaagtattttttgttgctatttatgtagaatgaattcgaaggcgggactttacacgtaaatgtaatattactgaagtacatgtataatttttaatacattttttagtgataattgttagttggtatgcacgatgtatacacgtgaaagtttgtgtgcataagatacaccatatatgtcactatataaattttatccgcaagctctagcattcactaaaggagatgtacattaatcccatgtggatgaggtataataactgcgtaaatattccttccgttttagatcacttttcact

SEQ ID NO: 24060 - DNA, 396 bp, Oryza sativa
tccccccaatcctgaccccttagcccaagagaccggagcacttgttaattcaggtggccgtttatcattgttgcagaagtgttcaaggattttcaagttttctcctaagaagaaggctgagcaatcatctgaacagcaagcagtgaagaacacagactttggtgcaagactagaggaagcatcgcagagcgatgatgattatgagccaactcctgtctatcaggtagcctataactcatttgatgctgaggatcttccatctgagagtggggcatttgagaatgaagaatctgaaaggcaagatatagcagatgacgtccagatggagtcttctcttggagttgcagataattgtgtagatattcatggaactcaatcatttgatggcaacacgga

SEQ ID NO: 24061 - DNA, 472 bp, Oryza sativa
tgcaaaaataaccatcccttgccttttacctacatggtaaaaaattgcatctatttctttaagcaatcacaattcacaactatcctacattggacgatgcgaaatcgcatcatcttctttcttctaaggacatagcaatatagcattgtctaagcatccgagatatctacgaaaaattatactactaacatagtttttttttttcgcaaacgcgcaaaaggaatactactaacatagtaaatgagatattgagaataatgcttcaatgctactgttgctaagttgccgagttctagaaccttcttgaagctgagcagactaacctttcgccctcacggcggcggagatctccggcaggcgcttcacggcggcgttccgctccttcgcgggcgcgtcgcagcgcagcgccagcaccacgcactccgggttccccccgctgatcgccgcatcgatgtcagctctcgtggccctc

SEQ ID NO: 24062 - DNA, 261 bp, Oryza sativa
acccaactcatcaaaaccctaacggcttgtttcaatgtgcaggcaggttctcgcggcagaggaaaaaaatacactgggaattcaagcgcccgtacgaccctcaccacagcaaccaccgcttcctcgggcgtttggtcgatgaaactaagatccctaaacgtattagtgcgcccagcgacccaaaccccccaaaacagcgcggaacgtaaccgatcctgcgagagagagagagagagagagagagagagagggagaggagga

SEQ ID NO: 24063 - DNA, 581 bp, Oryza sativa
ctcacgacgctcgcgtttaggagtggcccgtcaccgcgccgctggtcgcctgggcgttgtagtcgcagtcgtcggctcgtcgcgagtcgcgacacacggcggcgttgttttcgctcgcgcgcgcgcggcgcgtgagctgcgcagaccagctcaccagcgtcccccgcggacgaagccttgcagaggcggcggctggttgcggaggggaccaaagcgtgacggacgcgggcgtgtttgatgttgttacgcgagcctatattggcgtaatgcgtggggtacgtatacgatccaaaatccaatcatcacgtgcgtgtgcgtggagctgaggtcgttgtccggtgtcgcttgtcgaccgagacacggcgcaccgcgcaccgactggatggattctgtgtgcacggcggtcggcagcgatacatatgtcgccggcacgctctgggagctagctaacacggaacctaacggatcggtgactggatttggggaatgggcttctataactccaagtgcatgcgtactcgtttgcttctcggaggagtatcaatcaaaaggtttgtacaaaataaaaaccgtgataccat

SEQ ID NO: 24064 - DNA, 555 bp, Oryza sativa
gatcccctttacatcaagagttagaatctacatcagaattatagccgatagctcaaaaccctatcgctatcggttggtatctgcatcggctggaattactctaacggcttgttagccgatcagctcattgatctactatttgtatatcttgtcagttgcaggatcaaactgactggcacgcccgcatctcaccaacctttggacttgcactggagctaagcagatctcccatgctagtgtgtgtttttcgcatcaacactcctcaacaagtctttccagggaatataatgcttgattttgggcccttttttaagaacttaatatatgccttctcctgttgttgcaaggggatgtgtatcacactttttaatgtaaaatttttaggggcaataatttttttctatttgtgaatataaaactctatgggcttcgaatcttctggagtaatgaaaagttattgctccatgtcataaaaaaatggaccgcccggtaatatcatcagccaaacgagctgtcagatacctcaaatagtgaaacatcacaaaggtctttcaa

SEQ ID NO: 24065 - DNA, 1569 bp, Oryza sativa
aagaaaaaaagaaatggaaaaattttaaattggacccatttgtcagccaaaatgatgccaagtcattcaatgtgggatgccatgtcattccatatggcatgccatattaacgccacgtagaatctataatgggttgtgcgatttgggacctaaatgacacactatgacgagttctagaacttggatttgcattttgagagtttagggacctaaatgagacacccctacaagtttaaggaccgcccgtacactttactcgaaaattttctttaaaaatttatgcaagtctatttaaattttaaaataattaatacacaattaatcatactttaataaatcacttgtccggctttaaaatcaggattttttttttacgaaggcagtgtagctactgctgcagcaagctcttccaaactctcttgtctgtctacccggtttgtctgtccggtctgcccggtttgtctgcgttcgggtcgaagagttgaaaacttttctcatatagaaatcggactagctcattagcacataaataattaaatattaattaaaaaaatttaaaaatagattaatgtaatttttaagcaacttttacatagaacttttaaaataaagctagttgataaacagaaaaattagaagttgagaaatatgagaaaagaaagcaccctaagattctttatgggtgatggatacaactaagtttatgaaaattatttaagggcacagacgaataaataaaatattgaacatttaaaaagttgatttaaatctttttttctaaaaaatactaatgaagaaagtttcgtaagaataagtgtcgcttttggaagtttaggaagcaaacttgcagtaatccataatctttaaaccgaaaagaataatataggagtataactggaaagaaaaacgattctcatcgatagagtttaatttgagagatttgttccggtccaataaaaagtatgtcaaggtatcaatatctcatggtaccaaatcgtttccgatcgttgaatctaacaatacctctgtccagctagatccaacgatcggaaacaatttagtactatgaggtgccggtacctcgagatactttttactggaccggattagagcaaatttcttaatttgaactcggaagttgctggaaaaggctggtctagctagctgttcgacgaatcgccgtgggttctactcatgtattttctccgtttcatattaaaagatactttaacttctttaaaaactttttataagtttgattaaatttataaaaaaatatcaacgtttataacatcaaattagttcattaaatctagcattaaaaatgttttgataatatatttgtttggtatttaaaaaatattactatggttttctataaatattaaactcaaaatttttattttaaaaaataaaatgtcttgtaataaaaaatgcatggaactgcgatcaagctagtcgtcaagtcaatgtcaatatctagaaccttttgttggcctgcatgcatgtgtcctcaccgaacacgctcctaactcatcatctcatcagggtaccgagctcgaattcgcc

SEQ ID NO: 24066 - DNA, 493 bp, Oryza sativa
gctttgctcgatgtcctgagattgattgctattatctagtgtgtcaaaagaatcctcaagacctagggttaagcatataaaatttaaattcaaaaggaattcaaataaaatccaaaaataagaaaaatagagaaaataaaataaaatggaaaaatagtaaaagagggttcaaaaggtagagaatgattttagaagaatattggtccaagtttcgctggaattggatctatattttaaaagatatgggcttctaaagtttgaaaatcaaataaatgtgaaatggcactatgtgcgggtcccacctgtcagtctctctctcttctcttcttctacctccggctgatcccaaaagcggccggcggcgctagggttggcgattacagtggcgatggaggagaaaagtggttgcggccgaggaggggagggagctagggttctccggcgactgcgcgcgagcggcggcggaggggttaatttgatatgtggatagcct

SEQ ID NO: 24067 - DNA, 549 bp, Oryza sativa
  unsure (1)..(549): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgacgacgccatgtgcctgatggagctcgacgagctgatcgccgcggcggcgccgccgtccctgctgtgggacgacgactaccgcctcccgctgccgccgccgccgctatcgccgccggcgatgtacgaggagctagacgcctttcagtgctacgaccagcagaggagcgcgtttgagcaggaggcagcagcttcagcgtggaacaagcttgagctcttctaatcaatcaaaattaaactctgtaaattatgtttacagtgtttattataatcaataattaccgaactaaaacagaacagtgttgtttcattgttctagggggatcctctagagtcgacctgcaggc

SEQ ID NO: 24068 - DNA, 519 bp, Oryza sativa
gaatttccccccctaaacctaaaaactagacattactcaccctaaactttcaataccggacgaattacccccctcgatcaaatctagagcagttttgtcctacgtggcgtacgcgtggcaacccaatcagcattttcccttttcttaacatggtggggcccacttgtcaatctctcccatctcctttttcctcttcccctcttcctctctctcgtgacttcaggcacggccgcgcgggcggtcggcatgcgagggggcggtgggcggcagcgcatcgtcaggcgctgccgcgcgggcggtgggcggtggcgcgggtattcaattacggatagtatgggcaatctagtagttagccaaactagtgaggaaacaacaacatattatcaagaaaacattcacatcacgaagacgaggaaatcggaagaacacctagagtctcctgaacgcgtcggacatggcgtcaggccggccacacacggcacatccaatcaaagtggggatcctctagagtcgacctgc

SEQ ID NO: 24069 - DNA, 947 bp, Oryza sativa
  unsure (1)..(947): unsure at all n locations
atatgtatgtgtgtatatgtatctccctttgtatgtataaatatgtagatataaacagtgagagtgtgtccgggtgagtgtgttcatcaagggacatgcatgatcttagaattataatatttatgttttttctagagtgtttattcgagatatccttttttcgctttgcatatgtatcccagtgtaatatatccatatatatatatatatatatatatatatatatatatatatatatatatatatatatttcattggagaatagttaatatgatccctaaagtttcgctcctagattagtttagtccttaatcttttatattgtccaaacaagtcctttaaatttgtcatgtgggctaatatagtccttggtcccaccaaaatcgccacatggacctgccatgtcaccttcttatgcaaaatctatatgatttgtccaatttacccttacgcacaggaaagtaaaaaacaaaaggaaaaagttaaaaaatatatggtatttgtaagagcaaaaatatacctcaaaagggtgaaaaaaagaagtatttttttcctatggttatatctaattcacccttatatttatttttctatgatatacgtaagggtaaattggacaattcattattgattttgcatgaatgatgacatggcatatccatatgatgattttggtggacccaacgaatattctaggccttatgaaaaaggttaaggatttctttggaccatttaaaaggttagggtctaaactgatttacagagaaactttagggactaaagtagctattctccctatattcatcactgcttcttcccctatgggtatatatatccgtagtcgatcgaagaagcaatgataaatatataggaagagaaatatagtatgcaactgaatgattgtattgggtnnnnnnnnnnnnnnnnnnnnnnnnnnnnnnnnnnnn

SEQ ID NO: 24070 - DNA, 2798 bp, Oryza sativa
  unsure (1)..(2798): unsure at all n locations
tttgcacccttgactaattgtcatatactcagatttattcatgatccatcatccatcggcactttagaaataggctggcagagcataaatgaaaggagaagaaaacaaataaataatgtatctacggagcataaataaaaggagaaaagaagaaacaaatactagctggacaggtatggggagagtgatgatgtttcatactgatctatctatatatgcactgattgagtatggatttgatgttctaggcctagccatatgataataacttgacagctctatgtatatcaattgtgtgttcttgtctcatttgattctgtataaattaaggaatataatgaacagtgcagctagctagaaaacaatttgtaaatatcataatcaaatgatgttaattatatacagtgactgacgacccttcatgtgccgtggcacccacatttttgtcatagcaggaattaattaagatgttcaattagtcaaggataagagaaaagtaatatagcttgtgcaaattaaccagcgtgtgagagctagctgcagcaatactgaaatctctagcctttgtttggttcagtctggtttaattagcttgttttattgtgaagtttgtcagtaccggggagcaggaggtggtggtgttaactgttaagccttctgttagtcttagttaattcattttttttgaatgattgaccctgtccaacaaacatgaccatatatgctagctattgttccaaaaaaaaaaaacatgactagatgcatggcacactagctggaaaagatgcttgatctagaattaaaaaccaaatgcatggatctacattaatttagcatcatactgtgttcatgttgatgcccatcttttgcttgttatcctatatatttccgtaatgtctttttttaaaggattccgtaatgtctttatcaaataaacattataaggcatgtatgtatgatgggcgtatatatacttttttgcgagatgtctctttcatagagtggcattggatattttggcctaaaaggatttgtatataacaagaatgcactattacagaattgagtttcatgtacgagatctcctccaacttctaggtggactgtaatagcgtctgcatgtgataatcggttcctgggatgggttaagggctgcttgcaaaaatgtattttcgcaagtaggtccttagcaggcccggctgcgacaatggcaagcggacctcttaaagagacgcaggcatacaacaaagtggcgaatgcatcctcggtcccacccctaccctagcgcaccacccatccttatactctcctcactcactccgcaccattttctcttctctccaaccagcaggcctcatctctctctctctctccaccgtctcatcgcccagagttgagtgcgcggaagcggagcgcctccgcctccgtaccgttccagccatgtacccgcgcccaggcctcccagaggtgcggctccacctagcgtagtgcacggggagcccgtgtgaggcgagcaacatggagaggtggggaggcttgatccggctgtgggaaagccgcaggatcaagcagtggggaggctgaatctagtgacggggaagtcggatcgagtggtgggaaggtcgtaaatcgtggctaggaggctagaccaacccccataaggcagcgtgcggcggaaaggcttcccctgtcccccttcttcacgccggtggacatgggaggatcggctccagcttgggcaacctcgagagagttggatctggcacctcctctcctctgcctcttcattgtcgccgcgcgcttgggtctgcaccgccggcctcctctcctctgcctcttcgtcgtcaccgcgcgcactggatctacgccgtcggcctcctctcctctgcctcttcgtctccttcgtgcggcctcctcttctccatgcgaagagcttggcggagtggcgtatcctgcatggggaacctcggcggcagtggatccggcgctgggaccacaatgacaggatggatctggcggcgtggatgacctcagcgatggcggatctggcatgggagctacgacaatgtcggtggcagctgtgatgataacgttctcttggggagctagggtttccaccatccccgactctggtatataggggcagatccgtcgccccctgctccgggaggggcgttgattgctgcagcgaactcactgcggccataacgactaggttttggttttggggatttttattttttttgtgatttttcttttttgggtgggtagcattactgaccggccgcaaaaaattgagttttgcatgcgggtgtgccacccgcaagcaaaaatatcaatttttgcaagcatctccgagtagacgtgcaacccaaccgtatgggaaaatgagttttgacaacatggaaagaatttctatagtagggatcagataataaattagcaaatagacgaacaatagaatgagtgttttcaataaaaccttgttccgtttggattgataattaggaacatttaaggagatgtggaagaaaacagtaagcaaagattatttcaaggtggttctccagccagccattacctccttttacaaggaaattcaaaccaaattaaagatctctaggtattcaaacaacctaatatatatattacacacatgtttatccaaacaaattcactgcgattcctcgaacatatatgcaatgttgtatttgaaccacattttctccctatannnnnnnnnnnnnnnnnnnnnnnnnnnnnnnnnnnnnnnnnnnnnnnnnnnnnnnnnnnnnnnn

SEQ ID NO: 24071 - DNA, 3536 bp, Oryza sativa
  unsure (1)..(3536): unsure at all n locations
caaggaatttcaaccaaattaaagatctttaggtattcaaacaacctaatatatatattacacacatgtttatccaaacaaattcactgcgattcttcgaacatatatgcaatgttgtatttgaaccacattttctccctatatagaagatatatacgaacacacatattacacctttaattaaaatgtatttttttagaaacaactaaaaataaacttattatatacacttaaatatttatttttatttatcacgaatcttgaggcaatatgacaggcatccggaccatacccccaaggtggtgtccggcgcactacaagatagtttcttttttctttttagaacttacaagagagtgttgatctgcagtctgcatgcacaggtagtgggagattgacgaagaaaaagtgtcatcttccttgtacaatggggccttcatttaatcactcgataattagtggagcattaactaattaaagaacagtgtggtggattgagatgaagtagctcttaattaatttgcagacaggtagcaagctaattaatttccacgatcgatcttatcgtggctccattaaattttgatcggaaagaggagctttttccaagctaagtgcctcaaagagaccgatgcatatggcaatcagttgccagtacatcatgatacatataatcatttgtttttgcaagcaataatatatcaatctatccaaattgtgttctgtccatcttgtacgatcaagtcatatatatgtattgtgcttaattactccctaataataatggacttatatgtactataggaaaatggcatttgtttctagatcaacatatatatagatattaaattatgacggacgtttttttattcaaaaatatgacatgcactatttatcatgtgatttcatataggagtgccaatcaattaacagcgttctttggttggacgattgatgtcatggccgtacgtaacggttagaagaattttagtcagaagtttatattgcaaaaaatatacacacactccataaagtgagaaggtcgatatcgggaagataagaccagggaaaccgaattaataagagaaaaaaatgtttctcgccttaaggttgatgccaaaaaaaaaagtcgctagcttatctgaaagcacgactgattcataataaagaagggtctaggtacatcctaatcctagtaaatcactaatcaacaactacaaaactagacataaccaacaataacatcctataatatgttttaccttttgatgaacaatttttttaacaatttttttaattttttttaacaataacatcatacaatcacttttgtcagttttttcaataaaatgacaaaactaccctcgtgtgttcttccattgcttctgttcagctatcatcaacatacacacacttacgcatgatggttccaccttgcagttgatttatcatttttgctaatccatccagaggatgtccccttgttcttaccgtcattaaaatagttatgaatttttaaaaaataaataacaagatagattaatattttatatatcggtacaaaaatttaaattcaaatttgatcttcacaaattgtaataaaaataacaaatttaattgaaattagtatacatctgctcatagacaaatgtgattttttttagaaaagaaaacttgtaaaagtgaaatttaaacttgcatatttgtggaatgatgcatcacacattattctatcttattaaaatttttattttttataattatttgcataacatggaaagaaataagtggacatcctttcaaggtattaatatgcaatgatatatcacacgttattctatcttattaaaatttttattttttataattatttggataacatggaaagaaataagtggacatcctctcaaggtattaaaatagtaatattatacttttgcatccctattacacaagatgatgatgtggatggcatataggggaagaaaaacatcaagcagtggcatataaaggattagcaacttttcgatggaatataaggaaactcgtgaattttgagtggcaaataagaaattctctattaattaggaacatataaaaagaagactcggttctcgctaaggaaaaaaaatgttatttcaggccaaacagtgcatacatcctgtaaacggagttgcagctagcatctgcacctataagcaaagccaaacaaatcgaagttgtctcaccaaagtgcatgcatgcatgtgatagctaatctaaccaagacacttttgcaaaagactaattagtaaagctactccagcatcatatacacacaagaaaaagaagatgcaaattgaaccaaacaaacaaataaataaatgtgaactcgttggttttctccacaaccctcaaagcaaaattaaaagctaggcagatcgtgacacagacccatatatattcttcccatgctaatctgtaccgtcttctctctctgctcttccttgtctgatcttcaaatggccaacaatgggcagacagacaagtgactagattgattgacaaacattagtacaataattaagggtgtggtatagtgctttacctgatcaccctttaatattgcatgtgtttttccatagatgcagcccaaagaggtcattgtcgattttgtcgccgtgatggctttcagaccaagcaagatttcgcaagttgtgatgtgaaagccggtaggccacaagtgatgatggtctagctcatctatgccggggagccacgctagtgatcagattctaatatctccggaaagttttatacgacataaggaggatcggaggtaactagttatagttctgcaggaaatattgccaatgcatttttggcaaaattgaagaaccaagaaccaaattaaatgtgtggtagtggagttacagtataggtaaattccagtgatcataaatattactcgcatttattaggtgtgtttcaatagaaatttggtaagcttaaatatttgttgtcgacttctctttgaccgtgttgtaaggaggtacacatggttgtgtgcatgtccatctactatgtaatcgtaaaaagaatggctcgcagtaaattgctcaggttttgctattatttgttttgcatattcgttcttaggcatgctttcatctttaatttatctacaccgcaaagtatgtaggaccggcttcataagatgtatggttgtggttaagatcaactagctagggcttgactggagagagagctagtgggtggtatagtggatttgtgccactggatggaagcatactcatacttgcctgtgtcctgtctagatgctctgaatgcacatgcaaagcaaagtgtaataccccgtatattaaaatattaaaagatatttaggttgttttagtttggattgatttgttaaaataaagatgttaaccgaaataaataaaaaaaatatctttagaagtgggccaacatgagaannnnnnnnnnnnnnnnnnnnnnnnnnnnnnnnnnnnnnnnnnnnnnnnnnnnnnnnnnnnnnn

SEQ ID NO: 24072 - DNA, 3655 bp, Oryza sativa
ttctctttgaccgtgttgtaaggaggtacacatggttgtgtgcatgtccatctactatgtaatcgtaaaaagaatggctcgcagtaaattgctcaggttttgctatatttgttttgcatattcgttcttaggcatgctttcatctttaatttatctacaccgcaaagtatgtaggaccggcttcataagatgtatggttgtggttaagatcaactagctagggcttgactggagagagagctagtgggtggtatagtggatttgtgccactggatggaagcatactcatacttgcctgtgtcctgtctagatgctctgaatgcacatgcaaagcaaagtgtaataccccgtatattaaaatattaaaagatatttaggttgttttagtttggattgatttgttaaaataaagatgttaaccgaaataaataaaaaaaatatctttagaagtgggccaacatgagaaggcccataaacccagcccattagttctcccctaaaacctagagagaggggaaccgaatcccacttcccctcatagtgccgccacccctctccctggccggcacctccttccttcccttctgctgtgttcgcatctctcccttctacagcaaattgctctctctatatctccgccttcatagcttggatcaagaagcaaagtagaaaaacgaaacgaggaggaggagagaagtaaaaggaggggttagatcggagtctcccctattgtctccttacaagttctctaaagaaaccctaggtgaggcttattcttttgttgtatcagttgttctagcatggctttagtgctttaattcgtggtcagggaaggctagagaaggagtttgggtagttgcggttcggtttgttgcagttctgcatgtgggcagatttacagtgcttcagttttttgatattttggggctctaaatgttattttctgcaaacgtgtataactaggaagttgtagataatgtttggatctatcttctaaccaaagggcgcgattttatctcaagtggtttaggagatataattttttttagtatgactgttgtttttatgtcataatctggatagtagtagattgaactgtttttggacgggttaaacagtacaatcagccaggtcacctatagacaaagttgtagaggtttttcttagctttccatattggtaaagtacaccctgattgggcgagtagaactctagttatagttgttttagtgcggaatctgaaattctggacagattctgaagcctgctttcaagcgcaaattagaccatttaaatggcagaataaaaatacgattttcacataagagttgtaggccttgttctgtagatttccaaaatgtatttattttcactcatagccttttcatatttcaagatataaaggtttgaagcagtagtcttgtgtatagtccaagcggtgttccttgttattgagttttgatgggatggggcagtaggttcacctttttcattgttttatatgcatgtttgaatgtgttttctgaggttttgtttataattaggtggtggtccatcagatcgtgcatgataccaatccttcgttggaggcaagtgcatgacgaactaattgtgtgattcatggattgtttactctatctatttatttctgatatatttctacgtgataagtaactgcttatgttcatattattgttcacgccatttagatttcaagttgatcttatgtgtacgatgttattcttgttttaatattctggattctggttctgcttaaataattcaagttccctgcttgtcatggatgtgcaatatggtttcaatttggttctttgattccggtttcaattattcaagtaccatgcgtagtcatgggagtgcaatttggttctttattcaagtttctgtgggtaagcgctgatcacgcttactcggctttgccggcaaatgctaggatatattcactattgtccgggatggaaactactattacaattcatgcctgcacgggatgggaactactatcttctttaacttggtgtttggaaatgtgtttcctatcaaagaaagaaagccttatgttcatgctttattgtcaatgatgtatatatgtattttctagttccatattgtacttgctgagtatttttatactcactcttgtattttatttggttttaggtacgtattgagaccgacatgcatgggcgggaagtagcacctttatatacacatttatctgcacactatcaaactatattgcctaggtccataatgatacttaaactatatcatgattcggtcttgtaataatcttttagatttctaatagtttcttccccatggattataaggatggatcgcactgtaggaatgatattattattagttcaatttataactgtttgtcgtgaatgtccatatttacaggggagactctgccgaaatttctaataattttgggagttagtggttttgagtgtattttagtgtggcactccaggtacgtggctacctggggcgttacacaaagtgatcttaagctcatcgtataagcatatatattcacgctataggaagaacccactcaacaatcttctgaaaaatggcccatatcagatttgttttttcaaccatatggaatcaaacccacataacttcaagagaggtaagtatgtactccacggtgactagacctatgagactgtttgctagaaatacatataactatttgaagtcgtaaggacatatacaatgggtacacggcttcatgctttactaaaggtaaaaggtcaaatgagcttggtgaactgacgcgaataaactagcaagttaagcctacaaacggtctaacgtagcgaaaataagtttttgatatgtttttcaaggataataatggtagcaggtattgaggtgtaagaggttagtggcaccaattttaaccttgatgctagctacagaaaataggaaactagtactgaggacttatccttgctagagtcgacactaagttgagcgctgctgatgaaacgatgggtttatgagagtttttttagctatattgaataagagggatgtttgaattaaaaggtagaattaatatgatatcaaagttatttataggaagaattaaattcttaatttcctttgtgctatcatagatcacgttgttttagtttttcttttattcgtagggaactcttcgttggattttccctttgccctcatcacctcatggggtataagaccgaacatctcatttcaatgtaattcaacaacatttggcatgaatgccataatcaacatatgatggctggaatttaacattagccgatccctatctacaaccttgacaactctcatggacataatcaacatatgatagttatgaactcactcatatctcctcaaggtttaattaagtctcacattctttcaacgcgtatgggagagaataagtctttatctctcaccctccacatttttttactatgtcgttaatgtagtgaaaagaaattcgaaaactgtatacttgactcaccactaaaaaaaccttgtatagaccaaccttataggtgccggttcaggccttttcccatatccaggtgatgaaaaagatataaaaccaacacctttaaggacaataggtgtcggt

SEQ ID NO: 24073 - DNA, 2364 bp, Oryza sativa
  unsure (1)..(2364): unsure at all n locations
tgaacaataacatacacgcacacgcacctgctatcactatcagcaatatatatttcagacaagttcacataccattctgtgataagtgataacctagctgagcatggatgaatcagctgggatggaagaacaatatataatgagcatgcttatcctcccaaggcagcaagaaagtataagaccatgttgagagcaagtttaatttcatagctaactgttgacttcaaatcatttataatcaatttaatagccaatttatacaatacttacctataaacatatattacacaattaatatttggtctcacctatcatacacacatgcatcttggagatcgtactgcagctgggtataaatctgtagcccgctgctcctctctctcatgttttatctcctcgaaatgtgtttatagctggcttatagtttgctactatacctactcttagcgagcttaaacttccaagaaagtaagaaattagtagtaaaaatttaaaaaggctattttttttcagcttctgtccttctgacttgtggtgtatgttttggattttacaaccaccgcttttcaaaatctaagtgaaaattctagattgcttagagaagctaagggttacgagagaaactatggctggcagaagcactttaaagtttaaacaaagcctaagtagcataaaaagagcagaagctaagctagtagctagcttaatctctcctgcaagacaggcacaagacactagttcaatcttcatcagaagaagaaaaaaaagaagcaaaaggcgggaggagcaaaagacatgcaggtacatgggtcaaaagcttcaggctgccagcactactacctcagaatactttgattgcacggattgatttgatctttacaatagacaatcataccatcacctgtacccagatccacaaggaacatgcctgaacaggaatgcagaagaaagaaagaaagcagcttgtgtgcaatgcaaatccaaagctgcttggatcgatcgatcgatcgcaccatgtatgtgaccatttcactctcatgcatatatgctactacagtagtactagcaaacaaagaactcgagagaaaatgaaatgtgatcctcctgctaaacccaattcatcccaatctctaaccaccacagtaatccttgtctgtgcaggtttcagacattcagtcacatgttggatcgatcagcagtgaaacaggtgtattgtagtaccactgatggtgaatgcagaacggcagaggtgcagaggtttttttcttgcctctttcagacgtagttgtcaggcaattgtcgagctgcagggcaaagataataagcaatcaatcggatctaatctcttcggaatggtgcagctgagctattgaattcagacaaactgaatcgcacagggggggtttaagattgttcaaactgaattgtgaagatagcactatcgaagagcccaatttccgaagcaagacagctaaaaagcagacgatgtgtactatataactgcagagcgacacaagtttggtgagcgctccaagcagaaactggcaaatgttgaacgaatatcaaacaataattaactgcaaacttggtattctgggaaattgcaatgatagagtattcacatagaaaaaggttccaagtcccaaaccagaccagaattcctgccatgtcctgatagcagactgtagacactatgttctagtatgatccagagttgaaatgccgagcacacgcatccttagataatagaaatgttttacatttcgggcctctgccttcaggtaccgggtcaggattgattgagcacacctacaaaagaagcatgattaatgagtaataccatatatgttcaacattccagtacttgtaatttggaatgtgtggtatgtagtatctctgaccattctaggtagagctgagtggactagaagttcaggaaaaaaatataaccttaaacaccaataaaaacatggagcaaaggtaaagatggttgtacataaactgctttggtgagctgcaagggtcgttctgatactctgatgtgtttcaaacatgaaacaaaagataatgtaatgaatcgtctgagattacagattccagggatcagaagggaaggcttcaccacactaagtagggcaaaaaccatactaagttgatactgttgtggtgtcacctaaccatatctgctctgattttagagctatgctgtgtggtctggtttaacagacaaaatacacaaggtgtgtttttgtgtaaaacagcaggcagcattcaaacaatgctagcggagcaggtgggcatgnnnnnnnnnnnnnnnnnnnnnnnnnnnnnnnnnnnnnnnnnnnnnnnnnnnnnnnnnnnnnn

SEQ ID NO: 24074 - DNA, 7677 bp, Oryza sativa
  unsure (1)..(7677): unsure at all n locations
nnnnnnnnnnnnnnnnnnnnnnnnnnnnnnnnnnnnnnnaaatgttttacatttcgggcctctgccttcaggtaccgggtcaggattgattgagcacacctacaaaagaagcatgattaatgagtaataccatatatgttcaacattccagtacttgtaatttggaatgtgtggtatgtagtatctctgaccattctaggtagagctgagtggactagaagttcaggaaaaaaatataaccttaaacaccaataaaaacatggagcaaaggtaaagatggttgtacataaactgctttggtgagctgcaagggtcgttctgatactctgatgtgtttcaaacatgaaacaaaagataatgtaatgaatcgtctgagattacagattccagggatcagaagggaaggcttcaccacactaagtagggcaaaaaccatactaagttgatactgttgtggtgtcacctaaccatatctgctctgattttagagctatgctgtgtggtctggtttaacagacaaaatacacaaggtgtgtttttgtgtaaaacagcaggcagcattcaaacaatgctagcggagcaggtgggcatggatgaggtttgtgctggaaaaagttgtgcagtgctcgttgcatttccaacacaaaacaaatactatatcataaaaatatttccgatgatagattcactttgagttttttgttgcaccacatgttactatgtttgtctataaggttaatcaaacttaaataaatttgagttacgaaaagcccaaaacgtcttataatatgaaaggtggggagtactactgaacgtgtatagaacctgtgtggcttcaattacggacttgcaatcgccagtattaacaacacagaatctcagttcaatgaaattgcatggccagtaaattaagagatgactggctgggatgggccggcgattctcagtagcgggctgacttctagttgggcctatatgggcttgtccgctcgtgagaatattgggccgactgagtgaccggccatacgcttgggctggaggaactgaagatttatagtgcagtaagttttttttttctttgagtaacaagtttatagggcagtattacttgcactgtgccaaaacttgcctttctttcggagattttctagaaaaaaaatattatgggtacagcataaaaactgcagagaaaacaccctttgtttcgaatatagtgattacctacgtttagaactgtacattgtcccgtgtaagatggaaactactccctccttctctaaatgtttgacgatgttgacttttttaaacatgtttgaccatttgccttattcaaaaaattttgtgaaatatgtaaaactatatgtatacataaaagtatatttaacaatgaatcaaatggtaggaaaagaattaatagttgcttaaaatatttgaataaaacgaacagtcaaacatgtttaaaaaaatcaacggcgtcaaacatttagagatggagggagcatatgtcagagactctcctctcttttccatctctctccaagctcgccgagcgtgaggtagagctcaacaaacacatcgtggacagcatggtggcggtcgacggcgagctcggtcaagcgcggtctcaccatgctcggaaacctctcatttataggtacggcccacgcctacgtcctctaacgtcgcaaatcctcacttgtgatatcatccaagggccattaatcaatcatctaagggatagagacaagatatatactggttgataccctgcattttgccgcggtacatgtggatgaatacatacatgtttaaataatgtgaaaataatatggagataatgatttgacattgattgcatattaagttctaaaaatacaacaaaattgtaaacgatatatcatatttgcatgatatttaaaatactctagataataattgctagtgggtaatgatgtggcacacttgcatatgatttaaaatactctagataataattgctagtggatgatgatgtggcacacttgcatgttgagatttagaagttagtagacatcaactttacagtaaaattgaatatgataagccaaaacggcctattaaggaatataaaataatttatagataaaacttgtatatatttgtttttaagtgacttaaaagctaatgcgtaaaaagaaactacgttgaaaatatcttaaaataaacttcaaaattaagtttaaaagttcaagttttgtcttttgctttagcttattaggcgaaccgatgggacctgaatcctctagtgacctaagtgcagggagcaaacactatattacagagtgaaaatatagagcacacacatctttagaagctgttctccatttcatagacatggatcctctgcaatactacgcctgcagtcccagtgactgacagatggatccagtcctacatgttattgttacagataatctctacagatttctattatctaaggatgtggacatatctattggtcttgaaattacctgagtgcagagtgcaaaccctgaaatgttcccaacatctctcttagaattgagtggaccgagaaagtgagaggttgagtaacatgaaaccttaaacagcaagaactacatgagaagtaccaacaaggcaaccacagtaatacaaaaaccgctttggtgagatgcaagcatgcaacctgcaagggtctgatgcatgtgtttcgaacattggaaaaagaaagagaaaaataaaatcattgcaaatgtaataaataagctgagatttttgcaaattcgtgagatgagacttccctaattttgtagttcattcgcgtgggccgttttattggaatgaatccagcccaaaaccaacaacatcctgttgggcaggcccggcccaccgatgtcatccctcagagacggactacattctggctgggcctatatggactttcgagaatgttgggctgtccgagtgagcttgggctgaaacagctcgagacaatgtagcatagctctctctctctctctctctctctctctctctctctctctgttcttctctctttttggcgaaaccatagatttttcattctgcttacagtgccaagacttgccttcatttcgtactcgaaggtaccgcgagatgttaaaagtatttttctttttgagaattacacgatgttaaaagtatttaaccatgtgataatttgaagtaggagtagtagattaactctcggcgtcaaaactgtaaagagaacgatctttgtttcggctgtacttgcggaatactccctcaatcccataaaaaaaacctaaaacagaaaatgatatattctaatattacatacaaataggatatgccagattttgtcatatatttgttttgtatggaacggagggattacctaggttgttttacagctatcaaaaccctaaattgtcaggcaaaagaaaatctggtcaaatgaaaggcatcattgatctgaaataatagaagaggattgcatattgtacagcgaaacggatcctcttacgctaaaacaagcatcattttacagctacaccggccatttgtttactaggagctacagctgtgccatactgtaaagtaaagacccccaagcctcttttgttgactagagtaaacaaacaaatgcactggacggctggaacatgcatgggttgttgttgatcgatcggcaacacacgtggcaaggtttagggaaactccatcctctattaataatcgctcactcggaggagaaagagtaacatcaacgctaagagcacgtacaatagcaggctataaatcagctgtaaacatattttaataaaataaataaggagagagaagagcagcggctacagatctatagccagctataacacggactccaagacatagtgtgtgtataacaggtgagactatatattaatagtatagtaagcaactattgtatgaattgaagctagtggtggactatcctattaaacttgctctaatctatcaaataagcatcaccaatttggcatcattttttgttaagtagcgtccttttgaatccatcgagaccatccaatcacatctacaattcgttatctttggtcacatataccttctttggccttgataatcacctgtactagtagctcgcgaccagtaaaagcgttttaggtcactgatagagtgaagattctacggacggacattatgccagtgtagtaattaagtgagctaaacaagttaaaaactaatttacagagtactgtgttctaaaattgacttctcactacttaagtatagaagtcgcgcttgacttacgatgtcctaagcacaaatcgcgttttgaagtttgaaccatcggactataaaatcatcagcttagaggcgccttaggactggttcactttcttagcattttcatctttttcaaagttgaaaataaaatttggtaaggcaacccattaccaacccaaacgtcccaacttttggtaattctacaactttctactctcaaaactaccacccaaattctaccaatattttggcatggtagcaaaccaaacaaaccctactttcaaatctaactttttttgaaacacaaacaactttattaagcaagaacagatattaggggataaaccccggtacacaacaacggatagaagttaaaagcagagacaatcctgaagaaagagggttaaccgaactatggaaacaaccttccagatgaaaccgaacagcagaaaaaggagcaagccgacagagagctgcggtggagccgtgacgactgcagagccacaacgtcttaaaaccgtgacgactgctaccttgggcctcagttgaagtgcacaccacttgacaaaccgttaatccccttcggttgcctccacgggaacggcacaagatcgaggttggttgttgagccgtagatttttggtgtgagcgtcaccggactcagcaaaacatccccataggattcgtcattgaatctgaggaattctaacaaccctgacaatcgaaattgcacagggggtccgagctcaacccgaatgacaaaccatgtgcggcttctgctactaggaatcaaaagagagggccaaaacgtagaccagccaaccaacaacaatggggcttttgagaggctgccaatagacttctgtcttgctttgaggcctgagatggctaaggagagggcgacctgcaacatggaaccataagattttgagcagaacaaacacccaatcacaaggcttccaaaggcttcggcttgaaggaggatgtagatgacgacgagccaaccgctgccgccaacagaggaagaagctgcaccaacagtggcaccggctagcacacagcaagcgactggagttcagggggcgacaactgccacaccgccgatcatagcacacatgccgacgcctgccggcgccacagctagcataggtgcgacagagggaaacaacgccaccgctagctcgggcacggcgaagggggacgacagacgtcgtaacgccgaggacagcgcagagaccgtcgccacctcaacgacgaccaccgaagtgccaggcgcgacgcagactccgtctccaccaccaacacaaacccgcacacgagcagggtgtcggcaaccactgccagaagctcctcctccaccaccaccaaggccatccagatccggaaactctatcttactttggggctcttgctcggggatgatttgaccgccatgtcttcgattcgccgtccacgaggcgcagaggtaccaactcccaccaccgccgctaacgagaacaccggtcgccaccattagaggccagactaactagagaaacagaaccaacctgactaaagagtactaggggaaggtggccggacccctcctccaaccctcgccgacagcgaaccgctgaaatcgaaggggaagaggggctggaggggagagaaatcagagaggttactgtagaggaaaggggaacgagaggggaatgcttcaaatgtaactctttggtaacactaaattttggtaaggtaagcaatgaagtgaacatgcccttagacttgtgaatcaacttgccaaactctagttataagtatatagcagaagcccattaccattaccatttgtatttactctgaaataacaaaatttatttccctacggcccagcgttgaagagactaacagaaccttaacctcgaacagcttgactaacataaactcctacgaaaacgtggctaatagagagcccttgcaagtactacagtgcattctattagggctcctttcatagaatttcatagaacttccatgaaacaactaggactttcatagatttttcagatattttttttcaattcttgtgaaattcctcctctctgaaagaggccctcggtatgcagcactaccatcgtgtatagagtgctatgtatatgcgcacaaactacaagatgatcctacattggcatcggcataaacaagctgcagaccaaaaaaagaaaaattccaccaaggttcctgcttggttatcacgcggacgcggttgtaacaattatcacgtacggtaaccttctcaacttttaaaaccagaccacgatgtgaggtaatcttctcaacttttaaaaccagaccacgatataactcacagtaaccacacggttttttaaaaccagaccacgatataactcacagtaaccacacggttttcgcagtaaaggcaaagttacaacggtaacagctaaaccgtgaagtaacgataatcctatcccaaacggtttgataaacccagattctaactactaatacctcacagaagtgagaaagcaaaaaaaaacaaaaacaaaaactcctatacgcaaatgcaacagaggcacacagctggcagcacaccagtacagtacagtagaatgaatggatgtgtgcaatgcaatgcaacactacgggcagctacacgacaaaacatccaaagtactatcacagccacaaccaccaccactctctcactgtccactccactccactggataagcatggtcaaaccagctgcagctgaatgattagcacgccatcaacacagcagttagcatgctaagcaccgtcattatcagcatcagaaacggtcaaaacactcgaggcaaatcaaatcagcatcccttggaaacaaatcaccatccattaattgtacacatcatcatccacattagcttagcttaattaatccactcagcagcatcagcaggagcaggaggagaagcctagctcagccttaatcttacaacaacaacacataagcagcagcagcaacatgattaagcctaattacccgattaattgtactaagagcacaacaattagaggaaattaaaggaagcgaagcctaagagagattaagattaagaagaagtaattaacaaaccccatctcgccccccccccccccaattcgatgccactacgccctaaccctaaccctagagattggggttggtcaggccgccgccgcctcgctggggacggcggggcgtaccttgggtggccggccgcggccgcgcttgacgggagcggagccgtcgccggcggctggaggaggggcgggagccgtcttggccttcttgggcgggcggccgcgggacttggggatggcgtcagagatggggtccttggacttgggcgggcgcccgcgggg

SEQ ID NO: 24075 - DNA, 6802 bp, Oryza sativa
caacccaaacaaagagaaaacaagaaattcacctccgggtagggcgggagaggcggcggcttggaggcttcgtcggcggcggccatggcggaggaggaggagggggtgggggagatggggatggggaattttcgctcacgaagaggaggatatatgaagaagagagagatggatttggatcaggaatagataagaaaatatggaggaggaaggaaggaagaggagatggatgggctcgccttctttatttcttttttttttctctccatttttttttattgttaagctcggctgtgtcacctgtgtgagaggggaagtgagaagatgaggatggacggctgggatgagtcgatccgccgccatcggacggcgcggggagggatgggtcacgcggatcggtgacgtggcaggggtaggggtaggggaggggagaacgcgcgcgctcgagagctttatgttttgtttgcttttgcctcccgtcccgacccgacccgcgggtgccttttttgggggagctgtggaatgacggtattgccctccgtggtggcctcttttttttggttttttctgtggaggtgggcggtggtcaggcctgtgatttggctgcatggacaaagcggaaatgccctccctcccctgagttgtgtgtgtttatatcgttattattgctaatattgttacatgcacagctgaggatgtacaacggtatagtgtggctggaaatacacctgttttggttgtaatgtggtatgcatgtaattggtttaagatgatttaggttttgtctgatctgtttgttattgaagtttaaattacaggtaaatcgtaatgtagaaatagtagaaaagttgttacttccgaaaagtccggcgctgaatagtgcaactgaatttcaagtctacgcaacggttgcctggatttgcggatttaggtgaaatatagttgacctctttcataacgtgttgtgaatttgtgctttacttaggtgagcggaaataaaatcaagtttttaatttagattcaaaatagagtttcacggaatgttcagtggatagacatgtatgcttgctagtattgctatgcatatggttgatgaatagggtatagtgctactataagttatcgtgttttcattagttgtaatatggtgagtgtataattggtaagataagacattctaagtaaaaggcaacgaagaaatatatttggttttttttaggcagatgtgattattatggttacatataatgaacactttaaaaaggaaagttttaactttcaaaatattaagcgaatattaatgtaactaaatttcaaataaataaatggtcactcgggcttatgaaacatgtgatctaataaaccactttttatatcttagctactttaaaagcgcaattgtcttcatccatccttcccaaaaacaaaatcctgctatgtcgatcccctagcttccaataaaagctccaaagacccagcccatcatgaaaaccggcatagaaagaaactaaatcataactttatctcccaatcctattggaacagatgggaatgtaattagttgaattgtaaaattatacctaaatatttttctgcaactgaattaacctttgaacaaatatgatgccatgatcgtgaactcttttggaacaaagagaactacggaaattgtggaggatttgattcatatggaaaaatttctatgtagtcttttggaataaaggaatagctctctcagattattttgaaattcagtaatggactattttcataggaatttggagggcaatctagcataaggttctaccgcatgtttatctcttccatggcacagccacaaggttcctctgttttttctatgtaccatccaaaacaataatttttgaacttccacgtgttcttaattcctatagaaaatcaatgggcatgacactcttcctacgtttttcctattcttatgttttcacaagtatagtggcatttacaaatttgccactggattttcttattttgtaagaatactatttgaatgatagttctgttggtagttttttttcttttcaattttatagtgggaattttgccataacgatttagaacggggtaaattcgcaattgctcctatttatcatggttctttttagtatgaggtagtatttgtatagctagagaacatgagtacagagtaacaatttagatagattaagacaagtaacaaaatttcttaagtaaaattcgtataattttttttaacaagaatttaggttttctcaacttttgttttgatgcactctacctcccataccttaaaagtgagatcatgtgcgcattgcaattgcatgtacatggccaacaaaaacagctactagagttaagcagattagtagctcgacatgtacagttgtgtggaccgtatgaactagccggcactataaaaaaagctcaccgataacgaaagatacaaaattttcgattgggataatagaggcatcttccttttaatttaaaataccaagcgggaagtttacttgcttgagcgcatgggtaaaatcgtctttttggcgcttcgccatcgagtagtagtatagcttagctgccagctaagcccacagcttcgaaatttttgaaattggagcgtgcgctgcgctgggccgagccaagagtgcgtgaagaagaagacgaggaaaaaaaaaagaaaaaaaatattatatatatatagtactcgttttgttttttcccaattcagtttgagctcggagtactaatgctggccgcatttgcttcgcgcgaacgccacctgtcaccaggacacccgaaaagctactcgtacggcaacgcatctcctccctgcgccagtggggcccgcatgtcggtgagagtaagagtagtcgggtgcgcacgcgccgtgtacgcataataataggtgtagccttgcagccgtttacaccgggagcacggctcgccccggctggcgcatcggtcgctgacaggtggggccgggtgcgcctggggcccacctgtcggtgagggatggatgagagggtgtgtgtgcaccgtggagagtgggatttgcattgctgatgaactgctttttgggaacggggtatttaaagcactctcctccctcttccacctcggtgactgactggtccccccacacttctttttattactgtagtaataaagagtatgctagtactgtcactttgtgcacacaccccctctagagtttgtatatgggttaatttgatccatcctattataaaagtgtgattttagataagtatcactaatgttcgtttccatactattcgtaatcatgccacccgaatacgaaaatatttggttcacaagctcggtttgacttggttttgtttgctctgaattttgtattttttatatggtcaaaattgtccttgcatgccaaagacttgactcattcctcttttggacccgaaaccctagccatcgtcgacggcaagcggtggcggtgcttgaaggcggataatagccaacacgaatattaccttccaatcttgactttaatctataaaaattatgtagcttatccaatctacaccaccagattggatttttttcttcaccttcttaaattttaaccgaaatacatttttttacatagtatggctctgtttgaattttataaagatgaagatgaagatgaagattaagtgttttacgtaaaacgaggtggtaataacttgtgattaattgagttttaattattacaaacttgaaaaataaattaatctgatattttagaacaactttcatatagaaaattttcacacgaaatatacagtttttgtgcagtttgaaaagcgtgccatgaaaatctaaaacttaatctcgcctctgttaggttcttgaacatgacctataacttatttagctactatataattagaatgacaaaatgcttatacaaatcgaaagtatgttgacatgcttaaaacctaaatgtgtatagaaaaaaaatgttcagaataattaaatcgcacccacctactaacttcttgcaatagcatgcttacttttttatgttcttacactaaatttcactcacatatatgccaaattgatgtattgtgctctattaaaattatcaattgtttgtggattttttttctttagatcatataatcacatgatgagacgagcatgccttgccctcctaaagacctcttttgtaggctcatccacaagaaaagccaattatgcaaaggcatccaaccgcacttgttcaacttttcctttatgggctgcacaaaaactggccactagaaagtgcaacgtccaggttaacaaaataatttgaaagcaaaaggtccaatttattctggctatgtgttggaccaatttcaagttgacagtcacagttccaaaacgagctcattaaatgaaattattaaaaattccaagcctacaaccaaaaaggcattatgcatgagagtatggaccagtttagatcctcggtaaaattcttcaccctgacagagcaaggctaataatacagccaatctgttggctataaggttatttatagccttctcttagtctacccatataatagttagctctttacaattaatatagggcccacttgtctctctcacagagtttcttggttcttgtgtgcaagccggctgtaagtttatagcccgcttctcctctctcttctctcttttctcctccacctcaacatttagcctgcttatagcctactattatacttgctctcacatcgaatatttggacacatacgtagagtattaaatataaacgaaaaaaataactaattacacagattgcgtgtaaattgcgagatgaatttttttaaacctaattgctccatgattcgacaatgtggtgctatagtaaacatttgctaatgatagattaattaggcttaataaattcatctcgcagtttacaggcggaatctgtaatttatttttttattattttgcgtttaatacttaaaatatgtgtgtccgtatatccgatgtgacacgccaaaactttacacccataaatctaaacacccctatatccaacaatctttctaaatctgactctctgagtatctatttagtcagcttgccaaacaaattagagagctaaatttgtctttttcactccagtaatctctctaatctgatggtggatcccacatgtcaatctatatactgttagcctaaaaaaaacaaatattaattgttacacaaacatttgctcgatatagatctcattgtgacacaatcaaccaaactaagagactacccaccttgtttatgaaattcatagattcagccaaaatgatgttggggagaggagacaatgacacttacaaagacaacacaaaaataccacatgaaattcatatagtttaattgttgttatatatgtatgctagctctctatatattggttgtgtgtgtgcactcggtggatagatggatggtggatttttatagaaggaatgggaaggtctaggtttaggggttgtggtttttttttgtaccgacactaccgtgatattttctcttcgtttggagcagccgatcgaaggtgagagaggctttgacttgtggatgcagctagctagctaaaccaacctccggagcacgtgatcacgctgcacccatgccacaacatgttccaaacccctcatttagtaacttgcagcctgacccccacttttctttggcacgcatagcaatcctttcttgcagtagattgagtaacctctacaagcatgtcatccaacctttctgtttggtataacaaaaccttgcttggcttgatatatttacttggcttcattgtaggttttttttatataggtgttctttagttttgtgttttgcttttctttaataattttataggaggaactgtggtattgactaggattcttgtggtgaaacatgcatagttatttagatttgggtcctaaacctggcatggatgcttgcattatacttgttattgtatcccgatttatagcaaggactaagtgtcatatctcttattcaaccaatacgccacctctagtattttcctaaagcatgttttaaatggaggtaaatacttcttgagttcctaacatgtaactagaagaagatcgaactatccgagcaagaacacattggttggatgagtagtattcgagcgtgctacgggaggtaaatggtacaaggagaatgaaacagaagcttttcaagcactgttaccaagcttttggcaggtaaaaacataagcttttatgctaccaagcaggaatattcgcacaaaaagatgtcgggatatcactccaacttcacttgcaagttggcgctagtggtcctaggaatcgtccgaacgtatggatacacccttagggttctaagcttttgaagggcattattgtaacttcatgtgtacctcctaaggctatataagctgacccaatcctagcgaactaaaatacatttttactggtacaatgacgacaagtgttttattgacacatcttgatttcacttcaccttaaggctagacgggaagagaagtactttcctgcctatccccaatttcttcatgaccaatatgcatgcctagtttacataaggttaggccccaactaatattatttagctatgtaatgggatagacatgctatgtgagatttgatctccaatcctgtataaatttgttagggtacatctatatgagtgtgagggcgtgcatgtggtatatgcatatgaaatttgcttaaaaaccctttatgggattttta

SEQ ID NO: 24076 - DNA, 991 bp, Oryza sativa
  unsure (1)..(991): unsure at all n locations
nnnnnnnnnnnnnnnnnnnnnnnnnnnnnnnnnnnnnnnnnnnnnnnnnntcttgggaggatcnnncccgagnnatttnngatctcccaatgggcctgtattnaaatttgttttatgggtacccatctatttatganngtgtgaggggcggtnngcatgtnnggtatanntgcatanntgagaatttggctttaaaaccctttatgggatttttatcagccaaccgaaagttaagctatagttgaagcttaagctaaatcttaagctaattaagggattataaagcaacttcttaccttcggaaacacattgagttctatacgtagcaatcaattgaatcttagttgatgaagaaagatgtgtatgacatacttcaacacaacatgatcttaatcgcgaagattattaaatatgctagcttcaattaatccagcccacaatttttagcgagctaaacctcaattaattaaggccccatcaggaacaggaaatttataggatcactgtatgaatagccaggaagattccacatgagattctcaccaaaatctttgtcgaattccttaagtacgttgcaaaatggggcttagtggaactgcttatcaaacagaaacaagggttggtgtttgtatggaatcagatttgtctgcatcgttcaataaattccggtgactatgcgcaagtgaattgccacagaacagcaagctgacgtcttcgtagtatatttatttggaatcgcagatgttaactatctttctaaaactttgttaaagttagagaagtttgacttacgacaaaactaaaaccacctcagtcgttttacaatgtagtgcccgggaaaacctaggcgttatccaacataatcgccgagcaggacatccccccttgaacaggcggagcaacacctgataggcccgcagcgatcacccttcccggcagttgctaaacgataatgnnnnnnnnnnnnnnnnnnnnnnnnnnnnnnnnnnnn

SEQ ID NO: 24077 - DNA, 328 bp, Oryza sativa
gtaaatttgtttggtgctccatggtgcccgggcaccattgttgaaattgagtatataaccaattcaaatgagtatgaaactttttcaattatttaggtattaacattaactactttactaactagttcaaagcaagtttgaactgaatttgaacttgtttttgttagattttgattctaggtatatagcatccatacatataattagttaggtatgtaatcatgaattgtgaaataaagttaaatttgagttgttttgttgatagatatatgtatgaatcgaattcttataactaggtatatactcacaatttaaaatttttgaaaaa

SEQ ID NO: 24078 - DNA, 2186 bp, Oryza sativa
  unsure (1)..(2186): unsure at all n locations
actatagggcgaattcgagctcggtaccctcttgttattttgaagagattcgtacatgttgtacagctgccatgttgttgcctttctatgcatacaaaacaaatagcttcgtcagagaacaatacagcgcaggaaacagtcagtttcccctgccctgcgctccgacgtccttccagttccagattcgaccatcttaatttgtttgttgtatattctgacgatggacctgctgacttatgtagtagttcattcgattgcttcgatatctatgtttcaattcagtttgttgttgtgatttgcgtaacttatacccagagtgattgatttcctgggggatttgaagatgtgccagaaagaacgtgggatgctcaccgggaagagatcatgagaatggttagaaaactataggtaagatgagattctttggacacagtaaagccgagtgttcagagacaaagataggaaataaacatgttgatgaaaaaagaatcaatacaaaccaaaaaatagctgattgcttgaaagcgttcatagagaaacgtaatgatgaaaatcaatacaaaaaaaatggcaaaaatattctacaaaaccgattgctcatccggggaatcgaaccccggtcagtaccgtgggagggtactatgataccactacaccagatgcgctttctgtcatcgttctgaaaatttaggtatatgatgatataatttcccggtgagcgaacgaagataactgagggctttgatcactttcttatcaaaatcaacgttactaaaattttgtaatatcaaatttcgatatattttaatgttatcgaatttttgtagtgttgattgtatttgtcttaaagtcttaccaatttttcatagagtatctaggagagaatctttcgaaattaccaacatttaagtagggtacaaatggtaaagttatatttaactttttttaattacccatatatacggcatgtttggttggagggagttttaaaagggattgagagtttagagggatgatactattaagtgttttgtttggaacttcctccttttcaatatctggtaggggtaggtaattgggaaggaattcctcatttactttatctaagcaaatatcaattatccgtttttattaatgatctaatctctaactaaactccctatcaatttccatcacctctaccaaataagatattgagattaaaaattaaattcacatcttaatcttatcatcaattcactcatataaatttccaatcctcttcgctcaaattccaaacaacaagctatgagcgctgggggcgtctatgggagcagtcacctaacatgtggaccctatatcgccacgtcctaattaacccaggcggccaggtgggccccacgcctaggccaaaacccacttacatctgggccccaccctcgcctctcccggcgcgcgaaaccagaccatcgcaccgtccaccaccagtctcgtagcatcgtggcgccgcaccgcgccgtctccctctctctctctctctctctcttccccttcctcccctgaaacctaacgcgccaccgccaccgccgccgccgcctccctatcccaaatcttcgccgggaatcgcgacgatcaagccacgaggatcgctgctgctgctgcagcagctttgcctgtgcttaacgcccaggtataatgcggaccaggagccagcgcgacggccaccacgccgccgccgctgccgaaaccccgccttccggttcgtctccgnccgccccccgcgccgccgcgatccaccccccctcccccccccccaatcctgttcccacgaaccccgcctccgtcatcttcccaactgaaaccggtgtttgttcgtcccgcaggggcaagcggaggatcaggaggggacgttgcgaggggcggtggcacgcctcgccgtcgccggagggcttcgccggccgcggagaaagggaagtcgcccgccaaggtaaattaaattaaatcggtgtttgtgaaggactaaaggctctgtgcttgatttcctcattgcgacaagtcgagaactattttaccatctgtggcttgttcaggaacttcgggctctaaatgttccttgtggttaagcgcgattgttcgacatatgttcannnnnnnnnnnnnnnnnnnnnnnnnnnnnnnnnnnnnnnnnnnnnnnnnnnnnnnnnnnn

SEQ ID NO: 24079 - DNA, 3743 bp, Oryza sativa
cgtctgacacagatgagctcatggacatttgcattaagtttataacctgttactataagtctaattttatcgttgaaaatttttttataaaaaaattctatttgccttctaagagtttcctggcgccagctcatttgccaagttgtatgtaatgctcaggagtttcgtcacaagctttggaccatatctaaaagagtcactgccttttcctttcttgtgtgctttaaatatctttgttatctttgaattttgacctgttagttttatttctgattatccaggagttggctgaactcgtgcacagggtccatttgctttgcctactagcaaggggtagggtaattgacaaggcttgcaatgatcctctgattcaggtgcgagcattacagtggtattcattatttcatttacaccagattctgtatttctcatgttccaaaatgatgaagtggcattatgatttatgaatcatagtggttaaaacagaggtgtgtttcaaacagaattgtgtcaatattctttgaaatgttctttccaggcttcaattctctctgttttaccacaacatgtactacggaattctgtagacactccaattctgaaagctaatgaactgcgtagtcttgtgagctgggtaagtccccttcatatattattttattgactaaaaatgtgaagttttatgaaatagtagtttttagatgaaatcttttaatttgcatttatttgtctgcagttccacaacactttcagtgtaattgcacaatccgacgacaaggggtcttttaaatcaaatttggcatttgctcttcaaagttatgtaggcactgctgaagaggtatcatcttctccctgaagattatgctgtgaaacaaatctgctgtctttatttcagcaaacttatttttcttattcatgtttctcagatttggaaaacctaaaaagtgaataagagttgtcatatttcaatgccccaaaatatgttttccattgagatttgatatggattgtcaatgtctacttcatttcttttggaaaaaaaaacaatctttagttgccactgaaagttgacaccattggttatgtgccgtcaggaaacttggtctcccttcattgtcacccctaaatattgttctgttatttctattgtcgtctgcccttttaggtaaggttgccaccaacatataaaatactgtcagtttttttttctttttggggccaaaatagaaggacgagagactccagcagctcggtatgcgcatgccaagttggtggcatagagtgttccatcagtaactgtgcacaaaacaccaaaggcctaccgacatgactcttgcctatagtggtcatgagttacgcaccatgcagtaacactaccaaaggaaagcaagagatacattcacaggtcgacggtcgaccagtcttctcaccttggaacgagggagaatagggatgcattaacaagctgatcagtcctagggccatcaaacgcatggtgcaggtgtgctttctcatggcgtgaacaggtttcagtgcacaaacattgaaaccaataagcatacgaggtagaatgcgtcatgaggagtactgtgtagttgtcagtgggaatcaactatccttttgcaattccagtgaggaaatgctctgaaacaaatatggtaaaatgattgctttaggtaaagaaatatgggtatgggaacacatctttacgctgctgaaattgttcttggacccctggtgctccggttctcaatggggaagataatgatggagaggttccttgatgtcacaatggaaggaggatggagccagtgcacctggagtgaccatgactaccttgactcctttttggctggagaagatgcagaactgtcttttttttttgtggaccacttaacagcaaacttatacaggactgtcgagtggcaaataaggtaacaaaactctgaaggagtagcaatgaagggagaacttttcctatggcatataaggtataatgtcaactttcagtctttcaatggcaaataaaaaatctcctcttttgtaaaacaagacgctatttctgtttaaagctgccaaataattcgtttgcaatgcaggtttgtgcactttcagtggcattgtttagggctctcaacttaacagctaggtatggatttcactctgtaattagttttatgattgattccatccattccagaacgttagcataaaaaatccataaatcattttgcaatccattctcgtcgaatgctgtttgcttttgttccacgcaggtttataattatagtaaacagtttccatgatatgtattatatgtttaattccgtggtgaaaactggattttctgatctcttccagagaatagatttcttctttttctttgttctgataaaaaaaaagaatttgtcatattctaaagaagtggttcagtagaatggactcttaactaactttcaataaactacagtttgataaaatcctcgggtgcttgggttagaatagttgatattactcctccccagactgatttatttttttttcttcctatcgaacttcccataaagatcaaggaaatttcaattgtaagaccatctattatagttagtaaaagcgcatataaaggttcattatgttgtcctgtggttttgttcgataaccttctgaaccaattctaagtatagcttcccttctaggtttgttgcgaatctggatgttgctggtctcaagcctaccactaaatcaatggggacatcaaatcagaatgaacctaggctttgtacaaaggcgctgccatctagttcttttgttgcaggccataatgagtataataacctttcacctgtcctgtcacaaaacaatactgaaggtagcatcaatacaactccaaaacaagtcaaagttcaaggctgcagaaaaagtttgtctaaaaaattgtcgaagtgcaaggcaaatcagagagatagctctgcatcactatcaaaagatagctcatccagcagccaatatccttccacctccagtaatgctgaagtaccaagacaaaaaggggatttgaaatttaagttgcagctgaaaaatggctcttttagcatctgcagctaaaagtcaagacaacaagctagcaccccaattaaatcagtcaattgatagctaactaggttcaactccaccattgaagaagttacgaaaaagtgaagaagcctcaagcaactcgagcgtggtttggtcgaggaatagagcaccgttattttgggctgaggtattttgtggtggcgaggcatcgtctggaagatgggtccatgttgatgttgcaaatgatattattgatggtgaacaaaaagtagaagctgcttccgctgtttgcaggaagcctttgagatatgttgttgcctttgctggaaatggtgctaaagatgtgaccagaaggtttacctctttcataattcctaacttagtagctatatagaatcatgaggatatattctttgcttttggaaatttgtaaaagaactggtttgagaactgtgttctatattttcctaggtattgcctgcaatggcacagaattgttcaggggagagtgaatcctgagtggtggaaaagtgttttggcacccctagagcgtcttgaattggcagcaacgaacaacactgaagaaatggaacttcagaccagggccttaacagagcctcttcctaccaatcaacaggcaatgcacttactgagtttacgatattggt

SEQ ID NO: 24080 - DNA, 2659 bp, Oryza sativa
  unsure (1)..(2659): unsure at all n locations
nnnnnnnnnnnnnnnnnnnnnnnnnnnnnnnnnnaaatgatattattgatggtgaacaaaaagtagaagctgcttccgctgttggcaggaagcctttgaaatatgttgttgcctttgctggaaatggtgctaaagatgtgaccagaaggtttacctctttcataattcctaacttagtagctatatagaatcatgaggatatattctttgcttttggaaatttgtaaaagaactggtttgagaactgtgttctatattttcctaggtattgcctgcaatggcacagaattgttcaggggagagtgaatcctgagtggtggaaaagtgttttggcacccctagagcgtcttgaattggcagcaacgaacaacactgaagaaatggaacttcagaccagggccttaacagagcctcttcctaccaatcaacaggcaatgcacttactgagtttacgatattggttaacttctagttatgccttttgcttctttcaaaggttgcctgttggcttttctaattatttatgtaaccataaccacttaggcctacaaagaccatcatctatatgcccttgagaagtggcttcacaagaaccaagttcttcaccccaaaggcccagtgcttggcttctgtaaagggaatcctgtttatcctagatcttgtgttcagacactgcaatcaagacatggatggttgcgggagggtctgcaagtcagagaaaatgagttgcctgcaaaggttcataatagaatcacagcgctagcagtttttttctgtcttcatgtgaagtaaccatttttctgtacacaggtcgtgacgcggccaaagaggactttcaattctcagtcaattcaatctaatagtaatagtaatgaagatgggcttaagccaaccatggaactatatggtaaatggcagctggaaccgctgcaacttccccatgcagtaaatggtattgtaccaaaggtagacctccttgattatgactattgattttcattaggtagctatcagtgcttattttgtggtgttccatgctgattaaatgctaaaatatgtccaagaatgagcgtggtcaagtcgatgtgtggtcagagaaatgtcttccgcctggtactgtacacctgaggttaccaagaatattccaggtcgcaaagagacttggaattgattttgccccagccatggttggatttgattatcgaaacacccggtgccttccagtttttgatggaattgttgtctgttccgaattcaaaaatactatcttagaggtatgctgagtacttgatttatttttcaaaattctggtcccattcatcctgctgtctacaattttagtcggatcctttatgcaatctgatgtggatgtttaattaggtaaaattattaacaatctttaacaatcacaaattagcccaaacctgttagcaccttagtcaaaagtgtgtgcttgaaaggtatttgcacactttgtaaatatttttattttgttttcttccccttgatgaaatgaaatgcagttctctcgttttcgagaaaaaaaaaggtatttgcataagcatgtttcataatagcgcttaactcattgttgagcatgtctcattataatgcactcaatgttatggaaagtagtgtaatgatcaagagtagaattgttatattcatgtatatgctagaggtagtgatggtattatagtctctaggttcctgtactctcttgcgtaacaagaactaacagggaaaattgctcagtaacactaatcactcgagttagaaaataacatcgatgtgtcactgtcatgtaggcctagggccaaagctaattctcctagtttcatcaggtacatacaaagctagctctatagttggtctaacttactcctacgctttctgccaggcatatgcagaacaagaggaacggagacaagccgaggagaggaagcaggaggaagctcaggctcttattaggtggtatcagctgctgtgttccgtcgtaaccacacagcggttgaaggactcttacaaagcaccctcatcagagcacggaccagaaggaccatcccaagatgttagtcagcagaagggcacacgcaaaagtcgaagctcggaaacgaagactcgctcaagcagactacaggcggaccgaccatttgattctccttttcctgtccatgaccatgagcatgagtatccagaggaagatcagagcttcgacgaagagacgtttgtgaggacgaaacgctgtccatgtggtttttcaatccaagttgaggaattgtagcaaaatgatatcagaaatgcactaacttaaggtgtagcctgtttttggtcccaggtgaactctcaaaactatggtagctgtgatgcttctgacgaatgcaggttttgatgcatttgtcttgagttgggagttaagagtgagtttgctaaacccatagttcagctgttgcactgaaatgaggtgttgaaagttgaagctgatggtatgaaatgtagtgggtgttaaaactgttaacagtatatgcttgtttaagtttcagcatagtgccatcacgctaagattttatcaaactaatgttgagtttgccagttattnnnnnnnnnnnnnnnnnnnnnnnnnnnnnnnnnnnnnnnnnnnnnnnnnnnnnnnnnnnnn

SEQ ID NO: 24081 - DNA, 690 bp, Oryza sativa
  unsure (1)..(690): unsure at all n locations
gcattggaggaagctgtccgtggcggccatggaggacgacatggaggcagctgagcagaggaagacgaaggcggctagggcgcttaagcttcgcgacgacatggccatgtntgcgtcgtgcatgcaacgatcgaacacgtactagctgctgtttgcaacgaacgaacgatgcattgttgttgcattttgcatggtgttgggctctacatataggcagccatcccacgatcgatcgagagcgacttgtcacacgtgcagagcacgcttcaagaaaacggctcgtgccagttgccaactagtgtgaaaagattattttctttcttttccagcttggctttatgagaaaaagtcatggtcaactaactggcttgggaaagtctaaatatagtataattatactctctcccattatttcctagctatatacacgtcgcctaaaagtgcatgttgtcattagtctagaattaatatattattttgtaaggtgcgaaataaaaaattaatgattccaaaacttaggatcaatgaatacaaaattatacatcatcgtggactctccatttagtttttcttgattaaatcatttcaacatttaggattagaacaaacaagttgtatttggtttggagtcaattataaatttccattaataattataaaagtatgggtaccgagctcgaattcgcccta

SEQ ID NO: 24082 - DNA, 723 bp, Oryza sativa
  unsure (1)..(723): unsure at all n locations
nnnnnnnnnnnnnnnnnnnnnnnnnnnnnnnnnnnnnnnnnnnnnnnnnnnnnnnnnatacccccaagaactgaagtaacatcaaacagatttcgcgcgtcgcaaagatacgataccttctccaccggaatgttgtcgaacacattcaccaatccatcgtagaatatggtcatctgtgtcaccttcggattttgaaggtcccttttgcaagtcaacgatccaattgtcagctcaatgctttctcatttttttttcttagctttgcactcaaaattcagaaatgatttctattagagcagagtagagattatccaccttgggccgccgtagacgccgacggtggagccggccaccgagttgccgacggagaaggattggttcctgtaggggctcccgccggcgacgttggggaggctatgaacccggagcatggggttcgcgtggccgaacggcacggggtggcgcggcgacggcgacggcgacgggaaatggtgcggcgccgcgacgccgtaggagtccacgccctgctcccggtggccgtgctgcgccgcggcggcgtactgctgccggccgttgaatccaaactgccgctgcacacagctcagaccgttagaatctaccatgggagggacacgacgtgggcgacggggaggtcggaggcgaggcgaacctgcttcatgggcggcagcgccgtccaaggcgtcaccgggggacgggcgcggc

SEQ ID NO: 24083 - DNA, 750 bp, Oryza sativa
  unsure (1)..(750): unsure at all n locations
nnnnnnnnnnnnnnnnnnnnnnnnnnnnnnnnnnnnnnagggacaattttcatcgatctgatttttttaaaaaaaaaagaaaaactgaagttgcctagtaagtgatcgattttttttgacataaactgatcgaattctgcaatatataactgagaacattgatcatttcacatcactacactaatgcaattccaatggaacaattaaccagagaggcaatactagaacaatgaaacaacactgttctgttttagttcggtaattattgattataataaacactgtaaacataatttacagagtttaattttgattgattagaagagctcaagcttgttccacgctgaagctgctgcctcctgctcaaacgcgctcctctgctggtcgtagcactgaaaggcgtctagctcctcgtacatcgccggcggcgatagcggcggcggcggcagcgggaggcggtagtcgtcgtcccacagcagggacggcggcgccgccgcggcgatcagctcgtcgagctccatcaggcacatggcgtcgtcgggccactccaggaccgggagcagcgccgcggcgtcgacctcgtcgcagctcgtcgtcgaggaggccaccgacgaggacgacgacgacgacgatgtcgtcggcgtcgaggcaccggcggccgtgcaaaccggcggcgggtggtcgcgcaatggcaccatgatctcgtccgggtggatcatcggcacctcgtcggtgcagaatcccggggac

SEQ ID NO: 24084 - DNA, 672 bp, Oryza sativa
  unsure (1)..(672): unsure at all n locations
nnnnnnnnnnnnnnnnnnnnnnnnnnnnnnnnnnnnnttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaacccccgagggcaaggttgagtacgagtgaccttattttaagtcaagattcttcaaaaggaaagaacagcacagacacaacctttaggaaattgaaactgcttctattgaaatgttgaaaaaagagaaataagaatgtaatgcatgtgtggtagcccccggccaaccctgcacacccgaggggggtgcggggttggcctgagccaaaacctgacacccgacccccccccccttcttaaggggtagaagcgacgaaggtgttcgatgttccatgggttaggcagcttcgtgccgtcgcccgtgcccagccgtaccgagcccggccgggggacaccgatcactcgatacggacccttccacattggtgaaaagttgctcaatccagcacgcgtttggacgccgcgta

SEQ ID NO: 24085 - DNA, 2755 bp, Oryza sativa
agaagaccatcaagtcatcctcgagggacctcgcccggggggcggtcgaactcgtgctagcgagttaccaggcccgggaccccaatttctctccctggatggcgctggaggagttccctcccgggaccgaggacgacgcgcgcgcgcgcgtccgggatgccgccgaccacatcgtcaacggcttcgagggctcggcccctcggcccgcgttcgcccccaactccgacgaggagggcaacaccagcagtgcagacgatggtggtgacgaggccgtcgactcgggcgcgtcggaatgagcccccaagcccccgccaatctttacttttttctttttctttcttctaaggccttcatgcctcttttgtgtacaaattaacttaatctgcaatcagaaatgacgaaaaaatttttgtgttagttttattttgctatacatacgcgatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaacccccgagggcaaggttgagtacgagtgaccttattttaagtcaagattcttcaaaaggaaagaacagcacagacacaacctttaggaaattgaaactgcttctattgaaatgttgaaaaaagagaaataagaatgtaatgcatgtgtggtagcccccggccaaccctgcacacccgaggggggtgcggggttggcctgagccaaaacctgacacccgaccccccccccctcctcaggggtagaagcgacgaaggtgttcgatgttccatgggttaggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgctcttctaagtggtcgaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagatagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgcccaccagggtgcgcgaggcggaatgggctccgcactcgccctcatggatgtcaacaagaagctcaacgccttgttcctgaggaatgcacttcagaaggattccgttagccgcgcgccgatagagggtcccttctaccagcacatagcgtttggaaatgcgttggacgcgttcactcccttcgcggtcctcaggtagagtcttatctgtgaggtatgcttggatctcagagatccacgcaatcaatctaagggagcttgaagcgctcccttcgggtcccgaggcctggactccgacgggcctcgggggccggtcaggcgtatccgtttcccctaaggggtcgggtcgcgccgacggctgggtaagcctttcttcaaaggcgcccggtggggtttgggctcgcgaggacgcgagccttgagagttcgtcggcaaccacgttgtcccgtctgggtacatgccgaagctctatcccatcaaaatggcgctccatacgccgcacttggcgtacgtaggcgtccatctgtgggtcggagcaccggtactccttacagacctggttaacgaccagctgggagtcgcctaacaccaagaggcggcggatccccagtccagctgctactctgagtccggcaaggagtccctcgtactctgtcatattattagtcgctcgaaagtcgagacggaccaagtatctgaggacgtctccgtttggagaggtcaacgtgacccctgcaccggcgccctgaagagacagagaaccgtcgaattgcatcacccagtgggcggcgtgaggcagctgtgagggggggatcctc

SEQ ID NO: 24086 - DNA, 4907 bp, Oryza sativa
agaaagctggttgcccattttaccacccgtccggtaccttctcgattatgcaagatttggccgagggggtaggacgtaaccacagtgacccgatgcgcttggaaataatggcgcagtttcctcgaggccatcagaatagcgtaaagcatcttctgggcctgagggtatcgggttttggcgtcccggagggcctcactaacaaagtaaacaggccgctgcacctttcggcggggccgatcctcttcgctaggggccgtatccccggggtgctcttcgtccaagtggcctctcggggcacactcgtctcctgcgctgatgacctcggggtccgaagatgacaggtgcggccttcccacagtggcctcggggccgtcctgggggtcgggggctcctggcgtcgtcagacaagcgggcaaagggccagctccggtcgtcaggggcctcaggcctccgttcggctcgggggcctcttctccctgctctctcccgggtcgaatcagcacagggttagcctcggggtcaaagggtggtaggtgcggccttcccgcagtggcctcggggccttcctgagggtcgggggcacccagcaccgtctgacaagcgggcagagggccgactccggtcgtcgggggccttaggccaccgttcgactcgggggcctctcctccctgcctgctcccgggccaagtcggcacagagtgggggtgcgtagaatgaggattgtcctcatcgcgctccactaccaacgctgcactaactacttggggggtcgctgctaagtaaagtagcagggactcatttggctccggggcgactagaaccggaggagagctgagatacgccttcaactgggcgagggcattttcagcttcctccgtccaagtaaacggccccgagcgcttgaggagcttaaataagggtagcgccttctctcccagcctcgatataaaacgacttagggcggccatgcaaccagtgacgcactgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagttttatgcgggcggagcggagattttcaaaagtttccgctagatctgagagtaaggtctcttggttgcgcgtctttacaaccaagtcatcgacatacgcctcaacattacgtcctatttggctacccaaagaaattcgagtagtacgttgaaaagtaggacctgcattctttaacccgaagggcattgaggtataacaaaaggttcctacgggggtaatgaacgcagttttctcctcatcctccctagccatgcgaatctgatggtaaccagagtatgcatctagaaaacacaaaaggtcgcaccccgcagtggaatcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcaactccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccacaagggcccggcatcttcatctggaggtaggcgtagtggaccgccgccataaacttcaccaacgcgggcctccccaggaccgcgttgtagggcagactgaggtccgccacatcgaagttcacccgctccgtgcgaaagtttgctgatccaccaaaggtgaccggtaggtcgatgtggcctaacggccatgtgtgccccggcgtcacaccaatgatcggttgagacggctggagaaccatccccggggccttgatagcatcaaaggccgcgggggaaaggatgttgagagccgctcctccatctatgaggacacgccccaacttcacattgcagatggtgggggaaaccaccatcgcaatctgccctccccgggcaaacacaccgagaaggcctctttggaacactaggaaagacaaaacacagcatttaatttctgtatgatcatactcacacatgtacagaacctatgactgtaaacacataaatgagaaaaatgtaggtataactgtctggatggtccacatgaaaaatacaacaattagattaggtgatatattgtaaattaaaggagatttctttgaaaacattggaccccatgctaacttatttccttgaaaaaaaatatatatgcagtaggcaatttcaaaggaatcctttgaaaggattttctataggatttgatcctacaaaattccctccaaatactttgttccaaaaggggcatttagttacgtatttgatccactggaccatgtttgaaaaaaataaatcctagatgtgtttgtactgtgttcaaaagaatctaaaatcgttcttgggtagttaagggtttagctgggttttaaggtttaacttgaagtacgggtactatatagtaacaattcaccaacagattacgttagatcatagtattagtgtattagtagtatgtacttcctccgttttctaataaatgacgccgttgactttttctcacatgtttgaccattcgtcttattcaaaagttttattcaaatgtataagatataaatcacacttaaaatactatgagtgataaaacaactcataacaaaataaattgtaattacgtaaattttttgaataagacgaatggttaaacatagaaaaagttaacggcgttatctattaaaaaacggatgtagtaataggagagtattaatttgctgatcatgcatgtattgcgtacgtacggtaataattaatggtcgagaatattaacaagtactcctacaaattactgaatttaaaagtacaaacaactacaagttaccagaggagagaggacatatatgtatatatatatatacacgtacccagaagcatgtacagtcgcgtacgtacggttgcgttcgtacacgtatgatcgctaattgatgtgagcactgtagctcagcaagtacatgcgcgaaataattaaacatgcttaaaatgtactccctccgttaataatacacggattttgagtttttacttgcaacgtttgaccactcatcttatttaaaaaattttaaaattattatttattttatttgtgacttaatttattatctacagtattttaagcacaactttttgttttttatatttgcaaaaaaaaattaaataagacgagtgattaaacgttgtaagaaaaactcaaaatcctttatattatggggacggagggagtagtaacattgagctagcgagctagaggtactagcagcttcaaggaaatccaggagtaactctatggagatgttgccaatatgactctcatgtttaaaatgactccctatattattttcataatggttttcactgaagtgaagcccacatgatatcctaatcaccaaaaaaccggagaaaggagagaaggaggatatgacatatgagtcccactctactttttaatttccgagatgattggaatgagtgaaaactgactaaaaacaaccgagagagtcgttttgaatggctttaatagttgaaggggtagatatacctggtttttcagttgaaggatatgaattaaatccaacctacaccctctatctttactattataaaaatgaaagatgtttttaccggtattttggtacgtcatccgtgtttaagtcggtttttaagtttgttcgcttttggaaacacatatccgtgtttgagtcaaattttaaattcgtttgattttaaaaatacaaaatgaatcgtataagaaatctctttaaaaaaactcgcatgctaacttaagatgaatatcggactcctaattgcagcttatggttttccaaaaagtatatccaaacgaatttcaccctagctaaaccgtataataataataatattaaaatagccttgatccgtcagaactcacgaacatttactttctagtcttataaaaaaaatcaatttctagatgaacctaaacaagcatgtatccaagttcatcccccaaaagttatctatttttaggatagagggagtgcaataagtaggaacttaggcccttcacagtgctccaccctggagcgttccttcgtcccaccacgtagacttcgtgatgtcatggaggagagaatgtgtgggcccgagttcctccgcatgattgctcggttccttggtgagcaacgagttcctcataaaaaagcctgcaaaaaggtctgaagcatgcacaaaaccatcggaaagaggcgaggaagagcatgaggaggagaacgggaagagtctgggtcacgcgtctggctcgccacttccccaccgccgaggccgccgcgctcgcctacgacgacgccacaagccaccaccgccgccgcgctcgcctacgacagtgtcgcgagcgcagcggcgcacgacgacgctgcaag

SEQ ID NO: 24087 - DNA, 5384 bp, Oryza sativa
  unsure (1)..(5384): unsure at all n locations
aggcggcaacctccaagagtaacaagcaatgacccggcgtagagatgatcaatcaagtgccacactagctctacaaatggaagcaatgcacttgactcttggctagaacaacctcaaccactacaatggatgaacactaagctaaaaggtgtgtgagagagatgcaaggggtgtatgcaattgaattgggtgccgaaagagagcccccttgctgctggagggggagtatttatactcccaccaaccaaaactagccgttgggggcgaaatcccccaactctgtgtgctgctggtttgaccggaggtatgaggccggtcagcccgtgctactctgcaacggctagaaaactagccgttgtagccctgtcagagggcccaatcggcctggccggtcagaccgacatggggtggccagtcagaccgccctcaacttggtctgaccgaatacggctccgtcggctctatatcggccaccccgagcaacaccatcccggccttcagggggccggtctgaccgcacaagtgccgtcggtcagaccgaccttgtgcgccggtcagactgcccgcttggggccggtcagaccggccagggaccgccggtcagaccgccacaaggtggccggtctgaccgcccttggtcaggccgaaaaccagtgaatacaaggtgttagtgtgtgttgtgtgaaatgtgagcacaagtctaaatgcataatgacctaatgtggcaattaaaatcatctctttgctagatcattacccctcttaatagtacgtcgaaactaaaaataaactagcaaatttgatcgccctacacctcgattaattcaaaacaaaagcactagttttaccgtcttttttccctttactttgcgccgtcaattttaatccatcgataatcatccatgcgcacatatgacgtgaacctaacttaaaatatatagctcaaagacaacggttagtccacaattagtgcttgtcattaattaccaaaattaacaacgggggactagatgcttcacatgcaggacccgctacctcgccacgcgcgcagctgtcccgccatcgaggtcgccgccgtctgccctcgacaaggagaggaatgggcgggcggagaagctcgccggctcgatggggaaagcgtagagaaggagaggagctcgaggtcgaggccgcgtccgagctcgctgttgtcgccttgatccagtgagcctaggccagatctggctgcttagcctggcgtcgtcgccgtcgccgctcgggccaccgctccgcccggcttcaagaggaagacgaggtcgcgtggctcggtcgacagcgacctccgcgaggacgaccgtgccgccgcttgtcgtccgcgaggaagacgaggtcgcgcagcgacctccgcgaggaagaccccgccgagagtccgtcgttgcagagggggtagggggagggaggcgccggtgcggcgtctgtggcatccagcctcgatgatgagaggcaccggcgtcttcgcatccttgcccgccatccttgccccttgccgcttgccgtcctggtttgggaatgcgaggagagaggatagagagagaggggaggagagatgatggatgtgaaaagagagatgggtgggacccactaacatgtattgcttaagacacatgcactgtaaagtgtggttctttacccggttcgttgtctagctggaggctttgagctcctcatgtgcgttacccgcactgtgaccggccttatattagacattttgctcacacatatacagcagacaaagcccaagagcatcatcgattcatcgtcatcccgggatacccatacgagatgggtctcaaacgacccatgggacataaatctcatccagcccaatcccagcccaactcgcgagcccgtcacgtcacgcttcgcacccaccagtccaccttcttcttctcctcctcttccgcaccgcgccagcccgttggcggcctgaaccaccaccaccactcgacggtggctccgacccccgaacgcgctggtncactaccctacccttcccttacatgtncccggccgcgccgctcgccggatctctcccctcctcccttccaggaaccccagccaagcaggtagcgtgtgacgggggaagggggggatggggctctcgtcggcggcggcgggggaggggccgcagctgtgcgtgttcgacctgaggcgggggcagcaggaggggcaggagctcgacaagatcctcttcttccaccccaccgactgccccatcctcctccagctctccgtcatcggcctctgcgaggggatcatcaccttcgctaggtttgcagttttgctccacccccttctcactcgcatccccctcctgttcgtgctgctgcttggctcctcgcgcaggttggagctcttagcttattcggtcggagctttgttgctcgtggaggttagttgtttaggaacgatttgtagcacttagttgcgtggacgagcggaattccaacgaccttgaagctcatgggatttcaggcgaaggggtttatatgggaaaattctggcgtgttgattgtaatcggagttggaggtgaatgaatttggttcatcagggtgagatccttatgggggataattctggcgtgttgattgtaattggagtccgaggtgaatgtatttggttcgttaggatgagatccttcttagatccccatagaacttaacttttatctgcttcgagatagtatagtcagacatactacccgttctgttcttgaatccaaattaggtgcagtttcactgcttgttgctccttatttcagaatccgatttttaaattatttcacaaaattgtagtatatgtaactaggggcaaaatttgcctgttattttaatttttgcttttagttccaaccataagcactttctcgcgactggtgcttctgcacttataccttttgcttttatctgttggcttatctatctaaatattattcctgtgcagaatattttctcctgatgatgattgtgaggtgatagaatcagagaaacactcccatgttttttaccaagctgaagcagatatatggatggttctggtaatggctgttcttacattaacagttcatcactatttgttataaaccaaattgttgtactctagagcctcttcaattgggtgtagttaaaaacagcatgtaacctttgtctgtcacctattgtcattgaacaatatttactggaaatcctgaaaacattcaagaaccaagagtatttctagtctgccaccaaagtaaattctgtaacgagaacatgggcgttcatactcaagcatactatgccttcagtctcgcagatagtataatgaccattttggatttctttatttttaactgaagaagctatgagtttgcttcataacacttgttcctttcccagcaaattgtctgtaaatctttttttgcacttataacttgaatgattatcatactcatttccagtgaaaacttgttcatgcataggtagtggagaaaaacaaggacattgagtcaacttggcggtgtggtgcattgcaaggaattcttaaagaggttcactcgcttttcacaatgttccacggaccaattcgaactttacttgacaggcaacccagtgcagaacttgcccgtggtcaccttcgcacatttttcacagattatttaagtggtgagtctcgtttccattcatattgtgtataacatgagcgcaacattgccctttaaagaaatatacatttggtcttcatgaacatgttcttgagcagattttaatgctggtaaaaagatacaattgccaaccttccgtgattgcctaaaggagcgaggaactgtccaaatgctaacaatctcacgagaagtggcacttgaagttcaggtaggaaatgtactcttcaaacatgaaagacctcctagttacagaaatataactgtagtaccttttgatcttttcagggtacatgatagttgtctcttgcttttataattattgcttgtgtgaaatatgttatttttcttgctagcggcctgttatttatgtcctgtccagagttgtagtctggttttcagattatgagatcggcgttttcttgagggtctagtagtcattttcgaaggtagctaatgatgttataggcttaaaaacggttgctctgttgtacttgtaggagtatgtacttatgcagaagcctgctttccgagggggagaacttttggaatcaactctcacaacttaactacccctagatagctattgtctcactgttatagtgttatgaagctgtgcttaaagtactgtctaaagtcatcttgactctgataattacatagatttgttttctctgtttcaactattgatgcatgaatatttgcagtcactcaccacagttcttgggtcatgtcttggaaatgtcatgtgccaatcacttgtattatttgaagatctcttggtgtccacaacacttccaccggtacggggtctccctttaatcatcacttcttttataactttgttttctttgatggctttgagcagttcccatgtgattaatgtagttttaccactttgtaggatgatacactaaacctatatacttatgctatcttgaggttaactcctcgtgctttattgtccaatgcaacttcctggtcctatctgcggaaaggaacttcggttcatgctggccccacttctagttcatcaaatggaacagcttcagtagaaaggtatcgtagtcgatctcgtgatacttctcctggtggacaaaatcagatgcatcattatttcaggcctctccagcgtgagaaactatacaaaggaaaggatggttttgttgccgctggttccactacttcagaagttcgtggtgctgtggcttgggttcccatactgtggttccagcaggcagaagaccgcatgcatctctgtgtttatcagcacaagaacataaccattctgctactgattccagcttcatctctaataaatggagatgatggcattgctcatgtgaagagacatcttcttgaaaatgtgagtggcccttgcataatttccacccttttcatgatttcttgatgcggtactgagctcaagcaggccatgttgaatgaaaataagaaatattctcatgtctggtgtggcttgcaaaatattgatactgtggttgtgaacacatgctcatttttttatatttatattgcaggcatcacagaacattgtgactctggagctgaaattatcacgaggatggggaggagaaaatgcttatcatgttggtggatatcgctacttactgatgttgatccagatagaaaagtatcaagagnnnnnnnnnnnnnnnnnnnnnnnnnnnnnnnnnnnnnnnnnnn

SEQ ID NO: 24088 - DNA, 1255 bp, Oryza sativa
  unsure (1)..(1255): unsure at all n locations
nnnnnnnnnnnnnnnnnnnnnnnnnnnnnnnnnnnnnnnnnnnnnnnnnnnnnnnnnnagaaatattctcatgtctggtgtggcttgcaaaatattgatactgtggttgtgaacacatgctcatttttttatatttatattgcaggcatcacagaacattgtgactctggagctgaaattatcacgaggatggggaggagaaaatgcttatcatgttggtggatatcgctacttacttgttgatccagatagaaaagtatcaagagcctccccacctgggaaagtcaccaccctctcaaaggtttgttctgttgcatacttgcatatagagtaaacatacgatgtttcctacaatatgtgttaatggttctgttcttctcttcacctcaatatttccataaattttagatcctaaagattgttaatgttggtctgtttttgtagactaatatgttttagatgatcaattcgtatctcctgttcatttcttcctcactattgttcttcggttgcaattttacgtttttgtgttgaattggattgccatgcatttcttttaaccgtgctctgcaatgaaatcatgcaggattctctactttccttgaatagactaagagaagaaatagatttggagaagtcaagggccaagaggtctgactcttgtcatgacaaggattttgaagtatgcatcagagccaaaaataatgcatgggtcattgctaaagttacccgaggaagagaactttatatggcgttagagaaggctggtgaaacacttctttatgcatctactgccatcgagaagtttagcaacaggtatatttactcaataccttgtaaggtcatgttcggtaaatccctaggtggggggaatggaggggatttattccacacctattgtgatgtggaattattccctctcaatcccctccgatcctcttcaatccccatcaaactgaataaggcctaaaggggcagaagcatatcttaccacattatatgaccagctttggtttactgtgaccacttgagttataattccactgtcatgcattaaccgcctaaacgtggtatatctcaatatcttgtaaaggggcagaagcatatcttaccacattatatgaccagctttggttactttgatcacctgagttataatagttccattatcacgcattggcctaaccgcgtaaacannnnnnnnnnnnnnnnnnnnnnnnnnnnnnnnnnnnnnnnnnnnnnnnnnnnnnnnntt

SEQ ID NO: 24089 - DNA, 2747 bp, Oryza sativa
caatccaatccaacgtcaacagagtgtgaccttatgacactgcagaatcggcagccaggaacagttgaggaaatggaacaacaacaaatttggcaatgtctccttactgaaagggaactcgagggaaaccgtggacgccgcacgccggcccggctcgccgccggtcacgccgacatgctccggctgccgtccgtgctgccggagtcggcgttccggcacgcgtcctcgacaatgcgctcgatccgcgcctccacctcggacatggcccgccccccgtcggggtggtgctcggtgcactccatgcccagctgcagcaaacgcatcatctccccctcggtgcgcgcctcgttgccgatggcggcgtcgaacacctccgacgtccactcctcctgcaccaccgaccgcatccaccgcggcaggtcgacggcggcgccgccgtccggcgtcgcgtcgagcggcggccggccgctgagcagctcgagcagcagcacgccgaagctgtacacgtcggcgctctgcgacacgcgccgcgcgtcgaccacctccggcgcgcggtaccccgcgccccgcttcgtagtcggcggcgccgccgcgccgccgacgagctgggccaggccgtagtcggtgacgtaggcggcgtcccgtgtcgcggtgacgacgacgttggacgacttgatgtcgccgtgcgatgagattggccctccgcggtggatgaacgccacgccgcgcgccaccgccagcgcgatgcgcgcccgcgccgcgaagtccagcttctcgccgttgcctacataaacatcaatcaaatcttatatgaagttactattcaggaaacgtattgactccaactttaaacacaactacaaaagtgtgacatgaaaaaaaatactccctccatcataaaatataataatttttagccttcagaatttattctaaaatttataacaacttttctaccaacattttcttcacaaccaatcacaaccctccaccattcatttttctcacctacctcaactactcatccaatcacaaccctccaccacttacttatacctactttcttaataaccgtgtccaaccttaaaacttcttatattctggaacggatggagtactaaatactatgtgacggagcataaagacagcggccatatggatatttatcaacttcatgtgcagatttacaaatagatttgaataaatgtttgtctttattttgtgttagggttattagttattgtttactacttatttttctggtttatatatgctctctattgagtgaaataataagagccctttgaatcgcaggaatgaaaaaaaaataggaaatgtgcatgattttaataggaaggtaaatacaaaacaaatgattgcaaaatataagaaaaatataggaataaccgtttgattggactcataaaaaatacaggaatgggatgagagatatagactcaaaagaaaaatttttaagaggttagagctcttactaaatttcctccaaaatccatataagattgtccattccatagaagtttcaaagaataagatagggttcaatcatttatttcaaataccttcatggaaattttttttatagaattaaaatcctccaaaattcttatgtttttccgccaaacccataatctctttataagcaaaagaccgtgtttctttcgctgcacgaagagaagtgagaaggcgaggtgatgtgatgaacgaaccgtggaggagggcggcgaggctgcctgcgccgacgacgaactcgtagacgaggagcttctcctccctgctgtagaagtaggcgaggaggcgcggcaggctgtcgtggctgacggcgccgatggccgcgacgcggtcccggaactcgcgctccgagaggctcacctcgcgcagccgcttcacggcgagcaccggctcgccgccgtcgagcgtcgcgcggtacgtcgtcccagccgcgcccttgccgaccacctcggccgacgcgcgcagcagcgtgtccaggtcgtacggccgctccggcgcgccgccgacgaacaccagcttggtgctgccttcgcccggcggcggcggcgagtgcgactgcttgacggcggcgtccatgtccgtcctcgccacggtcaccgtgatgggctccgccacgtcgtgggcggccgccgcggcggcggtgctccgactccgtggcgccgtcgcccggcgccggaagcacgccaagaaccccacggtgagcgcgacgacgagcgcggccacggcgccgaggacgatgccgatgatcgcgccacgggagagctttccgccgcccttgctgtccccgggcggcgactgcggcgtctgcgaggggttggcgcacggggcgagcggggcgccgcagagcgacgtgccgaggaaggcgctcgccggcatcccggcgagcgacgccggcacggcgccaccgagctggccattgtacgacacgttgaaccgcgcgaggttcggcagcgtcaggttaccggggagcgtgccatcgaagccgttgcggtcgaggttcagcgtggtcaggctcgcgagccggctgaactccggcgagacgccgccggtgaggcggttcccggagaggtccaccttctcgagcagcgccagcgagaagagcccctccggcaacccgccggcgagccggttcccggagaggttcagcgaccggagctggacgcagccgcccatgtccgcggggatcccgccggatatcgagttcatccggagcgaca

SEQ ID NO: 24090 - DNA, 7475 bp, Oryza sativa
gtttctccatttggaagagctcggtttttgtccagctcgattgatcgccatgcgcgcagctggcatgcacacgcatagcatcgtggacgacaacgtcgtcgggtggtgaggtgaaagaactgaggcggcgggtttggaagtcaccgagcgagcggcggcgaggaagagcgacgccgtcaatggcgccggcgacggccgcccggccggcgagcagattgggccgaacatagcatgctgaaataagcccattgatttgatgtgactgcccaaacgtagcattaggcccatgataattaatacagtactccgtattaaatttccaaatttgaggttgcccatttttttctttagtgaaatggaacagtaagacaattaactttgttgccgcaacgcgatcaatgtttgttgatatgcatttcacaaatggttaccaagccaaacatgtgggttttttttgtttgttttttttaacatgtttgattcagattattgagtaatagaattatacaaaacacaatactgagtagaagaaagttttctgataaaatgtatttttccgaatcgaggagcaaacaatccatttcaattatctaaataatccgaaaggaacgaggactttaccgttgagctgtcgtgtattcatgtggttcctaaagcaaacattaaaattcctcgtaagtagtagtagtattagtatgtctgcatgcataaacaataggaatggaaagataccgctaaaagtttttccgaatgtgaaaacaataagtatcttttttaaaaaatagaatgataagtaaattaaaatggagggagtactttctgaaagttccttatgcccccaagtcttcacttcatcctctttcatgcatatgagtttttgccttattcatgtatgtctttgtttttctttataataattacatcttgggccaaagatttttttttacccaagtttcaccttcaaactactctcgatataattgtcaacgggggatacatgtagatcgtattctgaggtattagggtacgttggtacgaggatttatacgaaacgatatcaagcacacagaaaacaatgattatattagttcagacccctcgtaaggtaatagtcccaatcttgtttatatgggattatgaagaaaaccacagagattataatagagaaccacagaaccatcgagttactgagttcacccctgtcgagaatgacccgacgagatcaatcaacgagttggctttaagtccttcggattgcttctgctatggctagtggcaaaggtatgattcgatgatcccgtaccccctgggagccttgtatttatacccttaaatgtcttggtttccaaatagaactcaaagagtaccttacacgtacgagatcacactcctccaaataagactctaacacattatattcggggagtcagtttccttatacatcagcctattttaaggtaacattcccgtatacttgaggatataccatattcgtataccgcgtaacccccaggataggaggtatgtcttatccgtaaccctaacactaatgttttcacttcaagacaggtattttacctattttacactttagaccaccgtcacaccatctctctctcccttctccacctcatgttctccaccgccccacctgttattgctggtttgccacctcccccgagctcaagctcaacatttgactctggtgtccccaatattaagctcagtctcttccttgtaggaagacaacggtggggagctcaagctcgacaacgaggacctctacaagctcattgttgccttgttacctcagcttcattctaaatatcaatgtccggagtaaggaaaaactacctccttccttcttcttgtcctccatgaaaccattgatgccatccttttccctagatctaactgaccagagttggggacgactgccactaccccgcttttacttcttcatggggattgccgatgcagttgcactactttgccctccagctctgctccatgaggagagggagatcaacggcatcgacaagacccaaaacttgatattcacttgcaacaccagaaacttgagcatcatcaagaccatgagctcgatctctatcatcgcctatgctctcatggctcccaagcttgacctcctcctcctccaatttcacttgatccagtggcgtttgtggtcgaggtgctaagaggcatgatggagaaatgggattgggaggaagaatgtcgcggttcaagagaaaaggagcacacagacgccttgtcaatcaaggtccgaatggtggtggtagggaaccagaggtggagaagagatagatggagagagggtggtccaaagtgcaaaaggggataaatataccatggtaaagaaaatggggacaaatatacatggctttcaatgaaaatattagatatgggtagtcttagtgaaagtttggtaaaaatcttactcccaaaccacaatttactccatttcttttgatcgctctattcccattccatttgttgactatgagctgattgttagattttttttttacgttgactacattgtacttgttggtcataagtaagtgcttgcttaaaaagcataattgtcatgtgaacaaatttcaacaagaaaattgaaagtgaaatagtaattagttgaccccggatttaaaaattcttatatgaaatttgataaatagttttagactaaattttacgaaatattaaaggatagtttcactctactctttccaaagaaatttaaagtaggttcaattttacttattttttaaaaaatacaaattttatttatgagtggaagataggaaaaatggtgatccgtgtaatttcccttttaaaatttcaccaaatttggttgcaattcactagaaaaatttaaattttggttttcaaaatttggaattttggccccttaaattgttgtataattgaagcttttcaccttgataaattttataaaattacatatattttgatcaaactattacaaaataatatactttaaagtggtgtatcataaaactatagatttatgactgaatttatataaaaaaaactacatatttaagatgaaattatcccagaactatatggtttgcacaaagtacagtacaaaactacaacatttgtaactacttaacataatagtatgtagtcgtagggatttaaattgtaaaacctatagttttgtgatgactgtagtattaaaattgtagttttgtgatacttggcattaaatatgtagctttgtgataaatcttgcgttaaatctatagttttacgatacaatatcttaaatatgcagttttacaataatttaattaaagtacagttttgtaaaattactcctacatatttataacaaggtacacacaacttttactactatataatagcaggagacaatataatcattttatttttaaaatgacattcacgtatagtgattggtttggtcggaaatacatgacgtcataactgctaaccacaattccctcgtaccatcacatggcaaacacgcgcgaaatctgacacgcgaaatagtacgaccgtgacgcgccacagctctccccctatccgatccgacgaccagcattgagcgcgctccccctgccacgtcaccgatccgcgtactctctcctcattggctgcctcctcctatataggattactccccctcccgcttccacccccaacccaatccactccactccaccgccgctcgctcgccgccgccgccgcgtcgtcgtcgtctccggcctccgcttcctcgccgacggaatcctagcttagccatggctggtaggggcaaggcgatcggctcgagcgccgccaagaaggccacgtcgcggagctccaaggccgggctccagttccccgtcggcaggatcgcccgcttcctcaaggccggcaagtacgccgagcgcgtcggcgccggcgcccccgtctacctcgccgccgtcctcgagtacctcgccgccgaggtacgccacgcatggacgcactcgaattcgtggtcggattggattggatggatgaattcgggctgaatttcgtttggggatttttgaattctcgcaggttcttgagctcgccgggaacgcggcgcgggacaacaagaagacgcggatcgtgccgaggcacatccagctcgccgtgcgcaacgacgaggagctgtcgcgcctgctcggcgccgtcaccatcgccaacggcggcgtcatgcccaacatccacaacctgctcctccccaagaaggccggctccagcgccaaggccgccgccgccgacgacgagtagagacgaacacagattcctcactatgacgaacactacatgcttccttccgccgatggattagacaataggcatcctgcttaatttagtttttaattgtgcttgtttcgtagacaagggattagttgctctgtaattggtgttaatttatatgaaatagtgtcatctttctcgatgacttttgtcaaaagaaattctctccgggtgttcagattttccaggttgatttgaatgcgttgtctataaatcgtggtaaatgtttcttgatttttttaactcttgggactttttttttttgaaacaacaactcttgggaaattgggttgttgtcaaacgtcgcgtctggtttttctagagttcgtgcgttctcagcgtggtattcaaattgagacttgatttggttctcaaaattgttggatctagcgcaggatttggtttgaaattgagcattggcgcgggcgggcagctttgaaattcatgtgatttcaaacagtgccaaggcgggaagacgaaaatttccgccaagaaagaaacggcttaacggcaggaaagagagagagagagagagggggatggggaaaatgaaagttgaaaataattttaaaccagctccttgcaagtggaagcagcctctatacattaacatgtgggtcccacttgctttgggcccacatgtccgtgacaccgcctgcacgttcagtatcccattcccatgaaaggtacacatacggctcattagagtagggaaaacaggagggtcataagtcaattactatgagcttctattgaggtgatagatacaaaaaaatatatggtgttgaatttttatgtaatactatctccgtcccaaaataagcgcagtcatacgtttccgcgtccaactttgatcgtccgtcttatttgaaatttttttataattagtatttttgttgttatgagataataaaatatgaatagtactttactcgtgacttatgtttttaattttttttaaaaaaaattcaaataagacgaacggttaaagttggacgcggaaaactatagctccacttattttgagacggatggagtagctagctctacacatggtttaatatggatatattaatttcatagtgagataaagagagaaaacaataaaactaatctattatatatatattagctatagtataaatttatacggggtagttgttctgctattaaacttgctactacgagaggattaggctgctgcagtttaccacctgacttcacacagagtacatactttcttcgtctaaaacaaaccaacctcgtattaggatgtgacagcgaatctgaatatactctatatccaaatttattgtattaggatgtgtcatatcttactactagatttttttgggcggatggagtacatacgtacatggtatcgacaagggtttaccatccaccctaaggccccgtttgttttctccattgggaaagatttttcagcgcatacgtagtgagaaaacttattagtacatgattaattaaatattaactattactaacttatttgaatcttataaacaacttttatataaaaattattgaattctagttaatttatgacatattgattagtatattagtgagtaattagataattagtgtgtattagacgcagatgttttttttgttgtggattcgccgctacgttcatccttgtttcttttatgatatctaatgttttctattaacaagatgttatcatgacagtactaacgcagtatgaatctgtgatatatacacttaaattaacatgaaactaattaatcgctgatactcgagatggaaatgaagttcaagcagaaactaattagatcaaagttctgacgtggactctcctctcgcactagtgttgtcacattccaattcggtggttggagattaaaagagatggttagagtggatggccgcatgcaccggttgctgaatatctatatgcttaattagtgagaaaaaacgtggttttccttttgatttgtgcagtcgtttgttgttgctttgccgcttccatctagtgatggtcagcacatatatgctctgcacgtatgtagctgttcttttctcccgaagacttaaggaagattatgttttttacgtaaaacgagatggtattaacgtatgattaattgagttttaattattacaaacttgaaaaataaattaataggatattttagagcaacttttatatagaaagttttcgcacgaaacacaccgtttagtagtttgaaaagcgtctcacgaaaatcttaaacttaatccaactcttgttagagtagtcataatcttgcattaggtgaaaagttggaggctaatccatataaaaaaagtttgtagttctttgattttgccaaagtgtcaatgcgtcataagtttgatatatttcagtgaacggcatcatatataagttgatatttattgaggtcagtggcgattaacaaagcaacagtgtacgtatgaggtctgtaatttcacttggtggttatatttgttgttgaactttggagtaattctgaggtagaagtagagcggtagatcgatgaacccaaaccagaaatagtcaaaaaggaaaaaaaaagagaagctttgcaaaaggcaaaatttactttgagatattcttggttaagttcgtggcatttgctattggatactctcgttttgtggatttgtcataggacattctagttttacagttgtttgataaaaatacactttgaccattattttagtggatttaatatattctcttccaatggagctataaaactgcaaaataaaagtttagctgaatttaaatatattatgcaaattcaaaacttgtccaaagttgtggaaacgagaattgccaaagattttttaaaaatcgaacaaagaaacaaatttgaacaaatattggttgcatttaaataaatatttgtaaaatgtttttatttctgtaatttgagacaatttttgaattttgcaaaatatgtttagatccagtcaatatttgttcaaaattacatcttgcaaggtgacctaacgataaaatcatcttttcttcatttaaagatgatatattgaaataatggtccaaatgtctcttactacctcccaagaaaggtattaggactgagagagta

SEQ ID NO: 24091 - DNA, 4332 bp, Oryza sativa
  unsure (1)..(4332): unsure at all n locations
ggagtagcaaagcacatgtcaagattgttgatgctggctactactgctacaatggaggaggagatgctggaggagcaaggtgaaagcaggagagtggtcaggttggagcaagaggtgctgatccacatccaggtcaggaggatcaacaggaggatgagaaggccagggggcttctccagaggctgcagctgctggagatgaggcccaccgccaccgccgtcatcggtttccgcgagctggcgcgccctccctcgccgtcgccgctacgccgcgccggtcaggccatctccgttggagattgagggggggggggggggggcatttttctttcccttgatcaatgtggggtaaatatgtaggagagttcaaagtgtttaaggttttcagttaatgtgatccatccatggattggcataactggatgagttctcttccttcgtgctgaaaatacaatggagccgcttaaattgccaggttgctattgggacggtttccctctcggatccttccttggccggaatagcttcacataagaatgcagaggtcacatcagcaagcaaagcggatgaagcaaagagggaggattagccactcaaactttgtataatccatagacagcagattggaccagaaaacatggattatgtcatgctaaccattggatggatgacaaaccgatgaatcgtgtcattccagtaaacaacaaagtgaatattttttccttggtgttgccgacaaggtagactagtgaaagatcccatctaccagattagaagtcagcatcaacattggagaagaaaaatcatactagcaattactactacctgataaagaaaactattgccgttaaaggacatccaagacttgggataatatagactaaactacgtaacttctacggatgatgatgagtcataaaatcccaggatttacttttgtttgggaagcttaacacgacaatctcaagagcaagcagcaccaaaaaaaagaaaaaaaaaacctagggttgcaaatcccagataatcactacacaccacagttgcgtcttcttcaaacttctagaggcagagtttgtttttgcaaacctaagcagaaagttctctgcttccaggagtactacagctcaatcgggctaacctatcataacgataatcttgcaacagatgcttatagagcagttgtgacaaaatggctgccaccaccgttaggtctgcagcgatcagtcggtcttcattgcctcagcatgataagtttccaggtctttgtccagctcatctgcagtcttcccagcttgcctccttccgcgaccacggccctggaattgaccacggcccctgacactgccagtgccacggccctggaactgggactggaatggggcacgacccctgccacggcctcggccccggccagcttggaaggcaccacggttatatctattactggaatggcaagttcaggtgacagatcagcaaaaagatcaataaagtttcaacacatttgtggtgtttttcagtttggttgtgtcaactagggaaaaacacaagcaagatgaaattgtcaccaaccaccgccaaaagtgagaataactagtagaaaacaaccttattttcttctttgtatgtcacaaatgcatacagtatccatgactaaactaggaaaaattgtagtatagcaggaacaggtggaaacatgattaatttatgctagacatgtagtataaaatgtaaacctgaaactctgcacattacatgcttcttattaaaaacaagaagaaattggttacaataataaccaaatggcagttgctttactgtagatcatgatgcttttaaaataaccaagcaaaatgatgtggtcactattcgctactagtaccagataagtaacagaataaattacacagctaagaaaatgatactgtgagaagccttacactgtaggacctgttggtctactgctggaaccactgccacgctggccaatttcaggcctgaaatatatttatttttgttgagatttatagaaaaataaggtagattgactgaatggttgataggtatatagctttaaaggctcagagaaaaatgaaaacaacaaaagcccaacatagcacattttcaaactggagttaaatttcacaagttatcaattgacttgcaacacacaactgctaacgaacgtgacgaaacatatttatcagttgaacttttatccgttttcagactatagtccttcctaaatatggctagctcattagaatatttcacacaatactagaatctgctaagtaaacagctcatattggcagtgacaagttaaattagcacatatactggcccaacaagaagtttacttaaaaatattacaactcatcaaacaaattatcagcctctaaagtaacacatgaacagaagcttgtagacatgccatattgttagcagaaaaaagaaagaagagtttatctgcaagcaattaggagttctgatagcccagtattcaatatttaacttgggacatacagactgcattgtgatgtgtgatccagcttaggttccaggtatgtcattttctttttgtccttggaagctaaataagaaattgagatacatagaaatggaaggattactcacgtcataacaactgttcttgtaggtctgccattagaagccccaaccacatttatgcgaggtgtcataggcaaacctaagtcacttccaataacttctatcttcatagctttaccatcaagcagaacattattgtaacgtttcaatgcagcaattgcatcacttctcctagtaaacaccacttctgctgtgccctgcagaaatttaacaaaaaaagatattagcacaataatcgaggcaagaggcagttagcaaaagtttcagtgatcacaaaagttcatttatcattttctttttgcagaataagcaccgcaaatggacactgtttacatgctgttaatttgctaggccagctaattagtacataagattgtgtatatataaatttttttgaccagaaaacagagagggaggtccccacgctatatatagtacataattattacaacaaatacatgtattttgcaaatgtactctaagcagatcaccattttatggagtttcaaccagaaaagctcagcaaagttcaatgtgtgaaagaataagaaagacataatccctacatatatattactaaaaacaaacatttcctatgtttgtcttcttgctgttatctcaaacgcaagataatcactaagatacatattatcctattgttgttttattgttcttggtaaatctaatgcaaggcataaatctgtgcactggaagttttcatccataagacaaggtataattatacttcatatgtgatcatctagagcaaactgaaagtactgagtgggaagatgacaaggtgtgtatggtttcccttgaaacaatgcaaattggttcaccgaagaaaaacatcactttgagtttacatataatacctaattgaaatcaaaatatgctctatttgtaaatatgataagaagtacaaacatttggcgcccataaccatcaaagtgaacagcaaagcgcttcaagtgaccaacttctgaaaacagctcctacaaggcgaattgaaaatgttagcctgtcaactctatatccaacaagaatagtgaaaagaaatatcccaaaaaattaattagtctaacaaacctttatatcctcattggaaaccccatagtccaagtttgaaatgtacaattttgtaccagtttcaattccactagctgccatactatcactaaacagatcaggtctccaggtcatgtctttggttctgctaaaagactgaaaatggccaaacatccagcatgtgagaaaatgtgtcatcacagaagcatatcacctcaaactgttctgtatgatcatggcaactatcattagtaatatcaatctttatggtagagcagaaataagcagcttgactatgaaaatgctgcattaacttaaaatggagaggaagagagttccacaaatatcacaagtggagtagataaatggctagagcattttctctggagacatcctagaagcacttcaccatagcagatcccaaagctgtcagatgagagctgcattgaagttccaggtattgcacaaggatcaatgaagatccttccttcggcaccacatgcagattatatattgaattgcaagaataccacaaacttctttttttttcttttcatttggttcgatccatatgtgtgannnnnnnnnnnnnnnnnnnnnnnnnnnnnnnnnnnnnnnnnnnnnnnnnnnnnnnnnn

SEQ ID NO: 24092 - DNA, 900 bp, Oryza sativa
aacttctgcccctccacattgtacaaaatcttagagatgctctctcttcattcattcagtaatttatttttttttagcgtattcaggagaaatctgaccatgaacaaaaacacagcgtcagtttcggtggccttgccttagcaatagtgcgcgctgatggccgcgagttaaccccgaggccaaggggccctcgaggaggcatccctgatcttccacgcagcacatatccacctctcccaccaccacctccaccacctccaccaccttgaacacggccaccaccactaaccctatccccacccctcctggcgtaatacgccataatcccaaactcgcttcggtcagatcagattaacacggttcttctccttcttctccaacaatcaaacgatgaaaaacctgcaacattacaaggctcgatcagggggggaggcgcgaggcgcgaggcgaagagaggaacctcttccagatctagaagaagagaggggggtaggattagggcaaagagagaaggtgcggtgcggtgcggtgcggtgcgatgcgatgcgatactcaccggcgttgcgaggatgcggagtaggaagcagcaggacgccggcggctgctcgccgctgctcggccgtgcggaggcggaggcggcgcggcggcggaaacgtgaggagaggaggagatgtagtagagaaggaagcaaaggtggagtcaatgaagaggataattgcgctgggctatttgtttagcggtatgggctttcatgtgggccggtctgagtcgagtacggcccagcccggctgaaacggaatcgagaaggtgaacctcataggaataagcttatatcggaaaggaaaaagtacaccgaaggtccctcaacttgtcatcaggataaagaaagtactcgaaccg

SEQ ID NO: 24093 - DNA, 2747 bp, Oryza sativa
caccgaaggtccctcaacttgtcatcaggataaaaaaagtactcgaaccgtaaaaccagatatgtggggtcccttaaataacaaaaccggacacccaagatccttcggtggttttgaccccggttttggtctacgtggtggctaagtcagtgtgggacccacgtgggccccacatgtcaacatgccacgtcatcactccctctttctttttcccctcctctccctttctcccatctctctatctctttctctctctcttttcttctgcaagctggccagtgaatggggaggaggtcgccggggcgacgaggtggcggcggtggctgcgacgcgggagcaggccaccacgccgggttagattcttgcaccggccaaactctcccgggatggtgctggtgaaccggttcccgaacagctgaagaaacttcgccggtgaaccggtgaggttgttgacgtccaaaccgagagcccacatagccgagcagttgtagaggcggctcgggatgccgccaccgcaactaccatcccactgtgcaagccgagccatcgccctttccaccgcttccggccgctccccgccggcgacacaggcctcgctcggctgtgctgccgccaccctcagcaccgccacgctccaccgctcctcggcgtccactcctcttcgccgaatacccaccggagtcccaaccacctcgcgttccggtgagttccgccccgagttccatcgccggcgttgttttcccaccgcttcggtcgcccgttttcctccctaacccatccaatctcttcctcaggtctcgccgatcctcggcctcccctcctcctgtgccggacgccgccaaatcgtcgtcgtcgtcctcgcccgagggacgccgccgcctcctcgcctccctccgtcggccacctctccccgccgtcagccgcttggtgagcatccctcctttcctccccgctcccttccatcgcttgtcggccgccgcttccggtgaggacctctcctccctccccttttttcccgtcctcctttcttgccggccaccacctcttggggtgcgccgccgtcccccgtgcgcgccgttgtcctccgcccgcccgccgccgttccgcatcgccggctgccgccgccgccgcaccttggctcggccgggccggctttgtgccgcgccagtggccctggccgctgctctcccctcgggtcgacctgggtcgtccacgtggtggacatgtgcccgaggccgtggtggaccgtgtccaccgtgcgcccttccccttgtgccgctgacatgtgggacccgcctgtcggcgccggttccccttgctgacgtccgcgaatgccttttcctttgagaaaataattattaattgcgtcataaatcggtaataattctagaaattcattaaaacggctcaaaacttctaaaatttatgtctaattcatacgaactccgaattgagccattcaagttgcaaaattcatctaaaattgggatctacatgtttttttactttttatgtactatttccttggtttttattagtgtttttcctcgttttgcacgccaacgagtagattccgccatttcggaagtctgcggtcgcaaagataagagttcagaagatccaagtaaagaagcaagggaagtcacacatttccccttgagcatgttgatcccaatttacaaatgttttaccgtttgcaaataaatatgcatgttttgctaattacatgggatcagggtttacctatctgctcgcttgtgccatgtttacttgatatctgtcatttgtcaatcgtgggtaataaatcgactagctcatgttacttatgtgacacatctagaactatatgcttagccatgcttaattgccactagctcagttgatgggataattacagttttagacctgttagtatcatgacgagccgcgtgctcgagacacccgaccatgttgcattggtcgtaattatctatctaaaatgcaactgaatggtgggctgtgggtgcatggttttgcgagtcgcacccatggcaattaagaccagtttacgggaaaccctggaagacttacagtgcttgccacaagcgggaatgggtaactgcctgatctgaagtatagctcgaccctttcctaggcaccggtggcgagggtgggcgtgatggagttgggtcggccggggtgtccaattgtccagctgccggattcaccgcggtgcacgaggggactgcctgctgccttgtgaggagtgggggtgaaaccttagcgtggtgtggatggttaggggagagttatatgaagggtcttgtcacaatcactcgacgtggtgacgtgttcatcatgggcacatgatgacacggtgacatgtcggtggattgtgtcttgtgcgtacagttatgcacctctggctagagtaaaactattcgaatagccgtgcccgcggttatgggcgatcgagcagattcaccgtgattagtctcacccctgataaatcgacccaatgcactgtagttcaggtgggttggttgggcctgttcaacgtggtgtagcattgatcaatggagatttaatattaccttaattactcaactgtcttactgttttgcgcaataaatgttttacaaccgcctttatgcaaatagccacaagccattcttgaattcccttgcatgtctgcattgttggtgtggcttgctgagtacagtggttgtactcagccttgctattatttcccccttttcagaagtgta

SEQ ID NO: 24094 - DNA, 3229 bp, Oryza sativa
  unsure (1)..(3229): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagaccccagttgagttttgcgtgtggagtggagctgaagcctcgttaggatcgcctttttccgctgcttctactttcgtttcagtgtgaggactaagtgcctcttctgtaagtattttacgctttatttatgtttgaaactgtatattacttgtcgctttatttacgtttggaactgtatattacttgtcgttttgtgtaccctggctggtactggacagggatttaatacacaaaatagtctggaaatttgggttaaatttctgggcgtgacactggtgttggcccatgtcagtccgacccgaccgtcgggccgtgtctgggcctcggcctcggcacagtgggccgacccagcatggcatagtccaagaaaaaaaagtctattttgcctccctcggcttttcctcttagttgagtctcatccccttgttgacaacataaatgttattcaatacacaataaatcaattacggtctttctatttgagtaaaaatataataaaacttataaaatccataactaactcatatgtactctgtttaactccattcaaaatgcagaaaattcataaaaataccccaaatccattcaaaatcctagtaggcttttcgctgacacactatatacttcatcttgagcaaattttgtaaatttttattatatatatagtttcatcctattgtgcatatgaaagaggattagctcttagattttttatgaactggacccatgttaagaaccttattcatattagctaatcttcagtgtgaaatcgttatcatctagtgagtaatgtctattcgctattgctagctcatgcacgcgatgaagtttccaaatacagacaatattaaaggctgacagatatgctagctatttgcacattagccaccgtttttatcaggcaaacattaacttgcatttattcgtttgatattctcgaatgtgtaaaataatttctttccataatctagtgattgttgcgatatgatcttccattataaaaccaccatattcccctttctttgaactcatatcaatctaaccatttcccatcaatccataggtgcagtcttgctagaaagtggtgaatcgtgaaggccatggctcgcaacaaggtgaagttgcagcggatcatcaatgatgcgaagtggcgggcggcattcaagaagcggctcaagggctagaagaagaaggcaagcgagttgtcgacactatgtagtgtggatacatgcctcatggtgtatggtgagggcgaggtgcaagcaacagaggtttggctgtcggtgcaggaggcgacgagggttcttgagcgcttcaaggccatgccacagctagacagatacaagaagacgatggatctggatggcttcatcaaggagcgcaccgacaagctccaagaaaagttgcacaaggtaagacgtgatgccgatgaaagcgagaccaagatactcatcgttgaagccttctatagccgctgcgcaggcctcgaggatcttaccattgagcagcttaccagccttggctggatggcagatgcacaactcaagatcgtcaacaactcagtctatccgtaaccgtgccactgaaattttacaaaattagaaccatgccactgtcgtcacgttttccgtcaatttccttccttttccaccttcttccttctttctcctgtcttcttccttctttctgccatagcgaggttgagcgcgtttgcgattagcacggtgtccacacggcttcccgcgtcagtgcagccagcgtcggccgtagcgacatcactattcccgccatcgtggcggtggcgtgcccgcccgcgcagagccccatcttcggggccgagagccccatctcgtggcatctttcccttctctctctcttccccgtcgcatggttagcgggaggcgcggcgaagcgcgtggtgccggtgtccaagtgaggcggcatctcggacctcatttcccccctctctctgtccccaccccttgggtctgatcactctgcgtcgaggagctgtcgggtccaaagctagtgccagggtcggccgctgaagccttgggggggggggggggtcctcatcgtcgcaggctagctccggccgctgtctcacctccttctcctccatctagcgggctccagcaccagcgccttgcctcctccactgccgccggtgctagcaagccggctctcccgctcccgccgccgatccgtgcgtccccaccttgccgtcgcgatctttttaactaggaaacctccacatcatttagcgatatttagatcatacatgttgcctgcggaaaacgtgagacattaattaggagatcatatgctctatcgtgtgttacctttatccgttataacgcacggacatttttgctatattcattatattaaaagttaaagcaatttatcaagtactacctctgttctataaaagttgaatttatagggaatcaaggatagaaaaacaatcataataaccttattatttaatgaatacagtgcacgcacacattctatatataaacttaattaacatgaaggttgagacttagagaagggatggaaggaagggagattaaaaggaaatatttttttatgtaatcaatttgctgggtcccacattagtagaaatacaattttagatagaaattcaaattttatgaaacggaggtagtaaattaatgtgggaaataaactttccttttaaaatcatggctgagaatattttcctaatattcttcattccctaatatactctataattttccttaaactttcatagtaaaaaacaaaggaataagttcaccggaggtccctcaacttaacagcgagaatttttgaggtcccttaaccacaaaaccagaaatgtttacctctaaactcacacaaaccgtgcactcaagatcctatagcagtatatatggctggtttcgctgacgtggcatcctagtcagaaaaaaaattaaaaaatgtacgtgaggcccacatgtcagttgcacatctcttctcttctagttttatttcctc

SEQ ID NO: 24095 - DNA, 1880 bp, Oryza sativa
cctcgccggaagcatgcatgctatttgtatgtatgtatgtatgtatgtaagctcgctaatggccaggtgattagcgagcttaggaaatgggctcagcaaacaccacctcatcctggaaggcaaccatccatcatcataagaagtcaatactgccctggtccatctcctcgtggaaggcaacctcgcccgcccgcagcacccctgtgtccccatcacctggccgatctgcttaggagcatcgtcaaccaacgcctacgtcggacttccatggcagctagcacagccatcctcggcgccagtacgatgtacgccatcaactcatcatcagacgccagtcgccgacgatgctacctccacggtgccaccacgttgtcaagacgccggatgtcctcgcatgtgcggcagctgcaacaacaagagcacggcgacggcgatggtgcctccgcccctggccacctctgccgcccacggcctgccgactccccccccccccgcgcgccccgcccagcgctcccgccgccgacgacgccctccccttctcttgcgtcaccggccggcgccgccggcatccgaacctctcgtgacccgtggcccgtggctccatgcacgcccgccactccgctgccgtgctcgcccaccgatgctctgcccggcggtgctccaccggtgaagaggagaagaagagaagtgaagaggaggagaaaagagaagaaaacatatgtgaagctgacatgtgggccctacgtacttttaaattttttttctgactaggatggcacgtcagcgaaaccactcacatatactgccatagtaacttgagtgcacggtttatgtaagtttaggggtaaacatttctggtttggaattaagggacctcaaaaaatctcgctgttaagttgagggacctccggtgaacttatttcaaaaacaaaaggagagagaagcaaggtccatcgcttgggccgacgtcctcccccctttccttcttacttgggccgacgctcccgcacggcccaaggccgcgctagcccatccccatgccgaaccagctagcccaaggccacgccagcccagcttgcccgcgcccctccttcagtccagcccactcgtcaattttgtccccctcctctagcctagtccactccctcggcccgtagagtaaaacagaatgccaaattagtgcacgattaaggccctatttctttcatgttaggattattataatctagattattgagagtaaactgaaagaaacagataatttattaaagtagcttattataatctggatcccagcttattataatccgataagctcatttatgtgagctttttccatattattgggtgaaaaattacccaccatgccaccccactccttctttaaacttgtaaacccaataatctagactctaataatctaggaaagaaacaactaaccgcctattctactacatattatagcttatagtaatctgactcaataatctagattataataatcccaagctaaaagaaacagggtctaaaccagaatgtcagattagcgcacgattaactaaatattagcttaaaaactcataatataaattaatatgatttttaatgaaacttttatatagaaaatttttttgggaaaaacgattgaattccattagccgataggcgaaaccgaatttttttttttactaggagagcattgcaggcgaaaccaaacttggctttggtttttcctccctctcgaaggaagcattcctcgccactctctctccatatgctgcccgccaccgccaccgcctccgccgcgccgccgccgccgccgccgttgccggcgtcccccggcggcgagccgcacgccgccctgctcctgtccctggcct

SEQ ID NO: 24096 - DNA, 3469 bp, Oryza sativa
  unsure (1)..(3469): unsure at all n locations
taaatataggtcaatgtgacattaataatattttttgttcgtactaaatgtaatagtaaaaaatagtcttagtgtcttatagccaaccctttagtgaaagatgtgctagagcaacaattttccattttgctgttcttggacagtgtgatctcattacccattaaaatattattattttttgggtgtcctagtattggtatacaagttagcaagcgagtcttcataaagttactccatactatggttttggccactgcttccaactttaggcttatatataccactcagtgtgctacatggtacatactgtgtaagtgaaataaagggttccgagatcctattttatgagccttttttatcacagattcctgcactttggaattgggataaagcaggtgccagatgaatagaaatcgatgcctaatacacataagaaaccatagataaataataccagacacagaacattcccattgaattgacaccacgaaataataagaatttcagtttgatcccatgggtataacagtacaaacatctgattgaattattgcctaaggctttaagatggtaacactgatcctacacaatcttgggtaaccacctcacgtattttatacatggttgtttgatgttcttgctgattaaacttgattttaacaaattttttgtgatctcagacattctgaatgtttcatgtatgcacaagatgcatctcattgtgcagtatgtttttggaattcacacgaaacagttaaactagtgcgggaaactggaaaagttattgggttccaaggctccgagcagggaaaagttcttgatttaggactctttgttaaaagatggaataaatggcacaccatgctgggtttctcttactcactttcgctggggttgagatttctctatacgtcttgggttgactcactaaccttgctaactgcaatagctactgggattagggagtcaacagtatctattgtaattttgaatttaatacatcaaatctgcagtggattgattgtatccttgagagatttttccttggatatacaaccatgtacaccacataatactggaaaagaatgtttatcttgtcaagaaaaatatggaacaattagggcactgcagtatttgtgaataataatgtataggtcttcaactttgaggttgccgtattatttcccttagccacctgtttggggataatatgagatacatttgccttggactttggatgtaccaaaccttatatggtaaaatgtggtgcagttggtcaatactcaatacttactgctccctccgtcctagaatataaggatttttagggttggacacgggtattaagaaagtaggtagaattaaatagaagaaggttgtgattggttgagaagtggaggtaggtgagaaaattgaatggtggaggattgtgattggttgagaagagaatgttggtgaagaagttgttatattttgggacggagggagtactctctaatctacatcaccctttgttctttaatcaatgaaagattctcagtatggagtctagtacgctactgaaggacaccatgatctcaactagggctaaaatttacaaggttagttagaagattgccatgactaacttcccatagcctttctaacttttgaagtgagcaacattagacatctcacacacatgaagttcatttttctcttgtttttttttaaaattcaatctaggaactgataactgtcatatgacaatttctgataagtactgtaaaagcaccaaaagttccattttaaaaaataattattgctagcaactagctgggagcaagttatctagttccattccaaaatcatgattgttgaccacaatttttttatggagcaatagtgagtttgttaaattgccactttcagttaccagaatgactttggaggttctagttctaagaaaacatgggaaataattgcatgagctgatttgttgtatgaagtttgaacttgctttacctatatatagcactgttgacttaacgatgctattgcacttagtttttatccataatagatgctggccagaagttacagtcttctattgcgtaaatctgtttactactgcagaatgctaatatatatgttcaattttgatgctttgttatttctggaagatgaaatcaatatcatatgctcatgaaaagtacatattcacttcacgtcgtaccacttacttctatgcaatagctttagtgacctttgggtgcatcttatctaacttattctttaacttgcagctctatatgcccagatgtacaggcttgactgctgaaggtgtggtgaagattgtccaggttctttatgaatgcaaggggaatctaaaccgcattcgactccatggtatttgcaggatgactaagcatcatcttgatgctatcagttctgccatgtgcaagggtaaccaacaagaagatgatcaatcacttttctatagccacagagtccatgaagtgctcaacaccaacgatgaacgccgtattgatgttgatgtgtgccctatgtgcacaaatgtgaggctggtgtttgattgtacaagggatggctgtaggtttgtaccttctgatcttttgaactcttatttgctctttgcttcgaaaatttcccttcaaatttgttgaaagtttgccactgtttttcttatttgcttattgacaactcatctttgctatatggtcacaatattcagtgcctttagatatttgatagtgttgtctcctgtggttgtggaatagctgacatagggatctcatctttcctggaaagcttttaagtgatggtccagaaactcatttattctctcccctatgggctacaggaaagcaactgcacaattaatttttatttggttgctctcgtctttggaacaactggttcaatatgttaaatattcttcagtattttttcaggtctattgactttgacctgaactttgttcgcatttctacaaaataaggtttgatctattttgatgatttatttatatttcaggagaaaggatagttgggctcaatgtcgaggctgcttcttctgtgttgcccgatgcgaaacatgcggtgggtgcatcgacttggaggagctcagcgagactgaacttgcatgctcggacttcctgtgcatggagtgctggcttccgctcccgaaatgtagcacttgcaatcggccctactgcaagaggcatgaaaatctgaaggtagatttatcaccatctggccagtttacttgtcatcgttgcgtggaattttctagtaactcacgcgagaacctggaagaaagttcttagaggtgagttcctgcccctctacagaaaatacaagttgtcgagtaaacttgggtatgaaactactgtctgtgtaccagtacttnnnnnnnnnnnnnnnnnnnnnnnnnnnnnnnnnnnnnnnnnnnnnnnnnnnnnnnnnnt

SEQ ID NO: 24097 - DNA, 8079 bp, Oryza sativa
  unsure (1)..(8079): unsure at all n locations
nnnnnnnnnnnnnnnnnnnnnnnnnnnnnnnnctcggacttcctgtgcatggagtgctggcttccgctcccgaaatgtagcacttgcaatcggccctactgcaagaggcatgaaaatctgaaggtagatttatcaccatctggccagtttacttgtcatcgttgcgtggaattttctagtaactcacgcgagaacctggaagaaagttcttagaggtgagttcctgcccctctacaggaaatacaagttgtcgagtatacttgggtatgaaactactgtctgtgtaccagtacttgctgatgacttttacttaaagcgtcaaatgtactagactaactaactgagtgtactggaaatctaggattctgaattatttattgatcacgtcaaatttagcgggtgcagacttcatggacttgtgcaacttgtctgaaactctgaataacactgaaacagtccattgccctcaagtcccatatgcctatggaatgtgtttaaccttccaggcttccagctcagaatgtgctcagcatgacagactgaaggacaccgttattaaccgccatttgtcattttggagcgtgctgtactctgtctggctgccatttgcgcctataatttcagaattcaaatgatactcctgcaagaaatgctactcgactggaataccttccatcatctgttcatcttttacaggaagaagatacctgtccctgtactatttcgaatccgagtctaaatttgagtagtcaattgagggtttagatcatgttttgcgataaacttgtacaatattgaaatactcgacagttgatagcactttgctttccaaaatttgttccgtagtctatatcagtattttggtccctcattatcttggtcgagagagggtcactaacaaaataaccaaaatgtaccttttctaatgcgattgtttttaactgcacatccatcttcttttccgcttctttaccgaattattgtcatgaattgtttactccgtgcttcaaaaaacaaattttcttttttttttaaaaaaagaaactttcttctactgcgttgcttggactacttgttttaaagttattagataagtttatttctcaaaatatgtaatttattcttacaactaaacagattactgtcacgataattcgatgaataatctgtttcaaatgctaaagcagatcagcggcacctactgaataatcccgtgtccatccctacttttttttagacacaatttctccatctccctcgaggggagcaagccagcaagatctgaaaaagggttttaataaaagcataaacaattacttcaagttcatgcgtctccatttgctatttgagcaaccattttcaggagggaatccaatagttggcacggtgaagtcagagtctagctttaccaaattgagatatcgcactctcgagcgagtccctccattttagaccacacctaataacatcaagatcatgaatcctcccagatgtgaacctggaatactggaaacacgtgtatttcgtgcacaatgagcaaagttagttttacatccagaaacctgtttcgcggcgatcatttcacaatgatgtttcgctgagattttttttatataatggataaaaatccggtctctatatccacaagtgtatatacaaccaaacatttcagaaaaatattattttactataatattctatagcaatagtcaagattcctttggaatataggaattttacaggacttgaggtatgttccttttctcttacagataataaattatcacattcatgttttcaaagcacctaaatggtacgtttttttttggtaaaaagcttcctatttctatatataagtttcttgtaatacatctttagatcaacttttaaattttgtataactaatttattcacatgaaacacaagaattttacaagggccttcttcttttcctcttatagattacaggttatcacagtcatgctttctaagctgtgatttttgcaaacggtttctacatatataagttccttagaatactttttaaaatatttttttaactttataatagttacttcattcgcttgaaccctagaatattattttagaaagaaaatcaaataatccatcatctatttatccatttagaacaacagaactaggcctaattagttcagttcctataaaaatactctgaaatttctacattcctctgagtgatgaaacaggtggcagcagcagattggtcctccaaaatttcgacatgtgaaaaaggaaccttgctactacacccttcaccagtgagttccaaggcaaggcatcactgatcagtagttgtgctgttcccatctagtcccctgcttcttgccatgaactcaagtgaagggcacctcctttttcccctacacacaaaataaataaataaatcagtgctactaaatcacaagctggaactttttttccttttttttttcgcgtcggtgaccgtcttcaggtacactataactaaccaccaaaatccatgacatttacatgagcactaacaccccccggagcacacgcgtcatgggagacaggatttgcagagagcaacagcccaagaaaaggggcatgagctttgtgaaaattgtgactctgggtggcacatatgtcactgcaaaacttgttgcatgaacagggtcagaatgtgagttggagcaggaggaggaaaatgttggttgggagaacacaatctttggaccactaacagtctctccatcatgtatggtgatctgatcatctcttcctttgtgtggaattgaagtggattcagaaaggggaaaaaaaaagaaagaaaaggagctgccttgcatggcatggcaatggcacctggccctcctcatctttcagggtttcacatatcccaatcaaaggcttaatagcacatctaattgtctaatgataaaggatgatgggaggcaaaagtacatccatgatgatgataataataataatctctggtttttgtatagtaccatgtttttcagctttgagtggcgaaatttgacctcagcgcgacaccgagacgcggtgtactgattgatggcttgttctagctagctgaagtcagagggtgcccttttcttttttttgaactgcagtcagatgatgcttttgattgtctgaaaggatacttagtgttggtgccaaactgcccaatcaagatatgccagggaaaagaaatgatgaagtgcactactttaccctaaattgacttgggaattcaaattaagcatgcagttcttcagtcaacctatgaagtgatcattcatgttcgagaaaaaaatttgtaaaaaataagagtgtttttacgatggtctctaccagcagtattctacgactagtacagatcacaataaaaattgtcaaaatataaacgggtctttttgtttactgaagaagatgtagttgatcattccgaccttgtgtcctgaccggcctgaagtgaagtcttgatggatactgttaagttggtcgatcagttaaaatgaaggtcatctagtacaacaaaataatggctttcattgccaatcaatctattgctggcactactacaattcagaacacaattttaccactcaaattactttttactcactattcatttcatttaaacctataaaaatttagtcgaatatcctccaccgtcatcgtgtcgcgatccgcaatctctctgtatggatagaaggaagaatgttttggatcttagctcacagacttttgtgggcaatttcatccctgtgatatcatgggaagtttcatatgttgacaagggagagtgagcagtgttgacctcaatgatcattcaacatttcctgcctgctggaagccaaaatcttgtccaacaagccgtactccatactgcggctacatatacctctgaaattgctgatcaaatcttcaaaaaaaattgcaagttctacacgcgcttgctcgatccgtcgcggccccataatttttcaccggaaaaaaaatggatgaaaatttttaaccatggtaggacaataaggacccctttgcaagtcatatctgaagctctagaacagatgactgaacattttacatgttgtcaattaattaagctggtcggcagcttaatcgattgatctgaggataattaatcttgtcaataactgttttcacctaaaaacaggtagtagaattctctgatctcacctaaaatccatccagggcaaaaggtagaccagaggataattttgtcagaacatgagatgaaagtaaagggagaagaaaagaaagcatggaaactttgtagtgcagcacttgcaattgcaaagcaagcaaaagggacccaagagcagaagctcatgcttcatggtggcacgtaggccaccctcacagccttcactgccgacgcccggcccgggcccaccgcgcagcctcaccggcctcggacacgtgtacatagagctagtaagcaaaataaaaaataaaaaataaaaaaataaagagagatagaagcttgaactacacatcagtacatcacacacagagagacccttggtgcttactacacatcagtagttagctactggctggtttgttttgtctcctcttcttgcctcccccttataaaggaaggtgagcattgcatcttgctccttagtactcctcctcctgcatcatcatcccaatcctcaattcagaattcagaactgccatttgctaccttacataccatacctagctgaattgctgtcagttaatctcttgatcagatcgatcaccctgcagcttcttgttgtttctagcatttctggtgaagaaaccaaatcttcagcagcttaaggtaggagatcatcaatggggaggcagccgtgctgcgacaaggtggggctgaagaaggggccatggacggcggaggaggaccagaagctcatcaccttcctcctcaccaacggccagtgctgctggcgcgccgtccccaagctcgccggtgcgtcgatcgagatcctcgtgtcgcagtactactttatgtgtgttttggctatgtgcatcctacgatcgaggccgaaagtttatatactttcattgtctgaaaaagggtatgtttgtaataaaattatagggcttctccggtgcgggaagagctgcaggctacggtggacgaactacctccggccggatctcaagagggggctgctctccgacgccgaggagaagatcgtcgtcgacctacatgcccaattgggcaataggtacgataacattgtcctcgacacgttgggacaacatgcctgaacgtatgataaattagttttttaatgtatatataaccatttttatatacaaaacatgttaggtggtctaagattgcgtctcatttgcctgggaggacggacaacgagatcaagaaccactggaacactcacatcaagaagaagctcaagaaaatggggatcgatcccctcacccacaggcccctccagccgccgccgtcgccgtcgccagagaagaagcacgcagagagaaagaacacggcggcggcggcggcggtggccgagcagcatcagcacgacgaactctgggaggaggagtccccgggattctgcaccgacgaggtgccgatgatccacccggacgagatcatggtgccattgcgcgaccacccgccgccggtttgcacggccgccggtgcctcgacgccgacgacatcgtcgtcgtcgtcgtcctcgtcggtggcctcctcgacgacgagctgcgacgaggtcgacgccgcggcgctgctcccggtcctggagtggcccgacgacgccatgtgcctgatggagctcgacgagctgatcgccgcggcggcgccgccgtccctgctgtgggacgacgactaccgcctcccgctgccgccgccgccgctatcgccgccggcgatgtacgaggagctagacgcctttcagtgctacgaccagcagaggagcgcgtttgagcaggaggcagcagcttcagcgtggaacaagcttgagctcttctaatcaatcaaaattaaactctgtaaattatgtttacagtgtttattataatcaataattaccgaactaaaacagaacagtgttgtttcattgttctagtattgcctctctggttaattgttccattggaattgcattagtgtagtgatgtgaaatgatcaatgttctcagttatatattgcagaattcgatcagtttatgtcaaaaaaaatcgatcacttactaggcaacttcagtttttcttttttttttaaaaaaatcagatcgatgaaaattgtccctgcatgtgtggggtagtaataatccatgatattataatttcatatctaaatatgaccctgtttagggaagcttctgcaccttctcccagaatcagaaactcctctaaacagtctagtttttagtccaaattctgagaagctgtagttgtagaatccaggaaatgaactacaagctagaagctggaaaacccagcttttccatattcttggaagttgctaccaaccagctgcttctcagaattttaagttccccaaacaggctttatgtccctgtggctgatctttgtactttctataaaaaaaacagaaaattcagcaaagagccaatttttttcttagaaaataggatataaacccgacctctacatctaaccagatggacacaaccgagcataaagagcccaatgagagttatggatttacaggaaaaaaaatgttgtttgctttgctcttttttttaagagtaattctacggtctttgaggaggtaccatgactccatgaggtacctcataatatctaggtatcaaatttacaatagaaaaaataatacctcatggtatcatttcaaggactgtaaaattgctttttttttatgtcatgtgcacttgcacgcgtgcatgcagatgccgtaatgctaaaggaaaataaattcaggagagaaattaaagaatgagacctacgtatgaacaattgagaggagagagatagatgctgatggttgtagctagattctaagaagatcctactagctaccaaactctccttgagtgcagtgtgctttgtacttcacttcattcatatcccaggtgcaaaaggacaataatcaagtcgctggatctaaagtactcccatgggataaagttgtgtgttatgtgagttaaacataattttgtactttactatattctaaatcttatttatttagacgtgtgctataaatgtactccctccatataaaaaaacaacctaaaataatatgagatataatctagtataacaaacagatccatgtccatatttgttgtactagattatgtcatatcttatattagattgagttattagcggtttaaaagttaatactaagaacaaactaagggataaaaataactcgatcgaatgttaactctaaatttagattttaattttgaattccatggcggctaataagataataagtaaacaattggaagcgcaagtagattcaaactttctctcccatgattttacaaatttcactaaggttattgtgatttcaatagattttgaacacgacttatcactagtgatcttcctataagataaattttagtgttcctgacggttagagcatatatgatagttgtagaaatattaggataagattaatttgtttagaaccatttcttattgctaatcctttcatatctctactcatataatctttatacatatatcatcccgagaggccgagacccaatacaatcattcagttacatactatatttctcttcctatatatttatcattgcttcttcgatcgactacggatatatatacccatagtggaagaagcagtgatgaatatagggagaatagctactttagtccctaaagtttctctgtaaaatcagtttagaccctaaccttttaaatggtccaaagaaatccttaacctttttcataaggcctagaatattcgttgggtccaccaaaatcatcatatggatatgccatgtcatcattcatgcaaaatcaataatgaattgtccaatttacccttacgtatat

SEQ ID NO: 24098 - DNA, 435 bp, Oryza sativa
gccctcaccaatctctactctctcccatgcttaagatttggtgtaggaagggagaaaagatgatattggatgtcatcagtattggggacgatggtcaaggggttgaggaggaggatgacaacaggcgccggaagagttgatgaagggaaaagaagaacggaaatactggtaattgctcggtgaggagaaaaaggaatgataggggaaatggatatggcagatagcattcacccctttattttatcccatgccccttaatgggacccgtggcctagtttttctaatataacttatgtcgtaggtataatatagttgcactaatatattatagttacatttgaaagtttttttaaaaaactatcaaatactcacttattataatgtagtaacacatgagaatttgactagttctattattactatagcagaagaatg

SEQ ID NO: 24099 - DNA, 2080 bp, Oryza sativa
  unsure (1)..(2080): unsure at all n locations
ggcgaattcgagctcggtacccctccatgtcctgatccaattgtacaaatttatgtgtgtcagtgtagtttataaaacagtaatatataccatgtaagttataaaggaaagaaattaaactgaatgtcagtgtagtatatgtttttttggatgatggattgaaacccggcctatacatccaacacggatatatgtacacggtcagtcagtgtagtatattaaggaaagaatacagggaggtcaatctgatgagtatccatacctcaactgtaaccaaatgttgaggatccatattgcacacgctcgatgaaagccatagatctctgaacagaagtttggcaaaattgttactagtgcagagtgaagtttattagcaatatacaccatagtactaattaaccttttttatgtacccagtgttctttcaacttttttagtaattaagtacatgcatatttgcacacacatatataggtaggaatagatacctaaaagcaaattatttggaaataaagtctaaatttgagataaattaaattaattgcttccaaataaatgcaacctcgctatacatattacggacattgatgtgaaaattgacagccgccttgacaattgtttttcggaagcgggtttagatcataggagctccctgttattattactagtgatttttttggggctacaattttttttttgtagtagtgatctcatggttttagaccccgtttggtagggctccaaactccaactcttagctttaaactcccactactagtgggagctagctcttgtaggagttggagacctgttgaaaagtgttggtaggttttgagctctagatctgaaattacaaaaaaaaaaagaaaaaaactccccaatcgcaactgctgccgtcccagtccccgtgtgcgggcggccgtctcctgttgcgcgccgcccgacgcagtccgcccaccggccgcgcgccactcgcgccgtccccgatgttgcccgccgcctgccgtcgtaagtccgccaaccgcgcgccgtccccgatgccgcccgccgtcaacctcgccgccaaccgcgcgccgaccgcgcaccaacccgccgcacgccgcccaccatgtgctgctcgccgtgcgccggccgccgtcgaccccgccgcccgccgtgcgccggccgccgtcgaccttgccgccaaccgcgcgccggccgccgtcgagctcgtcggagtggagagtgagggtgacggcctgatgggagggagagagaggggtgagagatgagttaggggtagttgagtggcaattttgtgtaaatatgtaaaaaatttaaagggtagtgggtcttttggtttggagtggagttgtggagcagcaaaaacccagctccacccccgtagtacaaatttgtggagtagctctgccaactccgctcccaaaaatggaggatctggattgtttggcatagctcctgctccaggtaagttggagttaggagctggagctgtgccaaacgggaccttatttacccatatgcttaaccctagatttccagcctaggactggactgtacactgtaggccaaagcactttaatttggtgtcccaattaattaatccctacctttgcaatgcttttaatttggaacagtagtaacttgtagtacatattaccggcaatcatgaaaattgtgaacctagccataggtttgctggctacaaagctctctagctctaggcaacatgccattaaaaagatttatatgttgtgttggtacaaatgtgtgcatgcacagtactgtcacagagagagaaagaagttactcatagatatgtaaaccatgttgcatataactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24100 - DNA, 675 bp, Oryza sativa
  unsure (1)..(675): unsure at all n locations
annnnnnnnnnnnnnnnnnnnnnnnnnnnnnnnnnnnnnnnnnnnnnnnnnnnnnnnntcctgaaccatgaacagtattggcttttctaattttttgagtagcaccaaataaccaaccgtgtaccaacataattggaaatatagggtcacacacagccacgtgatgagaaatggggtcactaacatggatgtacaaactataattaaccaaaacgagctctgtgaatccgagtctatctacaactaccattaccatgttctatcatctggttctttttactgaattacaaatgtgtacaaaatttaatatgcatactacaattttaatatactttcaagtttcaactcaccaaatcaagcatcaaaaacttaccaaactacatcctacatttggcaaatacttaaggatacatgacacaatatctattgcttcagcaggcattcacttgtggaagatctgcagtaataccattgcaaaattacttcatggagaactcctaacggatgatgcaagttatatgcatagtgcacactgaaatttcacgtcttcatttgtctgacaatgttgactcaaactgcacatacttctcaatccaccaatgaagtattgaatttaaatggtgcagtattacgagagtggtccacataccttgtgccatagacatgcttttatct

SEQ ID NO: 24101 - DNA, 6067 bp, Oryza sativa
aattcggctcgtgtgtgcgcgcccccgctggtggggacacgtgtcgcccccgcgtcgcgcacgtggtcgggcccaccttagagcaagtataatagtgagctataacctgactgtaaacttacgtgaaggagagatgtaacaaaaaaatcaagtggattggctctcatgtaagagctagcttaacacaatctccaagacaaatacattaaatgtataagtgagagatagagagaggagaagaaaattatagtcaattttatagctaatcttattatatactatgttggctttaagaagagctaatcttattatatactattatccttgctcttactccccccgaggcgtcgtcgcacgaggctttaaataataatccgcggcacaacgcccccccgccgagacccctgccacctcactgacaccgcggcccccaccatcccccgaccccacctgtcggtgaccgcggggtacgtggcgcggggggtggggggttcgcgtgtgcggaggcgaaccacgtgggacggggacgacgggagaggaggagccggtgggcggggtggggcccacacccccatcctctttttttaattaattaattaattaaatgcggtgagcaataatgattaaattatctctaactaatcatggctccctcctaaatctcgcgaataaataagcgagcaatcgaatcgaaacgaagagaaagagagagaggaaagcgaagcgaagcacagcagcgcgaagaaaggtcaaggcatcgtggagaagaaggagaggaagaggaagaggggataaaagttttgcttggattggttcttgttcttgaggcgttttttcgcgtgggatggagagggattttcttggcgcgatttggaggaaggaggaggcggccggcaagccggaggagcattcaggtcggtgctccactgttcttctttgatgatgaactcgtttggttggttggttggtgctagtagtagtagtagtagcggcttagctcgcggccatggcgatgcgggtttttaattgggtgggtgcgatgcgagctcggatttcgggcatgtgatgtgatccaccagagcagagatgaatgcgtgcagctgcggatttgggatggcatcgattggccgcccaattcgcagctttcctttttgtttttgtttagttataaaagaggctttcattttttttcaatttttttgacggctttaaattgcttgttcaaatcggcacgattttcttgtgcgtgatttagcgccttttttttcttcgattctgcgtaggtaaatctgtgctgcgattgttgtgttttttttggctgtgcgtcgtgatttgtgagtgaatttgtagtttctcgtgatgcagattatcgaggaggaggaggaggcgcgtcggcggcgatgcagtggcagtttccggcgaccaaggtcggcgccgcgtcgtcggcgttcatgtccttcaggtcgtcggcggcggcggcgagggaggaggaccccaaggaggcggcggtgttcgaccgcttctccctctccgggttccgcccgccgccgcgcccgtcccccggtgacgccttcgacggcgctgccgccatgaagcaggttcgcctcgcctccgacctccccgtcgcccacgtcgtgtccctcccatggtagattctaacggtctgagctgtgtgcagcggcagtttggattcaacggccggcagcagtacgccgccgcggcgcagcacggccaccgggagcagggcgtggactcctacggcgtcgcggcgccgcaccatttcccgtcgccgtcgccgtcgccgcgccaccccgtgccgttcggccacgcgaaccccatgctccgggttcatagcctccccaacgtcgccggcgggagcccctacaggaaccaatccttctccgtcggcaactcggtggccggctccaccgtcggcgtctaccgcggccaaaggtggataatctctactctgctctaatagaaatcatttctgaattttgagtgcaaagctaagaaaaaaaaatgagaaagcattgagctgacaattggatcgttgacttgcaaaagggaccttcaaaatccgaaggtgacacagatgaccatattctacgatggattggtgaatgtgttcgacaacattccggtggagaaggtatcgtatctttgcgacgcgcgaaatctgtttgatgttacttcagttcttgggggtatgattcctgattgtgtcataactgtggcaggctcaagaacttatgcttttggcaagcagggcatccattccgagtccaccgagtgcagctcgtaaatcagattcgcctatttccgctgctgcgaaacttacagtgcccgaggctttgcctgcaaggcagattgtagttcagaaaccagaggcttctgtgcctcttgtatcaggggtttcgaatccgatcaccatcgtgtcgcaagctgtgactctccccaagagcttttctagctccaacgactctgcggggccgaaatctggaggcctaccgttggctgttactcctttgagccaggcatccccgtcccagccgattccagtagcaaccacaaatgcttcggctatcatgccaagaggtatatggctctaccttcatgttgctagttctgtaatgtttttggaattctgaattcccggcgtaactactgtagtgtttcataaggtattcgagattgattcatgttcttgcttgttccagctgtgcctcaagctcgaaaagcatctctcgcccgattcttggagaagcgaaaggaaaggtataaatcgtgtcatcgtgtgtcttgtggttttactttgcagctgaaatctgttactatggtcttgtgcatatttttgacatgtgccttgtttatcatgtagagtgtcaagtgttgcgccatacccatcctcaaagagtccactagagagcagtgacaccattggcagtcccagcacaccgagcaaatcatcgtgcacggacatcaccccttcgaccaacaactgcgaggactcactgtgcttaggtcagccaaggaacatcagcttcagcagccaggagccccccagcacaaagttacagatatgagacctggtgatcattgtataccgaagattcagctcagcgagagtcggctgaccttgatgccagatcggacgccttctttcgcatccgtgttagggtatgatgagacataggaagagatcactagatgctgtttctatcctggctgcaaaatctttctttggctagagctgtttataagtgctgatctagccacagccgccgccacttagtagtacgagagctgtgacattgcaggtaatttcaggctgttcttgattatttttgccctgagccatagcggcattggacttgagaggaaaagaaatgctgctgagttgtataggattacagattcggcgtatgtaattttgctgttttttggttctagccttaaacatacaaagctagcttcagaattcaaacagagtatccctgatgccaatatgccattgccatggccatttttatatgttcggtacatttgttgttgcatactgttttgtgcatacaggcgagaatgcttgtcattgtaatgactagcgagtttttgtagcatgcacatcacgcagctaactaagattattatgcttcccttggagatcgcatgcagtgatatgttacagtgtttacttgattgtagtctctcccaagctagtatactctacgtagtcataaatattgtaaaaaatgaccaaaacttgtgctaaatattaatatttaatatttatggctaaagggctaggaatgaaaacggatagaaaaatgctcagaccatttcctttgctttttttttccttttcggaaacagaaccgaacggtagaacaagaaaggatatactgttgaaacattttttttaaagaaaaatatatcagaaacataattattgctacctccctcataaaaattaaacttctacctttgaatatttgtctcgtagaaattgtatttctactcccgtttcatattataaatcattttgacttttgtcaaagttaaattactccaaatttaaccaagcttgtagacaaatatattaatgtttatagcaccaaattagtttcattatatgtaaatttaaatatattgtcataatatatttgtcttgtgttaaaaatgttaatatttttttctacaaacttaatcaaacctagaacagtttaactttgaccaaagtcaaaacaatttataaactgaaatggagggagtatttaatataggacccaacaaattgattacatcaaaatatatttccttgtaatctctcttccttccatcccatctctaactcattgttttaaccttattttaatcaagtttatatatgaaatgtgtgcatacactgtgttcattaaatgaggttattatgataatttgtctattctcctaatgtatccttagttccttagaaatttattttttacgggacaaaagtagtagaatagagcattagaaacaacgtatcgtaagtgtaaacaagttgcacccaatgttttgttataaatcaacatcatatacatctaccatttgaatactttactagcaataatgtctatgcgttgcaacatgtaaaaaccaattttaaataactgaacaaaactagcccctttggtcataaaaaaatgacgtttagattaagatttggtcaaacttttaaaattcaaatcattaatagtttctcaaaatgagtttttgaaacaaaataatctaagtactctaaaaaaaagtgatggttagaatttaaaaattttaactaaatcttattgtgaatgtcaaatatttatgaccagatggaggaaaaggtttgcgatgcatatatagttgtcattgtctagctactaatccatcacccactatggttgataaattgtgatggaattcgttagttttgaagttgcaaactgcagttttcttgtacagtagtgtgtgcgcacttatgttgactaaaatggctcaggtcatgaagaaaatattcccgatacaattatttagtctattgatatttatgagatttgaggtcagccttcgtcaataatatgaaccatcctatgataaaggtgagatacatgatagatggacaccgcatgaagtattgatgtgatgtggtgagccaatgtgtatgaggcaagtactgagattacacaatgggaaaagccgagatacatgatagacgtgcactgtctaagagaattaacatgacaactggctgacacaagtcgatgtgtatgatcgtcaaaaatcgcaaaaaaaaaaagtaagaacaatggtaacataagataaaaagaatcccatttttgaaatcacaaggggacacggtactggttggcttattgacttattgttttacgaaaacacggatacattttctatttacgctatgctagaaactgtccatttagttggcttgtgccaaacacatctaaatgtcagacacttagaaggcattgttaacaaaaatgaaaatagttcttaaatcaactcttaggctgcaaattagaagttcaagcacacatttgtaaggtgcaaataactatatcgtttgtgttcaaaatcctgaatcggagtaaaataacaaatggatcaatttgccagcaatctaggcccatacataactacaaacggacccaattaggccgctacactggtagcagcccagataaagatgggccaaagcgttgccatacccaacgcgggtgtattggattgggcccattggtagcgttccaatgttgggttgggcccaattgtctaaaatgggccgactgcttcctcctttctccgtccactcgccggagtgagtcactcgctccctcgaccaccgccggcggggccggctccctcccatgccctccggcgagcgccgcaaccaatccgttctctggggtggtgagagggattggatgcggtcacgccccacgcggcgcgagcaaactcagcaacataagagcaccagcaccagcaccagcaccagcactaagcgagcaagatggcaaggggaagatga

SEQ ID NO: 24102 - DNA, 1816 bp, Oryza sativa
  unsure (1)..(1816): unsure at all n locations
nnnnnnnnnnnnnnnnnnnnnnnnnnnnnnnnnnnnnnnnnnacacctatattttttttagataataaaaatgatttacatcttcggcctctgcgaataagtatatggccaattagtcaagaaaagataaataaaaatactcgaggctatgggacaaatcctcatctcccaaccgatgatatatcaagctgaaataccgaaagaaaacacgtagaatctataacgaatgatgcacctatatgctatgcctgtattcatgtttctgcaggtaatttttgtttgttaaattctatttttgttcctgaagaaatcatgtgttctgaacttctgataggttgctgttgcgaaggtggagcctgatctctaatacagcatgacactttctaccttattgcatctcatggattaattctcacagtgttggaaagaaggggttttcattttcattattcagttttatttgccctgtctttaatctattttgcttatctagttgtgctatttgaaaagtataaaggttgtttggatgtttacttatcagttggtggttacagaatagtatattcagtttttgagtctgttagtctcataattgtctatttatacaggtaaaatttgctacttagaagacattgatgatgttaattttttagattattctttagaaacaacatttatatttattactctatatttgtgtgcacaaggcctaactgttttatatgtataaagactgaagataatatggagtttgatatgattggtgttgatgcatcgataactaatgccttatgaagaatcctcgtaccagaggtatgcgcatgttgccatctgtaccatactaccatcttgaaaactgtttgttgcgttctaatgagtcatgtatttggtggttccattccaatacatgtacttcattattttaaattacaatgttcctacaacggaaaattgagaaagtcctcatggttgacaacacatcagttacaccagatgaagttattctacacaggcttggtttgattccactggatgcaaatggatcctttttattatatctcaggtcaataacttaaaattttctaattccacattcatatatttgattgctatgtatgaatacttgtgtatgaataatagctgtattattctttcgttgggttctgtagagaacgatgcctcattattgtgtacaaactgcgtgtttcatgttagaaaggcccccagcttacagttatcttcgctgtcctgcaacctaaccctttcacagtttccaatcatcttatttctaagtacgaatttcctcccttccaatttgaattgtgcaaaactgcaaaagtgatttatttctaaatattcttctccaggttattctttggagtcatttttattcactgctttttaacttttaagactaaatgccatgtttttctcatttttactaaataagcatcaagtttacaaatttatcttgaaattgtggaccttatttttatgggagacaatttgcacctgccagctgcaactggatagattaaacaacctgatttgatgctgttagtgacctttaaaccaccattttctttaagcgaggatgatccaattatctgtttgaaacatcacattctgtgctacgagacttacataagaagaaaactgtgttatgtttcacaaattgtggatccttagtctttaatatgcgggtaatgggaaaacccccacattgacgacatttcatattattatctgaatacacagcataaattagctaaagcccaacctttttttcattttaaaaaattcttaataacgccaa

SEQ ID NO: 24103 - DNA, 3782 bp, Oryza sativa
  unsure (1)..(3782): unsure at all n locations
nnnnnnnnnnnnnnnnnnnnnnnnnnnnnnnnnnnnnnnnnnnnnnnnnnnnnnnnnnnnnnnctgccagctgcaactggatagattaaacaacctgatttgatgctgttagtgaccttcaaaccaccatctcctttaagcgaggatgatccaattatctgtttgaaacatcacattctgtgctacgagacttacataagaagaaaactgtgttatgtttcacaaattgtggatccttagtctttagatatgcggttaatgggtaaatccccacattgacgacatttcatattattatctgaatatacagcataaatcagctaaggcaccaaccttttcttccatcttaaaaaattcttaataaaagccaaaactatttggaatcatttaaaaatattttgatgccacatcaatcagatttactctgttcagaataatttacaaagaaaaaagtgagggtaaatccttggcagcaaagcatgtgcctaatgctactatgtaccaatataatattttgtgtaccaaaaactcaaactatctaaacaaatttcttaactgattttctgataccatcatcattcatgcacgctgaatcaaacagtggatccttagttattggtacttcagcttattcatgccaattctgttatcattgttctacttggaaagctttgatggctagacttcttgttatctcttcttttttttttgcgaagttgttctcttatgctaatcaatcatgtaagaaattaaattgctaaaacctaagacttatatcaatgataaattaagtattctattctttgtgcccttatcgttattataatcctgtcatatttcctgtaaggttgactgatattttctactgaggtgtggttagcagaaaatagccaattaaatatgtcatctcctgctcaatctgggaacaagcaaaagacctacacttccttcggccaaagcaagaaggatatctcaaaaaggatggtgtgaaatttaacgatataactattatgaggtttggacctggccaagtaagtttgttatggtggttgttatcatggctttccccttgacactatatgatatacttggtacctatatctgctgtcatttaggcttactatttggattatggcgctttgctgagtccacatggtataataaagatttcaacgcagtcatttcctggaatcctgatgtatgtagctttaccattatttttgtgaccaatcaattttttttgcggcttaaatttctgctggaaacctgagttcatgtgcatgctgatagaaatttctgcaaagatattttcttgtagagacctgctactctgaaattgctttactaatttttcatggggtaattctccgcaaaccaccgtgccttctaatttgcctagtcggttctattttaggctattgaacttgaggcatatgctgttaagggaatgaggaaagttcattctaagtggtctccagttgctactacagcctggtacagaatttccctgaggtaaaattcttttgctggaatctcttataagaaaaccatgagttgctatatactattgttttcatggcttagtgttatattattgtgtagttgtttttctcaaagaagtaaaaattgatgatgcagataggctagtgaagaagtgcccactcaatatttttgacattggagatcagggaaactgcaatttctgttcccactagctatgggcgttgttattttactagtgttatcttgggatatatagttagggaatggttgtcacttgccaatcctagtagtaccaaacaatgcgaggtcatctacagctcttgagtaagaggttgtattattgtctgtaatgtctatgtctcttgcttggatggtattcttttcccaaagctactgaatggaggtgtgtacacgaggataaggggagggtgcagagttgtatagtatctcttgcttgagtaaccagtcaccttgtttattgaagactggctagtccttagtccttactatctaacgctgatcactcatattggcatttattttacagaattttctatatttgtagttgctttaatgtgtttggtggacaccgaaacacgagattctctttataatatcagttatcattaatcactgcaacattattaacacatttgatttacctaaacatgtttcaaattatgcatggtgagagctgatgagaagctctcatttagcattttgattggagaatgttcctcccgaaaaaatttcttaagcaggatgatggttttttagtctttctaagtccttaccaaataaactccaacacttgagtagatgtgaaaatgagtgatagtttgttgagttttaagttgatttagagttcaaacaataaaagaaaaaaatcaataaccatgaaaatttgcagaatgataggtgttcagaacttcagatcttcttttacaaagctctgctaaaatatcaaggtgctaacactggtgtgtgttgctgtggctttagccttctgactcatgctccctccgtttcgcaatgtaagactttctagcattgtctacacacatatagatgttaatgaacctaaacacatatttatgtctagattcattaacatctaaatgaatgtgggcaatgctagaaagtcttacattgtgaaacggaggaagtataattgaagcaatggtttctacctgttctttatcatcccttctctctctatatgcaggggaaaagatatcaattgttgctaagccaagaggcacacactctttgcagggaatgcgttattatgggaccatctggggaacaagtaggactaaagcgcgttagagaccacttcatctgtaagtactggaatacatgtcatcgcccgcctttcctgaatttgacgcctttttcagaattcgttgctgtatcagaccagttatcctgttctaatcactacttgtctattgtttcccctggctagttgagataagctgagtccactggagaagtgcgaattcgagcacggtaccctgaacggtcatgagtcatggtagaccagcacaactagcgtctctgtatcgctctggtggtcactgtagttcttttcatcattatatattttgttaggcacatgttatgcagaaatttatttttcctgatgaaacaccaagttagtaatgttaatatttactcttgcaccatgatgctgtgacagaaacaaaagctcgacactggatttgacctcccagtttaccaatcacatcatttgcaactatagttttacctcctggctcctgtacttgggccttcactcctgttgcacatccaggtcagtctattaatgcttctcagctcattttcatacagtagctcttaatagttgatcctgttaactgctttctctctcaaaatgaaaattagcccagcttcatagatattttatctacaattagtcaacttatatatacacctagtgtataaaaattatactcatacttcaagtactttcacaaaatggtttcagatattaagaacatagctcatgaaaaattaatctttaaccttacaatattttttctgtataacatatttcatatgaaactcatcggagattgtagtaggaataaatgtgttagagagaaaaaaaaaggccatgtaattattcagtgacgcagagctagcattgccatgttgatttctggaggggcccagcatacttaagtgtttagacaattgctagtttaattacctcatattaaaataaattaaaacatttctgtggatatgcttag

SEQ ID NO: 24104 - DNA, 5014 bp, Oryza sativa
  unsure (1)..(5014): unsure at all n locations
gtagctaatagtacatctttccaaaaaggaatattggctacaaccatacatgattttaagtttacttgtggattgaaatgcatgatgatttattttagatctttacagtaagataaaaattcactgatgttgaaagcaggcaggaccatatatactactgtacatatatcgacagctatgtgttgtcaacaacaaagtagttacagtaacacattacttgcaagaaagaatataatgtagtcctacacatactatacattgtttccaggcaacaatggtatagaactgttccaagctagggggaaaaaataacactgaaacatgagtaccagctagcagaggagaaaataaaaaataaacaaaaaacaaataaaaaagaaagaaacagctccaatcataaagcaatggattgcaaaatcattcagtggtccaatgcatgtccccacaaacgatgtcattcacaatgcttactttgtcggcccttttgctcagtatctgacaaaggagagggccaaaaaaaaaagagaaaaatgtttgcaaaaagaaggaaaagcatgggttgtagtactactaccaccagtacatgtacaccatcaaggaaaaataaataaaataaaaaaatgtgacaaatgcatgtcctgtgtaacatccctgtgtgcatttaaatgatttgtccggtgtgtcaaggctgttttctctctccgtggcactgtgcgtgtgcagtacagcgtctgggggcgctacgatgagatatgctactagtacatgtttcgaattggccatttatttgcatgggggccttttggcaccgtgcagatgggtagttgcactgatttggaccactgtctagtctactgctgcccattcatgtctgtgtaacctacagctaatcatatctaaataatggttcctaagttgattgcaacgggattgaagaagtccactggttttgtaacgttgaactttactttacgggaacatatcctatcctatttacacgagcttcctgtgcacaatccgtgcacaccacctagcaaatgtcatagaaaattgtaaaaaaaattggacgcatacttctaatagtattaaaccaacctatgaaatcttaacttcaaattcattatattttagctgtaacaaaaaggataaaattctgacagatttttacgataaaaactgtcagatttttcacttttttgttacggataaaatataatgaatttgaatatgagactttgcatatatgtgtaatactattaggagtatgtgtctattttttttctagaattttctgtgatatttgctagttggtgtgtatggagtgtgcactggaagcttatgtgcataggatatattcccgaactttaccaacggtgtttaaggggaaggtggcaaccagggctaaccatcaacggcaatgacgacgatgagctcctcacctatcctttgccgtcgctgacaattccctgtctttagtagagaatctatggatgaaggttatggttttgggtaggagtacgacagagggcaacgaggcgggggggggggggggggtgttgctgaagccccgtgatggaggtcagcagtgggtagggctgacaacaatagcgcgagggaagccgtggagttaagaggcgacagtcagcaatggtgaatattctggcggctgagctgctagagacaaggaagagggcgatgcgggggaatggcaccattgccagcttatgaaggaagagagagggggaggcagagaagggggacggggaataaggttggtctggcaggctttgacggcaccgttgatggcttccgacgaggtcgggcaatggcgcgcttgagcagtggcggagatgggaattgattgggaggtgtcaggagttgggaagaggataaggatagggctgcacgattgaagatatcttagccgtaaatttgaccttttttttattctttcattcaactgaaatgaagagtcccttttccaaaatctaaaagtcaattatggacttctcaaacaattagtttaggtgaaggggaaagtgaacagcttaaaaaaactgaatgttgagtaatgtttgtttagtagttccattttcaggttttgagaaaagttaatgttataaagtaaccttttgtcttgtatgggatactgtaattaatattttatttttttgccaaggaaatgtacgtaataatcttgtttttgttgccccatgaaactatggcgaatatttttacggtaggcttgaccattttatttttcaaataatccactatgtaaatattgtacactcgtggatgatctcttattatatatatagcttgcatatgtgcggtggtgtgtctctttcttgttgtctaaaattaaaaagatagaggaactatttgattcacatggatgctactctatgaacaactgtttgtcctaaaatatacaaatttaatatgttatttgtataattattttattactattactgtgttcaaccaattcatagaattaattaaggcgtgcatttcttatttatatatatatatatatataggacactcatatggggcaccatggtgcccgggcaccatggtttcaaatgcacaaaattactcaaatttttcaaaaattttaaattgtgagtatatacctagttataagaattcgattcatacatatatctatcaacaaaacaactcaaatttaactttatttcacaattcatgattacatacctaactaattatatgtatggatgctatatacctagaatcaaaatctaacaaaaacaagttcaaattcagttcaaacttgctttgaactagttagtaaagtagttaatgttaatacctaaataattgaaaaagtttcatactcatttgaattggttatatactcaatttcaacaatggtgcccgggcaccatggagcaccaaacaaatttactatatatatatatatatatatatatatatatatatatatatatatatatgtcggtggtcggtggttgctacttccagccgcgggggccggtgttaaaccgctacatcccctgcgtcctccgcaagaagtgggacgactggaagagcgactggttctacacccccctcgccaacgaagcacgcctccaacttccaagccagcccccggcgcagttctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacaccgggcccgaagattacatgcggacccaccagggagccagatgggattgggctcctgaggacttcaagatcgtggtccaaagggtgctgaatctcagctccgtggaggcgtctcgcattcctcaggagatcctccccctctgcagcgatcccgaccgtgcctccattctaaccattatgatgggggtcggggcctcagaggagagaactcctaaggaccacgatggcgcgggcgagagccgccgggggaaacaatctgccccaagagggggtcgtgcttctgggccccgcgtcgggggccccgggagcaaccgccctgccgacgcccaggggaagaggaagctgggaggaacacctcccccatctcctccccgagggggcggggcggtgcgtgccagtagtcggcgcccggagggggtcgcgccgaccttgcagcccgagggggagcgcaagaagaagcggctccgcaagatgggggagacggaaccatcccggggaaacctgatttcccctccaaggtggtcatttaaccgaccccctcgcaggttcgtcccattctcattgcgaccgtctttcttctatcccattaagcaagttttctcttacccatcttgtttgtcttctggttttttattctgcttcagcgatgccccgtcacattccccccgccaccccaagtccggccagtccgaggccgaagatccagcggccgcagaggagcggaggcgagaatctgaccggcgtgaagccgcagatcgccttcgggaagctgaagaggccgcccgggaggccgcccgggttcgccaggcggaggaagctgctcgggaggaggccgcccgggctcgccaggctgaggaagctgctaaggaggaggccgaccgggctcgccaggctgaggcgacagctgctgctggcgcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgcattttctccaaggcggctcttctcctcatcttctgtcgccccgctgagcgccgagccccttctgtaggccctggccgccgcaaacaccgcagtgctggatgggttcaacgcccaagtggaggccctgcgtgcggaacgagcggagctcgaggccgcatgggcgcgtgttgaggaggggcggcgctcggtggacgccatggtggaggtgggccgtaaggctcaccgccgtcatgtctcggagcttaaagcccggaaagcggcactggcggagatcgcccgtgaggtggaggaggagcgggcggccgggncccccccttcaatttcctttcctttaaccccaaccccccggccggggaaaattgggggggttttcccgggaaaaaggggggcgcaagacaccctccggcttcagcacgcaagctgggaggcggagctgaagaaaaagctcgacgccgcccaaggggtccttgactccgccgctgcccgagagcggcgggtaacggagactgaagcggcgtctcggcggcgcgaggaggcccttgaggcccgtgccatggcgctggaagaacacgccggccccgtggagaggggcttgacggaccgcg

SEQ ID NO: 24105 - DNA, 1225 bp, Oryza sativa
  unsure (1)..(1225): unsure at all n locations
nnnnnnnnnnnnnnnnnnnnnnnnnnnnnnnnnnnnnnnnnnnnnnnnnnnnnnnnnctgcgggcgaaagcgacttagccgctcgcctcgcggctgccgaacacaccgtcgctgacatgcagcgcgcactagattcctccatcggggaggccgaggccctccgcttggcgggcgagatggggcccgacatgctttgggactcggtctcccgcatggatcgcgccggtcggcaagcgggcctctggaaaggccagacgaggatgcgccccatcaatctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccaatttctctccctggatggcgctggaggagttccctcccgggaccgaggacgacgcgcgcgcgcgcgtccgggatgccgccgaccacatcgtcaacggcttcgagggctcggcccctcggcccgcgttcgcccccaactccgacgaggagggcaacaccagcagtgcagacgatggtggtgacgaggccgtcgactcgggcgcgtcggaatgagcccccaagcccccgccaatctttacttttttctttttctttcttctaaggccttcatgcctcttttgtgtacaaattaacttaatctgcaatcagaaatgacgaaaaaatttttgtgttagttttattttgctatacatacgcgatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaacccccgagggcaaggttgagtacgagtgaccttattttaagtcaagattcttcaaaaggaaagaacagcacagacacaacctttaggaaattgaactattgatgtgaannnnnnnnnnnnnnnnnnnnnnnnnnnnnnnnnnnnnnnnnnnnnnnnnnnnnnnnnnnnnnnnnnnnn

SEQ ID NO: 24106 - DNA, 1269 bp, Oryza sativa
  unsure (1)..(1269): unsure at all n locations
acggctagtttaggttggtgggagtataaatactccccctccatcagcaagggggctctctttcggcacccaattcaattgcatacaccccttgcatctctctcacacaccttttagcttagtgttcatccattgtagtggttgaggttgttctagccaagagtcaagtgcattgcttccatttgtagagctagtgtggcacttgattgatcatctctacgccgggtcattgcttgttactcttgaaggttgccgcctcctagatggcttctggaggagttgcccggtgacttctccgagaagattgtggaggaggcccggtgccggtttgtgggtggtttggagttcaccaacttcggagtgaaggaagaactaccccgagtgatcgaggcttgggtagtcctctccgtgggtcggctcccgccttgcccaccccttgacgaaggaggcgtgcggtggcttcgtggttgagcggtggagttgggctcgcctcaacggggaataggaaaccggcgagtttccgaacctcggtgaaaatctcttgtctccttgtctcatttgattgtcgcatttacatttgtgcaatttacattcctagagactttcttgagatcatatcaccctaggattgcaaaacattgacataggagtgtaatttactttcctagagaattaattgagccactatcaccctaggtttgcaaaacataacttagttgcttagttagacttaaccctcaccgagcctagcaacttaggttagttttgattaggtgtcatttagtttttaaatcgcctattcaccctcctctagtcgacatctcggtcctacagcatgccggcgttctcctcctccatgctgatggtgatgagcgtgagtggcagcccacggcactcgccggcgacctccctggcgagcccgacgatcaccgggtgggacgcgacgacggcggcttgcagcgtcgtcgtgcgccgctgcgctcgcgacactgtcgtaggcgagcgcggcggcggtggtggcttgtggcgtcgtcgtaggcgagcgcggcggcctcggcggtggggaagtggcgagccagacgcgtgacccagactcttcccgttctcctcctcatgctcttcctcgcctctttccgatggttttgtgcatgcttcagacctttttgcaggcttttttatgaggaactcgttgctcaccaaggaannnnnnnnnnnnnnnnnnnnnnnnnnnnnnnnnnnnnnnnnnnnnnnnnnnnnnnnnnnnnnnnn

SEQ ID NO: 24107 - DNA, 581 bp, Oryza sativa
tatagccatcgacggctgctccttcactgagctaatcattgtctacccatggtcattaccgtcagtagctatcccgtgccccatcatcgctctgcactatcgctatgcctcagcgataggtaaatgcggaggatcccagagcctatgccgctaatggttgctcgtcgtggtggcacctatccccatagctcagtgcctcagtcaactggaggggcaacgacaatggtgctgcaaacagagcgaaggttcgtgaggacgatcatggcggtcaggtttcctcatgtgtttggccatcatgcttgccacttccatcaccatcagacttggcatggtgcttctgcacattgctcaacaaggctgtggcaaagctcaagaactacgagtaacctgttacgccaaagctcggctgggcctagcacattctcgtcacgacatggaggtggcggtgtggaggcgagaaagaaaaggattgcgcatcaaaggaggcggccaagggagagacaaagaggatccctctcaagcctagagcatggactaaaaataggtgacaatttttatttaattggggatcctctagagtc

SEQ ID NO: 24108 - DNA, 638 bp, Oryza sativa
  unsure (1)..(638): unsure at all n locations
tatttttctttaaaaaaaatgtttcaacagtatatcctttcttgttctaccgttcggttctgtttccgaaaaggaaaaaaaaagcaaaggaaatggtctgagcatttttctatccgttttcattcctagccctttagccataaatattaaatattaatatttagcacaagttttggtcattttttacaatatttatgactacgtagagtatactagcttgggagagactacaatcaagtaaacactgtaacatatcactgcatgcgatctccaagggaagcataataatcttagttagctgcgtgatgtgcatgctacaaaaactcgctagtcattacaatgacaagcattctcgcctgtatgcacaaaacagtatgcaacaacaaatgtaccgacatataaaaatggccatggcaatggcatattggcatcagggatactctgtttgaattctgaagctagctttgtatgtttaaggctagaaccaaaaaacagcaaaattacatacgccgaatctgtaatcctatacaactcagcagcatttcttttcctctcaagtccaatgccgctatggctcanggccaaaataatcaaaaacagcctgaaattaccttgcatgtcacagctttcgtactact

SEQ ID NO: 24109 - DNA, 680 bp, Oryza sativa
cggccatgatggccgcgagtggagtgtgtctcaagcagcaaggcggcgcgcgcgggaggggagggggggacaggcatgatggcgtggggagtactgccgcttgcattgccttgcctcccccgcggtggtgggacgctggaccaccggacatgcgagattgctcgtcgagattgtacttcacgggctgtctgctagcgaccactctcgttcgtttccagattatgtgtgtctaggtctcaggaattcttgtcccatatagtagaaattatttgttcttgccttacgtgatctcgtggcattccattccatggcttggtttatatggtgagatttcttctatcgctaacaatgtcatttgagtagctagtagcagagccagaaattttctaaaccgtgggcagtgggtaagcctaaataaaacgactaaaatcaagtatatatgtctaaattatcactaaagttgcacatcaaaatatataatgtttttatataaacagtccaaacgtgcatataaatgtttatacgttgaaaaaatgtgaataacttaaagcggcactgctgattgttcagaatttgctatttaaatctaagcattgatcatgagcacagagcacgcggtacaggaaagaaattcatttagccggacgttgcatacagcatagtacgtaatatgcatttca

SEQ ID NO: 24110 - DNA, 566 bp, Oryza sativa
  unsure (1)..(566): unsure at all n locations
nnnnnnnnnnnnnnnnnnnnnnnnnnnnnnnnnnnnnnnnnnnnnnnnnnnnnnnnnagcaacgctaattgggaaaactgctggatgttgcgcaggagacgagaaatctgacagctaatgaacgcatctttcgcgatgatttaaaagcaaagatcctaggcttggctgtccttaataagatacagattcgcaatgatcgaggttaacgtggttaaaggaaggtgatgttaattccaaattctttcatatcaaagcaaactcccgtaggagaaaaaacttcatccagaccctgcagtccccaaacggtttagcagtctcggcctaggataaggctgatactctttttcgcttctttttggataagctgggaactccatcacaaagacagtcttgcctcaattgggaagcactcaacttcacatccttcgatctagacgatcaagaagacgatatcacagaagaagaactaaaacaaacagtattctccatgcccgtccgaaaagtcacccggccagatggtttcattggagctttttttaaaattgcttgggagataatcaaagaca

SEQ ID NO: 24111 - DNA, 1507 bp, Oryza sativa
cctgtgtggagaggcgtttgaagacactaaccatctcttcaatgtttgccccatcttcagaaaaatttggcttatggtgtgccaatggcaaaacatcccgggggcacagcctgtagatgacaacgcagcttggtgggctgatctcaatcaactacaccctaaacctttcaaattcagggttaaaggatctcttctcgccacttggtggaacgtttggttggaaagaaatagaagaatttttcaaaacatctcttacacagaggatcgcgttgcgagaatagtaaagaaggaacttgatctcagacacactgctttccaaccccctaattgtcttttctttttcggattccctttgttctttctggtttctcccttcttttccttcgatgtcttcccctgtattctatgaactgtttttctctcctctaatgaaattaatgaaattccggcagagctcctgccgtcgttcacctcaaaaaaaagaaaaaaagaaaactctattcactccttatagggtatccctcttttttcatgttacttaaaaaatcataaaaaaaagattaaaaaattagtaagataaatcaataggtgatatatcacttcacaaacatactcattcaaattcaacttatacatgtagaaacgaaaataataaatttaactatgaatataatgtatatataattcacggtcaaatttgttatttttatttgaattgtacatataagttgattttaacttgcatatttgtgaaaagatatatcatatattgatctatcttggtaaaaaaaatttcgaattttttatgattttttgaatgtcatgcacaatatgagaggatgttctctggaggaaaaaaatcacttcccgctaatagaatcatttctgttggctatacaaatagccacgtcaacttattgtagctaatgccagaaagtcaataatacaataatatatactatacatgtccatggctgcacggctgcacgtttatggacaagtatgttttttctaatctcggctttggattcatgattggccggttggccgctgagaagaaagaaggtataactactaagaaaagcattatcgcaagcggtcaaaacggtcttcgcaagcggggcggccgtccgcctgtaagccaacgactgtgaagatcgccgatcttcgcaggcggggcggctgtccgcttgcgaatataattttcgcaggcagacgttggctagtccggtccgcctgcgaaaataggaatcggccgcctgaaaaaaaaacttccgcctgcgaaaataggtagaaaatattgaaatttaataataatttacgtaaattacttttaaactatttaatagaaattcttgcaggtagaatattatgtacatatattagaagattatcaagcatttggtactgataaatgtacatatattacattactcaaaagtgttgccaaaatatatatattacaatattttttttacattgtcagggtaccgagctcgaattcgcc

SEQ ID NO: 24112 - DNA, 735 bp, Oryza sativa
catcatgcatgggcgaccgtggaggccgccacgagcactgacgtgtccaaccttggcgcgccgcggcgaggcatcagtggcgcgtgcagcctgagggcgtggtgtcgaggcatatacgtacgtatatccggatcggacagacaaggatggcggacatatcttcaccctgattatcgaccatcgccgacttcagcgaccagtacacgcactaacaggatcgacgacaagctatctaacaacgacgacgggtggctcgagtacgtttcgctgcgacaactggcgcgtgtgctgcagccgggccgggcaccagcgcaagccgtagctgaccagtgccctgccaacaagcctgggcgcccgccacatcttcatccgcaccggcgccggcggcatcaaaaaccaccgattacttccacaaggcgcactgttccaggcaagccaaacgtctctcatttccttaatttgcatattatttcttatactctcaagctagaacatgcagcatggctattatttatcacgctaatacactgaaacactaggtcgaatacgtacgtgagctgagtagacatacacaaacaatcttttatactagcacaagggttcactacaaattgttcaagtcccaaacggttcagaaccagcggtccatagcagcacagtaaaaatttctaatgcacggacctgatgggaggaggtgatcaaccgcaggaggtacatgaggcagaggggcaaact

SEQ ID NO: 24113 - DNA, 564 bp, Oryza sativa
ttgggatactcacaaaaaatgggattttgttttcagtcaaatcattttatgatgcaatgaaaatagaaacaagtggttaccctttcaagaagatgtgaatttaaaatttcagttaaactcgaagtgttcatttggttagcacttatcttgactaaagataacctcattaaaaggggatagaaaaaagagaacatgcggagagcgcgtggagcctcatggccacgcgcgcggcaggtgagtgatgggtgggtgagcgacggtgtcctccgcgtctctcttcctcctctgcctcgcagggaaacaggaagtagtagtacaagaggtgagaggagtagtgtgtagtgcaatgtgcacacgtataccggtagagtaattttaccatccaacatttggtacatcgaggtaccacattttgcatataaagttttaaaacctcgaggtactaaattttatactacaaagtacctcgaggtactaaattttatactagaaggtatctcgatgtaccaaaaatttgtggtacgtacctctgggtatcaaatgttagatggtaaaattgctcat

SEQ ID NO: 24114 - DNA, 2285 bp, Oryza sativa
  unsure (1)..(2285): unsure at all n locations
tcaaaaaatcctaagctattattagaggggcatcaaacatacagaagttatcttgaaaggaggggctaagtggctatggagaagaggaattccacagactgctgcttatcatcaatctccagccaccgctggccttcgtcagccattttgcctcttcgcccacagttgtccagcaggaactcaacctctggccgcttccagtcgcccacgcaacaatctcagatggaagcggtgggctgcaccgcgcctcctcagcggttggcaaccaggaggatggaggtggccacgacatgagccccagtcaagaaatcaaagatgaatgtttttttttttttttttgaaatgccattgcaactttaacactgcacttcatttgtcccctgttaggatctggcatgagcacagatcacttttcagtttgccccatacgttaagaacttggaaattaagatagttgtaacaccataatgtccatcagaaaccttttgagacagcaatagaatgtaatctgctcaatctctgtagctgaaactaagctacctatgcctatgtacacagtcaaaaactcacaatgtaactgcttatataaccaggaacgggaaattagtaaagaaagacatgaattttattcagatagttgatcatgcatgtgcacttaaaaaaaaaatatagaactttcagattttggtcatacaaacaaagtaaaatgtaagctgtgcatattcttggaaaggttagggtatgtgtatattaatctgatttcatttagaagtattgaaaatcaacccagacttaatagaggaaccatcataaattattaatcatttgaattgtagaatagcatgcgaaaccagttggttatgaatctgggttaagtttgcatatgtatctagttctttactacgaaacacagaaaagagacaatagaagtacatctaagtatgcatatagtgataaatagtcgtagttctactaaatttcaataacttaacagaacatataagttttttttttctaccaaatcatttgtgtagcagaacgaatgtttaaaatcatactctcagaataaaaccacagtaaatagttagttaatcaatagtttatttttttccctgcatcaacaactctaatctagtaaattatagtcatgacatacagtcagtagcagtaaatcatccaaagaaatcagttaccatctatctgtattcaaggtgttccattctctatagtacatatcttggcatgattttcaaagtatagtaccatgtaaattactgcatcattcaataagatttattctagaatatgatcctgctgttgtgccaaattcagttatttcatcatgcaagcatatacaaggacttaattatgttagtgtgattttcattagcttttctaattccagtactgcacttgcatcagcattcattcattcactcatggcatacagaaatttattcgtccaaccctagcaagccaatttatctagaaccctagaaacagtaagtacaatcctgattatagcatcatcaagttggtcgctaggattagttcacaagcatcacaattcagagcatgctatcacacaagagagtaccaatcaaatcacatcacagaagtagggagaaaaggggatgatcagaaaggaggaactcgggggagacaagccatggttggctcaaggggtgttgaagctgggaaaaatcccaatctggaactctaggcgggtgtcttcgtcgttgggcagcagcatcgattggagagggttagcttgggggcaggctcatgagaagcatgaaaccgattcaggccggcagcggctgcggggcgcccgccgaagccagggagcagcggccggcgtgtgaggtggagcgccggcgatggcagtgagacctgaggatgcggcgggcggcggcacgggggagagcgagaggaaaagaaagagagcgagagaaagagagaggataggaagaaggtgggctaggtgggtcgttgtggctgatgggctttagagagtgggctttatatggggaataagttcactttaggtccctctatttgtcgtccagtctgatttttgtccctgaagcgcaaaccggatatgacccatcccccaacttgcgaaaaccggacaaacaaggtcccttggcggttttggctggcgtggcgcccacgtggctattttggctcggtcttcatctgacgtggcgcttatgtggcaatccgatctnnnnnnnnnnnnnnnnnnnnnnnnnnnnnnnnnnnnnnnnnnnnnnnnnnnnnnn

SEQ ID NO: 24115 - DNA, 125 bp, Oryza sativa
cgaatcttgggcaccaactggtagcggggaataaaaagagctctcttccttgcggtaagacgaaccctggccttctgtggtggcgcttctcccttcaattcggtcagttccttctccagacgatc

SEQ ID NO: 24116 - DNA, 1214 bp, Oryza sativa
acagtaaagtatttaattaaacaatattaatccaacgctatagagcatacccgttgcataggcccaaactttctgaacaaccattcctggctacacagttctatctccaaaccaggaatataccattccaaaccaggagctaaacaagttataatcaattacaacatcatatattatggtgagaggtgtgagactaatcatgaaagacattgttagacccacccataaccgcgggcacggctattcgaatagttttactctggctagaggtgtaccactgtacccacaagacacaacctcaacatcatgtcaaccatgcgtcgcgatacttaacaagtacccgaatagagattgtgacaataccctccgcataacacaattcaaagcagtgcaccattcctggatcataatcaccctcttataaaacaaggcatggactccccagcgacccccgtgggcttatctctgccacttctcagtctggtgcccacaatgaaccacactatacaaaatgtaaagccgttgcccacgctggcttgtggttggcacggttaatgtttcacaactgaaaatcgtgaaccggtccttaattgtcatgagcacgaccatcaaaaccatgtgctcacaacccacctttaccatgttttagttggcatcttaattaatcatcctatcatgattgaccttcatgagctaccattaatccatcattaagtagtagtgaatcattagttatcccattcatatgagctagtgtctctaagcatggctaagcatcctaattactttagctaaaaccatataatgttctagctaatccaattattaaccaggtgacaaagtataggtaatcaataacaaagggctataacaaaggaaataggtcgttcccacccggtgacattcaaaaataaatgcaatagttgaatagaaacaatagctttaaataggatcaatgtcacatcctcattttcgtttcaggatttataaattatctaataaattattaatagaatttatattaaatattctttaatttacaagtgaagtcaaatgtgggaaataaaatttcctaaatttaaagcatggatggatttaattttcattaaattctccatgattaattatactctctgaaattttctcggatttttcggagctcaattcctaaatgatacaaagaacagttcagtaatatttaatcattaatgatc

SEQ ID NO: 24117 - DNA, 686 bp, Oryza sativa
ggcggaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgttcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcatttctcgcgcccactatcttgccccctcgtttctcgcgcccacgcttccactaatcccattcgcccgtttgcggtgcatgaggtggatatgcggctgtggcagtcgagatggaacatctcgtgcgcgcattaattacgctcgccgaccgaagcgccatcaccatatctccaagaaaaacgaaccggcttgtcccgatttttagaccggccccacctgtcaccaggccttaggaagtggcgtcacgcccgaccgcttccctcgaggagggcgatcgccctggcataacgccgggggctactgtcgg

SEQ ID NO: 24118 - DNA, 762 bp, Oryza sativa
ccattacaagcaagacattgtatgaagaggggcgaacatgcagattgataaactgacgcgtggtggacaagaatgactgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggagattttgtttggaagggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacaccgagagcttagaatctcacccagggcccccggccgaaccggcaaaggggggcctgcgtggtctcccggtgaggagccccacgctccgtcagtgtgattgggaatgaggggtgggtgatatgtgaatgaggggttatatgtgattgtgaatgtgaatttgggaatgtgggtgatatgtgaatggaattgggagggtatgttcaattttgcaggatatgtgaatttgtcaaattttttaaataa

SEQ ID NO: 24119 - DNA, 717 bp, Oryza sativa
  unsure (1)..(717): unsure at all n locations
nnnnnnnnnnnnnnnnnnnnnnnnnnnnnnnnnnnagctaacaataagggtcacaccgccgagtggataatgaaagaacacaagcgtctcttcatagattggttgcgagacctagacttacctgagggacaaactactgatgaaataactatgaagcggttggcttgtggtccatcaactacagtaaattcttggcagggatatgacattaatggatactcgtttagtacaagagcccgagataataagatctgtacgcaaaacagcggtgtccgtgtggaggcaattgatgaagccgaggaaaaacaatcatacttcgggtttattgaagaaatatgggaaatcgactatgggcacacagtgcaattccccatatttaagtgccagtgggtaaaatacccaaacggggtcaatgttgataagttcggtcttactattgttgacctggcgagtgtgggtcacaaggatgacccttgggtactcgccaatcgcgtggcacaagtgttttacgtgaaagacccatcaaatttgaagaaagatatagtgctacccgggaaacaaaagatattgggagtggatggggttgaagatgtcgaagattacaatcaatacgatagtatgccactttatagtcagtttgtacagaagattaagaatgtnnnnnnnnnnnnnnnnnnnnnnnnnnnnnnnnnnnnnnnnnnnnnnnnnnnnnnnnnn

SEQ ID NO: 24120 - DNA, 964 bp, Oryza sativa
tgagtatatagtaggcggtacaaatactcatataagaaaccgtgttgaaatatctctgtagctttggagaaggggcaaacataacatttcatgaaaattaaaaaagttataaaatcatattttgaagtcagcttatatgaaaactctataagtatatttgcaaagaaaaaattcaattggaaggatgggttattagaaaattccaaaacaatgcagcgctgaaaaaaaaatgaaagtaggaataatgcttgtcaagaaaaaattacaccccagtgtgccctattggaacatatgacatgtctcatgtaaaattgtttgaagtgcatgtcacttcgtcacacacaaataaattgaaataatactttatgatcaaagcagaaaagagaataacacagtacgtatagctagagatactaagggttggattctttggaatagcacatatgtattgttaatcggtatggactacacagatcaaccgagaatggaactatgcaggttacaactcagaagtacctgtggctttaatcctctcaggcaaccatggtttcagtgtcactgaaacaccctgcaaacaacgctaacctatgaaatcaatgttccattaaatattaaacaatagtagcagatatagaaatgactatagcacaagaaaaatgttagctaacatacatagggccagcactgattttaaaaatgtagtaattgcggtctagtaaagttcacaaatactgaaatcttcaatcgaaccaaataaatatttgttcgctagatgtacaacataatctgtgattactgccttgacttatagacccaatattgacccaatgtattggttacaatatgattcgtagaataatggagcttcctccagataggaggctaaaagacctgcaccatgaaatcatatcattaccttaatatcggcacaattatctgtctatactgagccgtaaagaccctg

SEQ ID NO: 24121 - DNA, 638 bp, Oryza sativa
ggcaacgactttaccttttgtatagcatggttcattgcagggcaccagactgagaagtggcgagaagtccgtggggttcgctggggtgtccatgcctctgttttttttgagggggtgattatgatccgggaatggtgcctgtggtgaattgtgttgtgcgaggggtactgtcacagctcttttccgagataccgtggtggtattgaggcgcatggtgacatgttgtggagctgtgtcttgtgggtacagtggaacacctctggccagagtaaaactattcgaatagccgtgcccgcggtcatgggcgggtctaacaatgtctttcgtgattagtctcacacttctcaccataataaaagatgttataattggtaataatttgtttagctcctggtttggagatagatctgtatagccgggtatggttgttcaggatagttgggcctgtgcagcattggggtgctgtgcagtgttggttaaaattgatgattaattactctattgttttactactcttaaatgtttgctaaatgctgcttttgcaaatgagcctatgtatgcccatcctttggtacccttgtgcacttgcatatttgctgtgtggcttgttgagtatgtcatatgctcaccttgcaata

SEQ ID NO: 24122 - DNA, 1368 bp, Oryza sativa
cggtgattatggatggatgcttctcaattggtgtacaaattaatgtatggattgtgcgtcgtgctaaattgttacttatatgtatcagatattcagaaggtagctaggcttgttcatcttgccgagaccaactcgtacaaaacttctcgtgcataaaaaatgttcaaaaagagaagttcacacacacataattgtgtcatacctgcacgtgcagtagattagaaggagggtttttttttcggttgtatacaccctattacgtacacggaagaagattaggagtggtggatttttaaaagatctaatctaatggtctaaaataacataacaggtccaccgatttaaataaaaatagagggtttagatgtttcttgccacgtgacggtctaagagtgtttatagagtgtcatatggcggcttagtagcgtttataggatgtttcatggacttttagtatacaataactaggaaggtagcccacggattcacgcgggcatgtatcttaagatgtgtttgagatacttatatagttataaggatggaatattaacagtagaacaccgtcacgcttcgaaaacaatttctatgtgcattttttttgtcatcattgcctgtaattttttttgtcatcattgcttgtaatttgattaatccccataagaagaaggaaaacttagtttgttttaaaaaatatatctaacaaattaacgtaaattaaaaatcctaaaaatggaattattagatcccaaattgataaattgttgtttaaatggaattattagaaatgattttaaaagcctagaagaaaagatctaattttaagtaataaattccaatataaaagtgggtaaatttttattaaatacttcccttgattctacagttcctagatttttcggggatttatttgagccaagaaagtatttttaataaatagaattgcatttcatgaataatttataaggaaaaaggtttaaaaatccttcttttggttttgggccgaaagtcagcccaagtctctctctctctctcaccggcctatgcgcgcccggctcaagccggcccagttcgcccctctctccctcctctctctcccgctgacaggtggggcccacctgttagggtcgtcttccacctcccgccgccagccgcgccctagctgcgcgcaagccgccgccccttccagattcggtcgcatcttttccgattcgatcaaattgatagaggggaaatgatccctttgatctcctctatcttttcccctatagaaactttagctaatttcgtttcgaaatcgtcggattcgagctcgattcggatttgatttcttccctccaaccctaaaccttccattgctgctgttggtcg

SEQ ID NO: 24123 - DNA, 853 bp, Oryza sativa
acgtcagcgccacatcagccgtagacccgtggtagatcggttagatctcggcctttcgttttgtttagattagatctcagccgttcgttccgagactgcttctgtgcactcggtccaccgtgaacccgagccccgctgacgcaataaatcctttttccttttcaaaaataattctttattgcgtcataatccaatgaaaatctatataaatgatttaatccgatttaatctttaaaaattaataactaattcatcttagctcagatttagctggttcaagtctctcaatttctctaaaattgagatctacatgttaaaaatatccacatgtgctgtttatgattgtttatgtactgttttggtgatttttctcttttatgcttagattccgacgtttccagagagtccgattttgcaggagaagactttgaacaattccaaggccagcaaggcaagtcacacagatcccaaacaaccctttgtgcatgttgattgtcacgcccggaaattcactagtaatttccgaacttatttgtgcataaaatcctcgtccaggaatcagccgaggtacacaaactgacaatttaatatacaaatccatcataataataacgttacatacttacaaaagaaaagaaaacagcagtggaattacggtctagcgaagctccggctccactcccacaggcagctcaactagggtataagccaaacgtcttctccttcgcaacttgtcttcaactcaggtttgattgattattgcaagaatgagcatatgacatactcaacaagccacacagcaaatatgcaagtgcacaaggataccaaaggatggcataatatagggctcatt

SEQ ID NO: 24124 - DNA, 454 bp, Oryza sativa
cgccttttctacaccttcttctccccacacgccatcgctgccttgcttcctcactagagcagttgcctccaccgtcaacacacttgcttcctcgccgggatctccaccctttacctcgtgctgagccgccacgcgcttgccccgagcaccgcctcggcagccggggccttctccgccgtgggctcctcctccgcgggcttcttcgccgccgggctcggatcaaccctagcaccgtcttccgtagtgtctccatcaatgccctcgtccgcatgggcgccgctgccgtaggccaccgccggctagggttcagccctcgctagctctgatagtcgcctacgatagagctcgtcggggcggccagcgggagaggaggcagcgcgcgccggccgacgagagggagggagagaagcggtggtgcgcgggcggaggcggccggcgggagggcgggagagga

SEQ ID NO: 24125 - DNA, 389 bp, Oryza sativa
ctatcggaagaatcaccagggttctgtttcttccgtttgatgatctttttcgaaatcatccggttaacacccttgctgtcaacatctacacattcgctgctaattggcttgaaacggactttgccaacctttcttgcattagcctctagtatctgcaagggaggccagagatttagaaaaggtgacaaaaattatactccctccgtccctaaatatttgacgtcgttgacttttttaaacatatttgaccgttcgtcttattcaaaaaatttaagtaattattaattattttcctatcatttgattcattgttaaatatacttttatgtatacatatagttttacatatttcacataagtttttgaataaaacgaacggttaaacatgt

SEQ ID NO: 24126 - DNA, 742 bp, Oryza sativa
ccatgccgagccagtataaatcacttagatcgaaatatatattaataatgagactatatatattcatagcatagccgatcagatagatctagcatgtatcggctaatactccgataccactctatactaagatatcaaagcaagtaaaatatatcaaacaaaagcctaatatacttaaatgcgacaagatcttaacataaagggcagatttaacatatcaatgaagcatataaggtaaacatagttaaatcaggtaagatcggctgaaaccccgatactaccctaatcggcaaccaagaaacaggctagagattgatattctaatcatgactcataagatcaaactcaactgatacagctataagtatgaaagaaggacaatatctagacaatcaagccattggaagtttcatagagtggtggatatcctatataatctaagccaacgtcattatttaacctaatcggctgccctccactgacagatgttagccgattataggttagatagcgatattgctagagattatgtaagatatatgataactcaacgaattacataaacaagattagagtatcataaagatggaagcactaatcccgagaacgcaagccgtcataacaagttttacctcttgttgaagatcaaaaacgatgcagctcaacctgaaagcaagaactcgtcgaaataaaactaaagcaaaaaggtggcgatgcgccgaaattgtattgaacgtgtgtt

SEQ ID NO: 24127 - DNA, 529 bp, Oryza sativa
ggcaccatggtttcaaatgcacaaaattactcaaatttttcaaaaattttaaattgtgagtatatacctagttataagaattcgattcatacatatatctatcaacaaaacaactcaaatttaactttatttcacaattcatgattacatacctaactaattatatgtatggatgctatatacctagaatcaaaatctaacaaaaacaagttcaaattcagttcaaacttgctttgaactagttagtaaagtagttaatgttaatacctaaataattgaaaaagtttcatactcatttgaattggttatatactcaatttcaacaatggtgcccgggcaccatggagcaccaaacaaatttactatatatatatatatatatatatatatatatatatatatatatatatatgtcggtggtcggagggtgctactttcagccgcgggggccgggggtaaaacgctacatcccctgcgtccctccgaagaagtgggacgactggaagagcgactggttctacacccccct

SEQ ID NO: 24128 - DNA, 1713 bp, Oryza sativa
cgcatcgagactttcggtgtgtagtttgtctcctggcttctcttgaggaaaccttgcttagcacactgtgttagactgttagttgttaatcaggtactcccttcgtcccaaaatataagagttttgggggtagataggacgcatcctagctagtactacaaatctagacagaagcttgtccagaatcgtagtactaagatgtgtcacagttatctaaaagcccttatattttgcgacttagggagtagcacttatatagaatgaatgatgccgtatcgtgtataaccatgagctaagctaatgttttgtaagaaaggagaaagaaacagagaggcgtgactgcacaacacaagctttctttgatttccaagctcttatcttttccatatccatgagaccaagagctaatcccatgctacctgctggatggaacttggaacacttgcacctgatctgaatcattgagtttagacatgtggtgtcccactgctcccgttcgctttatcgtttctatcgaatgcgacgtttttattgcttttggctcccccctagatccatccatgatagcccatggttctcggatcaggatgcgagcaccggcttagtcgggatgacatgagtgaaaaaataatccttcagattagcataggtcgtctgaagaaagttcaccatctatcatctgatctgagaagaaacagaagataaggcaaatggccctgggtccatgccaagattgtgatggtaatgttaatctactgaatcagccgcagtctgtattggagacgcatgcggatcttcgcgtgatttttttggctgcaagtagggacaagttgctgtcatgatgtagtaattctgaaaggttggatgagttctaaccggcaaccgccagccgttatgaagagacaaagcgacacgatcgggagatgcttagctcgccattgttgacattttggagaaagtggagtattatatctatgattaatagtgtgtggttgtctggtgacatcactagattatagtacagtagaaaagtttcagaactgggcggctgcttgatggagcagaggaaatttggcactctgaaagataaaattttaatatcaaagtcaaacaattgatgcacgtaacaatttagcatgaatttttatatcgtatcaggatctgctgattcaaaaaattgaaaaactttggattgatgcaggtgacgttcctgaagtgtggaggcgtggccgtcggcacgggcatgcaccatgtcacgatggacggcgcgggcgcgttccagttcatccggacgtggacggggctgtcgcgtgggctcgacgccgcggccgcgtcgccgtcgccgccgtcgcacgaccgcaccctcctccgggcgcgctcgccgccgcacgtcccgttcgagcacccggtgtactccccgagctacctcaacgggctgccgcggccgttcgtgacccgcgtctactccgtcccgcccaagctcctcgccgacatcaaggccgcctgcgcccccggcgtgtccacgtacggcgcggtgaccgcgcacctgtggcgcgccatgtgcgtcgcccgggggctcccccacgacgccgagtcgcggctgcgcgtcccggccaacatccggcagcgcgttcgcccgccgtttccgttcgccctactttggcaacgccatcgtgcgcgacctcgtcacggtgcccgtctgcgacatcctgt

SEQ ID NO: 24129 - DNA, 5027 bp, Oryza sativa
tggctcgggatgcccatctacgacgccgacttcgggtgggggcgcccggcgttcgtggcgccggcgcagatgttcggcagcggcacggcgtacgtgacgcaggcgccggacaaggacgacggcagcggcggcggcgtgtccgtgctgttcgcgctcgaaccggagtacatccagtgctttgagaaggccttctacggcacagagtgatataatcggcggcggcggcggtggccggagtttagagctggaggacatcgagcgacctgggatgcatgatgacgccgaggtggtgtcgacgtctgctgactctgtgtcatgctcaatacataacataatatgcgttatttgatttgcggtagaagtatttagtgtatgctggtactgtgcaacagtgcaagtgtaatgagctgctgccttgttggttgcagctctctctacacagacactttggtctgtcttaagttcgtatgtacaaaaaaaaaatcaaatggaaatgaaaatgactatggaagcaaagaaagttcgcaagcaaacggttggttatttgtagaataagcgaaacagcatatttgcaaatgaaaaataatttgtgaacaaaacttttatatacgtgttcttagcgatttaacttttatatacgtgttcttagcaatctaaaagtaaatattgaaaaataaacttcaataaaaaaaccttaaaatcagctctaaatttaagtttaaaaatttaaattttggctaataaacattagcctaagcgaaaagataaagccctatggtgcacggctcgaaaattcgatcaaaaccggacgaacttcgtgaatttcgttgtttccggcctgggacgaaagcacaatttcgtcagggagttcgaacacttttgagattttccaaatttgagaaggacaatgaaaaatggggaaaaagtcctaaaaacaatcatgtttttgtggtacagactggcaaaaaaaataataaactgcatttgcataaaaattgggggaaatcctgaaagtagtctcttttttttttcaagaaacctcaattgacgaaaataaaaaaagaagtttgcatttgcatattgggccgagaccatgaagcatgacagaccggttaggcctatattgagcctgtatgtttctctatttgtatgctctttctctcgcacgcagtctgttggcatctgaaatttcgctcatctagcttggaatttcgataactcaaccggattttgatgcgtgccaagtggacttctaggatttgaattcaaattttctttactcaatttatccaaaaactataaattttttgaatgactttcgtgattttcgtcatatcgccagcgtccggcatccacggcgtattcagtaatgtaaacctaggtggttactacgttaaccttaaggtgatcatattaatataggatgtatgtacgtatttatacgagtaaatatgcacatgcatatataagtgtgtttgtactatggttcgaaaaagaaaaaagtgtatttaattttatcctaactatttcattgggtcacttaatctttcaaagtatgttttagcttattttaccacaaaaccattgaaaatgattcattttacccattgataaaatttctcctttttaatttgtacagtttatattttaaggtaatttttttacaaccattgataatgtcattatcaaaattttaatagtgaatcatttttaatagtgtactgtaaggtgcaaaaagactgaaaaatagttaaggaggtaggttaaatacttaaatgctttgacgaaatagttagaatatttctttttcgttactggacattgatttggccctcgtccgtgtgactggcgcacacgccgtggcgtgctcacgtctcaccctccacgcgaccacgccgcgcccacctatggcacttggcgcgccacctctggcatttggggggtgagttttgtgatacgcgccacgtgttttaggttgtgtctggttgggcttttcaatctgcttttgcttttgcaaaagccaaaaacaaatcaaagggctaaaagccacaattgcttttgctccaaagctgcttttagtgtagtataaatccaaaagtagtccctacccctgctttcattggcttttgagagaaaaaattacccacctatgccattatgaaaaaacgattcgcactttttctttctttcccgttccccttctcgccagaccgagcgcctggccattcgcagttcgacgcggcactagggtttgcgccaccgccaccgcgcgccacccatgttcccgccgccagcgtgctcccgtcgtcgcgagccgcgtctcccggcgctggcatgctccgacgcccgtctccccattgcccgcccccacgccacccaacgccgccccaggctgcccgatggccgacggctgtctccctgtcgctcgcccggtggccgtctccccgtcgcccacccgacgccgccccacgccgcgccgaagccacctctgctcgacgctgcttgaagacacccctgctcgacgccgcccgacgctgctccgatgcctttgccactgctctagccggtttgaaaggtgaggccgaatcgcccctgcccctgctcttgtgttgatgcatgtgttgtccctagaatattacagcaaattgatttttggcctgcaaattgattgaagaaaaatttatttggttcaagaatgggtgacaaggcagattggggtgatgattttataaggcatttgtttgatgtttgcaaagaagagatagaagctgggaatatacccatgggaattttcaccactaccggttggaaaaatgttgttttcaagtttgcagaaaaatcgggtgacaagcgaaccaaaaaaaacaattgaagaggaggatagttattttgagatatggcatcattgtatgaatgctctgtttatgtggaccatatcactttgatggatgaaaaactaatatattttgatgaaaaacttatacattttttctacaaattggccttttaaatacaaaatattgaacatattaggttaggtttgtacgagtaatttgcatataaacagtcctttcttatacaacttacagtttcacagctgctctaaccaaacgggcttctgcttttcccacagtttattttacacagctgcttttccacagcccacagatcacaacagcttttccaaaagccacaactctaccaaacacacccttaggctatgtgaaaatttttgccgcgttacatcagatatacagacacatatttaaagtattaaatatagtctaataataaaataaattacagaatccgtctataaaactacgagatgaatttattaagtctaattaatccgttattaaaaaaatatttactgtagcgttatattgctaaatcatgaagcaattagacttaaaagattcgtctcgcaatttatacgtaatctaactaattaattttttctgtatatatttaatactttatatatatatatatatatatatatatgtccaaatatttcactcattttatttcgtgagacagggtgaaaaaattatcagctctccgtctgcccagtgatatccgcactcgccttttctgactgctgttccctgaatgcacgtcgcatcaagtcaggagaggcattgaacaggagatagaaaagcccacaagttctcttcgagaaagagaagtattagttttggacaatttttaagttaaccttagaaatataaatcataaataacttttaaattattaagtttaaaaatataaaaattatatgaatagatttgtcttgaaaaatacttttaaaaaaatatacatatatcacttttcaataaatatttttataaaaaaagtcaaagttgtgttttgaaaaccgtatctctatccaaaacaatttcttttataagtacggagcgagtactcccgcatcatctgcagaatttttacgacggttaatttatttttcataagaacggaagtacggaacaaaacacccgcatttcacccgcatttcttaagatgatgataggtgtcgggtgaaaatctgatctgcacactagattagctactaattacacacttcgccattgtgttcggtaagactagaaattattaagaaaaataaaataaattttaccccgttaaattgagtagcttaaatcatacaagtattagttgcatacaagtataattatacaagtattaccccgttaaatggagtagatgcacagtattagttgcatacaagtataattgtacatataaaaacaaaagatcaaatttataatatgaaattcactcctaaatttaatattaatatataaagctgtatataaaattcagctcacgtaagattgcattgaaaaatcccctagtttggactttggactaacacggtagaaaacgatcatgctctttagcttatcagctgcaaccaaaatttaaattttaaatcttaattttgattattttaatcgtagttttttttcaaccattatttttataaatctcgaatcgatataaaagaaaattgaggactgctacaaaacaggatcccgttgcaacgggatagacatattaactattctcttgtacgagtatcacaggtattaggtcctaggtatcacaagtaccgggtaagaggtatcacagatatcaggtaccatgtagctggtaccaaaacaggtatcatactgtcttatagatgatatcctgttacaacatgataccgttgtttgaagaaaattacccacacattatttttctcgcaaatcatcgcttctgaagatcacacaacggaagtccggaacccacgcccaaatcaaaaagaagcggacgccccccaaaaagttcaaaactttccaaaacatcgtgtgcgcggttgcatcgccgcccacccgcctcatcgcatcacaactctcgcctaaaaggctaaaacccttcctccgtcggccgaacccgtcttgattcgccaatggagttaccccgccgcggccaatcctcccatcccgccgacgccg

SEQ ID NO: 24130 - DNA, 2067 bp, Oryza sativa
  unsure (1)..(2067): unsure at all n locations
ccgcttccctgactccaccccgccgagcggtaaccaatcccaactcccaaaccctcggtattcccccaaattcgttgtgcgatttttttatttttatttttggctacgaatcgcattatctctgttgcaaatgatgatctggtggtagattggtagtgaatgatgctaagatttgttttcatgatgcagtagttgtaagcggggttagtgattttattttttattttttattttttattttttattttgattttgatggtgttgtgttcatgggcaaaggacgcgaagctaggccggctccggcgcagggggacgcggtgacggcggcgctggggcggcggagggaggagctgctgtgggagctccacaagacgaagatccaccgggagatgctcctgtgccagctggtcgagacggagcgcgccatggcggcgcgcctcgccgcggcccgcggccaccccgccacgccaccgctcccgtggccgcagggcgacctgctcccggcgcgggagtacgcgtggcggagcacgccgtgggaggagcaggcgaacgcgaacgcgaacgcgcacgcgcacggtgccctctcggcgccgcgctctggtgacgaggagatcaccccgtggtggcgccggagcccgtcggcagtgacacccccggtgtacccgcacgtggagcgctctccgtcgccgccgattgcgcggggatggccggccgacgatgacgagcggcaggaacgtggggagccatccgggtcgccggcgatggctcctccggtgcggcatgcacctcatgtcgaacagtccacaccagtgccgatcaagtcgcctgcggcggaggccgtttgtatgccatctgggtcaccggcgatggctcctccagtgcagcctgctcctcatgtcgagcagtccacaccattgccggccaaggagcctgcggcggtggcgaaggtggaggcagatgccattgtccagactgcggccaatgctgatgccgaccaggcgttgctcggcaagggggcgacaccaggagggcaaggttgcactggtcagaagggtgaggaaggtgatttcgccatcgacggccatggcaggcagctgttgggtgagatgaatgtaagcaagagcaccgagcagccaaaacctacagaatccatctctggaggccacaccgatgaacttgtccagaagcgttatcaagataataagccggcagatcaggagattgcaacattggacaagcagaagcgagtaggttccaatgatgaggtgattcgcttccgttactgttgttccccagtttttgctgccttttcatgtttacctatcaagaatgctgttcagattatgtttgcatgtgcccatactccatattgccatactgtgccacacttgtacagtgtacacttgcgctatatatttctttgtatcgacctttcaccagcatcttagcttgtttacaaatccataggcacttataggaatcaaggcccatttatgtgggattttagcttacaatatcaagttcaagaatgatctactagcattttacttgcagatcaggaattgtgtgtggagagctagaaaaactatatcagttttcgttgtgtttacttgtacgggcagattgaggtaagcaaccgaacaggtggaaatttaaaggtgtaggataaaatgtctattcaaaatcagcaagtttcatctttaatgttgcagtgtacaatttatagtagtattagtatatatttagttagttaaactgtaggattaccatcgttcacacatctggccttatttatcactttacctatctgagataagatatttgagatgatactgttgtgttgatgctctataacaaacttgctctggaacagcttacaccagaaaggagatcctctggtgtgaagaggcagctggcttcaggaacctcactggcaaagaagccgaggtcccaggggagctccatcacttgctccctctgcaaggtcaccatgacttctcccagggcgctggttgagcaccgggcatnnnnnnnnnnnnnnnnnnnnnnnnnnnnnnnnnnnnnnnn

SEQ ID NO: 24131 - DNA, 13385 bp, Oryza sativa
  unsure (1)..(13385): unsure at all n locations
nnnnnnnnnnnnnnnnnnnnnnnnnnnnnnntgtgtggagagctagaaaaactatatcagttttcgttgtgtttacttgtacgggcagattgaggtaagcaaccgaacaggtggaaatttaaaggtgtaggataaaatgtctattcaaaatcagcaagtttcatctttaatgttgcagtgtacaatttatagtagtattagtatatatttagttagttaaactgtaggattaccatcgttcacacatctggccttatttatcactttacctatctgagataagatatttgagatgatactgttgtgttgatgctctataacaaacttgctctggaacagcttacaccagaaaggagatcctctggtgtgaagaggcagctggcttcaggaacctcactggcaaagaagccgaggtcccaggggagctccatcacttgctccctctgcaaggtcaccatgacttctcccagggcgctggttgagcaccgggcatccctcctgcaccggtctaacctcgcgccattgcgatcggggaacaaggccaccactgaagctgcgcagcccgcggagaagaagaccgagaagccagaggcatctgaatggaacagcagtgcacaccaccaccagaatcggatgtactactgcgatatatgcgaagtgaggtgcagcagcgagaagatgatggcgtcgcatctcgccgggaagaggcacagggagcggcacaactccattttcatgtaatgatgatgggacacagtacaagcttgccgctttgccgcagacctgcagcagtgcaaaaaataccattttgtttgaaggaaagattgtttaggccatgtttgtttaggtttatacgatcggtttatgagaagtttaagtctaaacaaacaaatcaatttattggttcggcttttttaagccataagaaaaaactacatgtcacagtagttttttgggattatggaaagtgtattttttactcgaccattaaactcaggcttcgaagtcactgtcttacaaaaacatcctccattcaaaagagttggcttaaaagctagtaaacctaaacaaaggctctgtttggatccggaatcttgctatttagtagtattatacgtagattactgacaaaacccattccataacccctaggctattttgtgagacgaatctaacgaggtatattaatccatgatttgctacagtgatgctacagtaattagccgctaatcatggattaatatacataattagattcatctagcaaaatagcctaggggttatggaatcgattttgtcgttaatctatgtttaataattctaaatagcaagattccagagggatatttaatagcatagaggatccaaacaaggccaaaaagggttttaacttttaacctgatgcttataagtcatgattggtgaaaatatttggggtaaagcttctgtactttatactatagtgtattctgcttattaaaaaaacaatctttccttctattcttagtggtgcaaaagttcagattaaaaaataccaagcaatgagaaaaactctaaaaattaagttgtatgaggttgaaggataaattttgcagaactacggagattttggcatgcgggcgtacagcacgtaacctaggtattttgatgctacaattttacaaaacctcatcctaagcaaatctgtttttagataattgaatgaaatatctcggcctttgctcaagagctacatctaattattataaggttaacacaaaagcaaactcacacaaggagtatgtagtcaaagttaaaaactaaaagtagaagcaaattaataaaaaccaaacaagataaagacctcacaactactaattctatcaactattgattctattggtgaatcttcacccgaatttggcaaatagctacatgattatcgactcaagtttacgacatgcatcttttgttagcttgatatgattctaagcaaatcttagcataagttatcttagcaaaaatttatatacaaaagttgttttaaaaaaccatattaatctatttttcaaaaaaaaatagttaatacttaatttaaatgcaatagtgcttcgttttgcttgccggggaggaggggttcctcctcccgaacgcatcctctaagtatataggatttgctcaaacatttcaaatttagttacggcctctaggccatcctccaaggcaccttgctacagttttagctctttttggacaacggattattatctaggattatttgttttacacatgtaaatttatgttttctaaaaaaaacttagggaccctttaaatcgtagaattgaaaaaacgtaggaatagaaaaaaaacgtaggattttaatagaaatgtaagtataaaacagatgattgcaaaaacacaggaatgaccgtttgattggaccacaggaaaaacgcaggaattagaagagagataaagactcgacggaaagtttccatgaggttctacctcaagttagaattcctctaaaacttgcatggagtattaagcattccataggaatttcattggattttatagcatctattcatttgattcaaagggctatataggaaaaattcctatagaaatgagatcctctaaaatttatatgaatttcatttgaatgaaatgggcccttaacttttctcttttgcattgtccacatgtagactatgtagtactccttacatctacttttgatagtcattttatcttgacacacagaccaatgataaataattctacttatcattcatttaaatatgttactactcattcatcgtaaacaagcaattcattaatatttacatttttcaatgtccatatagccaatcatgtgtggaagaatggagagtcacgcattaaatccgaaaaagtcattaagggaatagtttgttggattgaaatatttctatcaaaaataaaatttttagatttaaaaatataactatcaaaaaatagatagagagagtacaaaagtttgaccggtatccccgccgcttcattgaaagcaaccacctctagttcttcccagtgtcttaattaccggccacgtattcgaagatttccaatgcggatatcgctagcactagtaatttgaccgacgctactagtgctagtactggagtagtatgaaacagtgaaccagccgtaatctccaatgtggagtattcgctttccctattacgatgagtctgaattaaacgacaattatttcctttttgcacgttaatgtgacgcttcgtttttcctttgcctctaagcaaatcattgcaaacgcgacgagtgtgtgagaaactgagaacaaatcagccattaatctctatatcattagctggtcacgcggcccaattgattcctataaaagccgccccactcaccattctgcttctgcgctctgctttttctctgctcttctcgatttctccggtgcaccgctcctctgatcggccgatggacttcgccgacgctccgtcgcacggtatgcatcgacgaagctctctagtctatcaacatcttctactgtcgtctccatggccgtttctttgctggaaaattggagcttagaaccgaacgatgtatagtaaaacgctagtaaaaacagatgaccctttccgtgtcccttggttgtttagattatcagatgcgatgcgatttgatcttacgttttttcatgccatgaatccactttgcatgcatggcagataaaaatgtcgatttcaaaacggatataccctatacaggtaattagcacagatctgcttgtgtgacagatagattctgatgcagaaaagtttcatcaaaactgtttgtttcttatttcgttacaaaaacagagaagaaacatgtccatcttggatcggcactcgatagacttctgcgtttaagccttgttagttgtagtttaggcactagacatgttgctcgtgcttaatcaatcacgaagaacatcatcatcaacaatggctggtgcatatacttgcaggagactcgctggtggtggtgagggacgcgctgctgtcgcagctccagcaggatcgcctccggaaggacatcatcgtcgccgagctcgccaagatagagcgcgccatggctctgcgcgatgtctcgcagtcgccgacgccccggcacgccgccgccgccgccgccgccggaaagactattacaactgtggtgagaaacttgtatatgccatcatgtttttgagtcatatccatgacccatcaattttgtgtctctacatgtatcagagtattgttaagaaaacaaacctgttcgatcagtctatacttcgtctttgttcttttcaatttcaaggtagtcaacacattaatgtagttctttcagactcagtaatactggggttaattagtgtgcacttgcactagctagctaatttacttgtattttcgtaattggtctcaacttcattttctaatggtttactgaaactgcatatcaagcaggctacaccggccaagaaaccatcgccttcagagaaatctgaaccggcagttcagaagtcgatgccaccctcggcatggagctgcgccgtgtgccaggttcgaacaaccagcgagcgcaacctacgtgatcactgcggaggtcagaagcaccagtccaaagtcgcagcactggagaagacaaccaaggccatggcgagaacgacggcgaaaccttctcccggtgcagcagcaagatggggctgcagcatctgcaacatcagctgcaacggcgagtgcgatttcgatacccacctgaaggggaagaagcatcaagcgaacacccaggccttactggaacaaaacaagaagagctcagtgaatccagagtcacagggaaccaaggcggcggcagcaacactgatctgcagagtttgccaagctaagttcacctgtcagtcagacttgcagagccatctcaaggtcatgaagcaccagctgaatctccgggcaccatcttcagatggctctagcttcaccagtgcaacctcggagagtttgagtttggaattgtattcttgcaaggtttgcagcgtgaagtgcaccttcgagaggatgctcgcgtaccatctcactgggaagaagcacctgaaacaggagaatttgcagttgtcctgcgagatctgcaaactgcagtgcaacagcgagaaagtgctctctgaccatcgttatgggaagaagcaccaggcgaagctcgagaaagtgcttcaggcaaagctcaatgcgacggaatgagatgcgtctgattctgattaaagatgctggcgttttgacttttgagcaacgaacatttaaattatcgacggcactgtatgattatttcagattattaatccttgattttgggacttactgctgctgcttcttttcaattgcttctatatactagtacaaaaataatctatacggtttaaaatgccactaatactacttgtgcaaatcaatactcaaatatcgactgtactcttgctcaaagacgcgagtatgtgccctcttgaattattttacaagtgaatggtaccaacaaaaacatcgatttaattatttaaacaggacacaatcacaatgtttccaaaaggacaaaaaagcacaatctgagtgacataagcctactccctttgtcctgaaaaaaacgaatataggactagatgtgatacattctagtacaataaatctgaacagagatatgtctaaattcgtagtactagcatatgtcatattcagtactaggttggttttttatgggacggagagagtagtcaaaatctgagtggatattttatcatatcacattgttacatcgaacttgccttgaggcatgtaaaaactaaatgatatgccagtttatgcaacaggggtgtaactcgatgaatgagtatccttaactcgtatctttatgctgctctccactaatagttctatggagtatcattccatacaaacaatacaaaattctcactccatgcaaaaaatataaggtgcattaattttacttttttttttggacaagactttacccatgattactttattaaagtagagccctatatatattaaagtagacaagacttcaccttatctcatctctatggttctcatggacaaactctcaatagcaagcctgcatagttcatctcaggttattagagcaagtttaatagtatagcccactactagctccaattcatctataatcgatctaatagccaattcatacgatagttgcttactatactattgatatattgttccacctgtcatatacacattgcgtcttggagtccgtgctgcaaccaactacagatctgtagcctgctgcttttctctctcactattatctcactaaaatatatttatagttggctaatagcctgctattgtacctgctcttatgcggcatatttgcaatcaaagtgaaactattatacgggtatcagaagttgtgcattgcatgattaaaagggtagtttttttctaagcatctatacttatggcctcacatttttcaaaaaaaaaaagcctcacattgttaatttagtacttacctccctccatccctagaatactactccaaaaagtattgttttgagcctaaaaaatttatcccttaaaaaatctttttagaatgaagtccagtagacatctttaatactacttcatcccctcttagtttttcgaatgatgttttagaatgcacgccccccttcttagtctaaaatttcatctcgcaaaacatatcttttaggttggggtccattaaatcttttaaatatcactccatttgttcctaaaaataaatgtagttttagagtgttccactgtaccctttttagggcccctttgaatcgtaggaatgaaaaaacagaggaatagaaaaaacacaggattctgacaggaatacaattgtaaaacagaggattgcaaaatacaggaaaaacgcaggaatgaccgtttgattagaccacaggaaaaacgcaggaatcagatgagagggatagactcagaggaaatattccaagaggttagacctcttgctaactttcctccaaaatgtgcatagaattactcattccataggaattttaaaggattggataggattcaatcctttgtttaaaatgccttcattggattttttttccatagaattaaaatcctctaaaattcctacattttttctacaaatcaaaggggacctaatattactctttttttacttccatttttagtcattgaaccaatagtactcgcccctctttcttgatttcctttcccactaagtttccctgcatcatgcgaacgtaggtccgcaggtgtgcgtgagaactgagaacaaagcagcctttttaggctgtgtttttttaggggttgggaaccccttcccttcacacagaaatggaacgatagattaacacgtgattaattaagtgctagctataaaaaaactttaaaaaataattaatatgattttttaaagcaactttcatatataaactttttttcaaaacgtgtaccgtttaacagtttgaaaaaaacgtgcacgatagagatgggttgagaacccataaaaaagaacacagcttattcaccaccattgttggttggtttcgcggcccggttagcatcgagtgccctataaaaggaataagttcactttgactatcttaattagtgatcgaatattatcgtttgatatctcgactctcaaactattaaaatcagtgtaatttgacttccccagtggttttggaggacggttttactgatatggtagtattggtgtggcgcttaggcggtattaaaattgaagatatatatatatatagacccatttgtcattcattagaaaaatgtgagggccacttttctccctctcattcggaaacttttcacactagttaagggagtaaatctgaacttattcctctactaaaaaaactactctatctcccaacgctttgctttttgcgctctgctttgctagctcgctttctccggtgacccggtcggtgcgctgctctgctccggtcctcatctgatcggccgatggagtttcccaccgccggtggtagccgcttcgccgacggtacgcatcgaagctctctttctctctgccctctctacctagccttcctaggacaggatctgtggtcgaaagggtgatccgtttcgtatctctttggttcagataatcagatcgtgttttgatgtcaagaactctccatcctgcattcattacagttagattgcaaactagatgcatcatacatgtcaaatagcacaaatctgataataggacttctcaaagactgttgtctgttcatctggaagtggatttttgtctcttaagaagacatccccttattttatgcatggcattcaaaaagtattaaaaaatttgttaagatagattaatatatgatatatcttttcgcaaatatgcgagttaaaatttaacttatacaattcgaaacaaaaataataatttgagcatgaattgctattcatagtcaaatttgttatttttgtttctatttgtataagttgaatttgaatttgcatgtttgtgaagtgatatatcacatattgatctatcctactaaattttttcaaattttttgatggcttttccccttaggggatgatttgagttttcctgttcatcttttcgttaagataaaaacaaatgaaacttgttcatcttagataggaacctgacctgacagcgattaggccttgctagttctagtttaggtgtggaataattccaatgttgcgtgtgcttgaccaccaaggacacatgaacaacaacaatggatttgtgcaagcagtagcaggagacccgttggcggtggtgagggacgcgctgctgtcgcagctccagcatgatcgtcttcgtcaggagatcatcgtcgccgagctcgccaagatagagcgcgccatggctctgcgcgatgcctcgccgtcgccgtcaccgagccccggcacgccgctggaaagactgcggcaagtcaggtgagaaacctatgtacctgtatgcttctgactaacctttttttcttcttctcacattatgatattcagatatgatcatatatattccatccattttgcgtctctctgcatttgtaaatttgttcatacttcagcatactgttaagaaagttagctccttgtaaggcagatacttgtttgctcggtcagtactttgctaattttcttttcagttgtaaggtaaagaattaaaccatatgtaaggttgatgtaaggttgatgtagttctcccaaactcaaccatatgtatgtggcattagtacggtttgatctattggactaagtaatactccaatttacttcaatttcgcagtttcctttcgtaattgtttactcaaactgcttattaaacagacatggagctgcgccgtgtgcgaggtgcaaacaagcagcgaacgcaacctacgggatcattatggagggcagaagcaccagtcgaaagtggcaggattggagttgaaggcgaagacggcgacagtgaaaacgacggcgaagccttctcctgttgcagggcagagagcacacgctgccagatggagctgcagcgtttgccaggtacactgcaatggcgaatggcatttcgatacccacctgaagggcaagaggcaccaagcaaatacccaagccctgctggaacaaagcaacaagaattcagggaattcagaatcacacgatggaaccaaggcgcaaccgagcaatgtgagccatcacgccgagaagaagaagaggaagaagaagaaggaggaggaggaggaggcgacatggatctgcagagcttgccaagctgtctgtacctgtgaatcagacttgcagaaccaccttaggggcaggaggcatcagctgaaagttcaggccttgcctgaagctgcgaaacaagagaagaacaatcctcccaagcttgcaaagaaccctaataagcaaccctcggaatgggtttgcagtctctgccaggccaaatgtaacactgaatctcagcttgagcatcaccgcagaagcacgaggcaccagcagaaggtagaatctcttggatggaatgcgaaagagagtgacctggggactctgcaaggaatgtcttcggatggctctagcagcaagagtgtaaaaatctcagcgacgatggataaacagaaggctacgtatttttgcgaggtttgcagtttgaagtgcaccagccagagaatgctggcggatcatcttagtgggaagaaacacattaaacagttggagttgcagctattcagctaaggtctgtaatttagctaaggtttgtaatttgcagtgcacacacagctagaaaatgcttgctcatcatcgtgaccaggaaaagctcaatgcaaagaaataaaatgttgcagcagatatgagagttttgaagcaatggcgttatgatcaacggtcatttaaattacgcgatggcattgtatgaatgtgaattgaattattaatcattaatttcaggacttaccgctgatgttttccttttgcttacaatacaacttgcttgatattcataattcatttcacatgttacaatatgatatacatgtcaaaatgccaggatgccagtctgctgcagttgccatttcagaagtaaatggtaacaacaaacaaaaaacattgatttgtcaccatgtttccaaaggatgcagcagaacacaatccagacaaatgcagtcaatgtgcgtcagttcaaaatctgggtggatatttcataacatcacatcatcagatcgagcttgcattaaggcatgtctaactaagactcttgtgatatacaaagcactgcaaaatatttcagaaaaaaataagcagagtgcagttaatcatctgagaaggatgttatttcatagccacatctatggaaggactagaccttcaacgctacacggtcttgccatgaaacactcctcttatcatcgcttgccggagagtttccggtatccctacaagctgataggttgacatcggcagtcataatatcttcatctactccagcctgttcagcctttttaagttccaaatggttatggtgccccgggaaatcagaaagctcatcattctgtagttacagaaaaccacaatgttagttgtcagaaatagattacgttttgtcagatatccataacactccaaaaaaaagttacataccattgcagaatcttgatttaaatctaaatctgttcttttactggtagatggcacttcagtactcgccccataaaaagctgaagcatcattgattcccacatgagatgggactcgcggagctttcttcttcagccgtacttgctgcgaatcattcttcttgaaagaatttaacttcttttgtaagaaccttacaaacaaaacagtttccatgattagttgaagaggataaaagggtcaatactactactactatttatgatagaattcacatagcttgcttcgttaacatcaattgagtagatagatgggaacatggagggacaagaaagaaacggaagtgctgtcatacttgacttcagaaagcaggacgagctttcgcttgtttatgctctctagcttcctcctcttcatctcattatcctgcatcaagaaccgctatcagattcaagtccaatgtagtgcaagtgtatatatgcagtatcaatgtgaccatgtcatcatcccatgctacaaccataaccaattcttgacagccctagtttcgcactaacatcagctatgcaatcaatcctagtttcacactaacatcagctatgcaatcaaccctagtttcgcactgacatcagctatgcaatcaacccctggactcctgcaatcaagcggagcagagtactaggagatatcatatgcaatacaaaattgcaaccgcagcgaattagtagttcagacaaggaggtgaacaaggagattcatcggcgaaaccgcgccgcaaagggcaagggaaaccagagggggcaaacccttcaccttgagcacatcgcggtagtcccgccggagctcgtccaacctgtccctctcgcccctctccgccgccggaggcggaggcggaggcggagcgagcctcttcttccccttcctcctcaccagccgcacctccccgtcgccgtagtccatctcgtgaggaggacgagggcgagaggggagggggggctaggctagatccagacgggggaggcgagggcgaggaggagggaagaccgagggccgcgtggtggtgtgaggggatcaggaattcaggagggggtcagtcaggccacgggggggggagaggttggggagaggaggagatggggatagcgaggaggagaaggagcgcgtcctccctcctctccatatccgatccaatccgatgcggtcgcggccgcgtcgtcttcgcctcggaaaggtgggcgggggcgggggcggggcgaggcgctggtcgtgggtgggtggatgcgtgcgtgcgggcgggcgagagcgccacttcttttttttccgccatagatatccatgaccatccatccgttcgacgcggttgatggctgtggtctgtgcggctgtgcccccatgcgactggagttgagctgtgcttgtgttgtgcttgcgtgattggctgggggcggatgtcatgtttgtcttcctccttggtgtccatggttttggccttcgggggcatttttttttttttgacttttgcttcagcaaaatttgtttgggtttaccaaatgttccttttttactcttatatagtaatccctctgtactcataaagaaagtcgtttaggacaacgtttaagtcaaaccttgggaatataaatcataaataactctcaagctgttgagtttgaaaatataaaaattatatgtatagatttgtcttgaaaaatactttcataaaagtataaatatatcacttttcaataaatatttttatagaaacaagaagtcaaagttgtgttttgaaaaccgtgtcgctgtcctaaacgacttactttataagtatggaaggagtatatacataaaagaaaattatgatgatttttctcccttatactatgttaatatagtacatttttatctcccttatgattcatgaaaattttgcctatgctagttttgtttatatgttttccacgatatttatgatttgtccctctatgtttggggtgactttttaactacccaagttcaccatggtatatttatatattttaccgtgttgaactgtttgacatttagaatgtaaacttgcatttttactactaaaggaattgacattttaatacactggtactttgatacaccctcatcaagtattctaactcggaagagggattttac

SEQ ID NO: 24132 - DNA, 3582 bp, Oryza sativa
atctgcgaggggcaaggtatggaaagaaaatattgtaataggtggcattaatgtaaatatgatgatattagaatgacaaatgtgtcttttacacatatgaaaaggtatgagaaggtatcgaaggaattagcttgtagcctgttgcgttgcatcgttcttagatacgttctgttcgtacgtaaggtttatgtgttcttcgataagttgaaaggtggagaattgagggccagcggtggacttgtggccggaggcggtggttggagggaggggcggcggaggaagaggacccggaggaagtggtccaggactgcctatgttcgccggagctagaagcggccgcacggtctcgatctgtcagacgattggtttagttttttttcgcaaatcttcctcattgaacttgttttgttcttgttaggttcttaaatcttctcaatttgttgtcctttcgatctttgattacattcatcaaaagatggatcaccaaattgctatgtaaattaatgactaactggaaataattatcaagatcatgcgaatatgatatgtaccacgtaaatcggaccaaagtttggaaaccgacacaaacagaacgaccgaagattggaaaccgaatagaagagaatgtaatttttgtccccaccacgtaaatcatattttacgttacctttaaaaactacttacgcggtaccttgtggtaccttcaaatccacttacaccatacctttcggtacgtccatacgttgttaaacataattgccctgttatcaattaccttttaatccatagtacctttctacctctgatacctttcataaggtacctttcatcgtgagccgttagatctatgccattttaggaatgcaaacactgtaaaaggtctcaactcagaaacgggaggcctacgggaggggctaaacatactagggaggactatgccaacataagctcattatttcgcataggaaaaagtacgaattacccccctgaagtattaggtgagtacgaattacccccttaaacctgaaaaccagtcatttttcaccctcaactatcgatatcggacgaaaaacccccctaagcagctttgcaagcggttttggtctacgtggcagtccagtcagcaattattttctttttaaatcagtgggccccacatgtcagtctctcaccctcttttttacccctcacctctctgtctctctccaaaatccactctcttcttcctccctcacctcgatgatgacggcgggcagagcacgaggcgacgaagggggcgatggagctcgggacgatggcgggcggcggcgaagagggcgcccgcggaggggatgcggcaagcgcgccgagagggaggaggcgggcgcttctctcctctcccccgccgccgcgctgcgcggcactcctctccgtgaacgagctcgtgcgcgaggggcataggaaggccgagagatgaggaggccggactccctcgcgaccgccgtctctagccagatcccagcgagcaggcgtcggggaagggtagtggggcacggcggtcgtcgtcgggccagaggtggtcatcgcagcaacgagtatggctgggcttgtcgtactccggcgggagtggctcaaacgacgacgacggcggaggaggaggcgcccactcagcccgctccctggcctcctcacctctccctccctcctcagcctgctccctagcctcctcacctcttccctctacgcccaccccactattgccagcatgcttcggccgccgccgctccgcccgccccgctctgccaccgctgcttcgccccgctccttctcccgcttctagtcagcggcgaagttgccaagcagctggtgggaggtcacggagccatccatggtgaggtagagatcgtcggtgcatgccgcgagctccttctgtgtgcggtaggtgaagttgagcgcggcggtgacctccttctcgaagcgggagaaggggctcgtagtgtcgtcgagacgcagcttgcggagcttgcagaggctttccccgagctccatcatggcaccacggtggttctgtgtttgtgcacgatcatgtgtctaatcacaatttttactggtggagtaataattaatatgcatagttaaatgtggaaatgagacgatgaaaatatacttggttgaagaggtggtggaagccgacggcgcactggaggatgcgtggagcagccggcagcgtccgggtgggctcgtcggtggtgtaccagagctcctccacgacatcgtggcgcgcgtggaactcgccgccgttgaacagcgccaccgccaagtcgaagctcccacatatgatttccgacgactcccaccgaagcagcggaggaggcgcccgctgctgccggcgcgcgagccgcagccgccggcatcggcgctcgctgctgtcggcgctcgagccgcagccgccggtatctaacgggagtgagagagggggtgagagggaaaaagatagagagaagattatatctgacaggtgggccctatcctttatttaataaaaaacttactgactggactgccacatagaccaaaaccgcttataaagctgctcgagggggggtttcatccggtatcgatagttcaaggtgaaaaataactggttttcaggtttaggggggtaattcgtactcacccaatacttcagggggtaattcgtactttttcctttcgcatactagctctgttcctttttacattatttatcagattattaaaatgaatcatttgctcaatgctttaaaaactttgttcgatcgtattattttaatctcttgtttatagatatatgttaggttaattttgtttagaaaaaaatatctctataatcaagtagataattcgctcaacaaattaaccaaatggggcctagaccaaacattatagtttaaaacagtttcatatgaaaacataggtgaataatgcaaaatacatagcaagatagcaaaagagaagggactctgttgtccccatagttgatccggcatggaggagaggtggaggagagaacgaggaggattatcttgtccgcgagaagaggaagaggatccgatgatgcgaagattaggccggaatccctgtgtcccaacccaacagtgggtatacggtctaaaatttgagtagccgagaacatactactaacactttaaataaattgagtgatataaattacaaatgttctttttatgtgttattcgtaatgattggaccaacactttggggttgctccttcagcttcgacgatattactttaccttatctgtcaggcatggcctaataatctatttactccaacggccatagagaggaggggctttctgcctattgtatgggacatacaacctctgttgacgtttttgcatctatacaggatacaccaatagatggtagtagagagtgtttgctgtgttttgagtagatggtagtagagagtgtttgctatgttttgaggatatgacgagggtgtatgtgatgttactgtcctatgaccacgtttttcactattgcaatgagttagggatagtgaatttaggaaaagataatttttccactattgcagtg

SEQ ID NO: 24133 - DNA, 1226 bp, Oryza sativa
ggattgtatcattatttctcatactagacaggcattatagcttaaagcaatttcacataaaaacatagagaactgcaaaatgcatcacaagatagggaaaaaagaagggagctccactggtcagagggctagggggcttgagcccccttgccatactactaaaagtaattcattttacttctagggaataataaccgcatccgggatgattttttgtccgtcattgtcatcatctgctatgcgattttttttcttcaagcaaaacatactaaactctagggtcctcttggctcgatatgaagcagatttggtccgattattggaaaaacgagaagagaggaagataaggatagaaaccctcaatcaattttggattatctccaaggttgcattcaaattttacaaaggagaggcgttaggcagctgagggactctgtgacattgtagcgatggccctacgtgacaatgacaggagcaaggggagtccgattagacttttgattgcttgatgggccggatgtgcgattgcgggctgaggcggaggggaggagaagggaggaaagcgggccagctcgctgcagactgaggaaggaaatgggatcaaaatggtctagatagaaaggagggtttgatttttatttaaataaatattgaaatggtgtttgtattattaaaattagcaattgacctacaaaaattccgagaaaattttagagagtgtaattaatcatggataatttaataaaattaaacccaaccatgtaattttatttctcacacatactttactttacttgtaaattaatttaattctagaccttcctacttagaaatacccaagtattcccaaaacaatgtattttaattaattaaataatgtaaatgtttatcgattttttctaaattttctcgtattttcttcccgttgcaacgcatagacaatttttctagtcttttataaaatacaagattatttagagaccatgtttttacattagttgagacgaaaatgatcttactcaaaaatattcttcttattactattctttccattttttcaccctcatgcaaccatgtttccatattatataggctaagagtcgttgttgagctgttgttacccatagcaccgatgttttgtctctcatctttcgctctttcatgtcaacgaatattcctaattaacaacgccaagagtccgctattaacaaccattgtacatgccg

SEQ ID NO: 24134 - DNA, 817 bp, Oryza sativa
  unsure (1)..(817): unsure at all n locations
nnnnnnnnnnnnnnnnnnnnnnnnnnnnnnnnnnnnnnnnnnnnnnnnnnnnnnnnnnnnnnnnnatcaaatcgcatcgcatctgataatctaaacaaccaagggacacggaaagggtcatctgtttttactagcgttttactatacatcgttcggttctaagctccaattttccagcaaagaaacggccatggagacgacagtagaagatgttgatagactagagagcttcgtcgatgcataccgtgcgacggagcgtcggcgaagtccatcggccgatcagaggagcggtgcaccggagaaatcgagaagagcagagaaaaagcagagcgcagaagcagaatggtgagtggggcggcttttataggaatcaattgggccgcgtgaccagctaatgatatagagattaatggctgatttgttctcagtttctcacacactcgtcgcgtttgcaatgatttgcttagaggcaaaggaaaaacgaagcgtcacattaacgtgcaaaaaggaaataattgtcgtttaattcagactcatcgtaatagggaaagcgaatactccacattggagattacggctggttcactgtttcatactactccagtactagcactagtagcgtcggtcaaattactagtgctagcgatatccgcattggaaatcttcgaatacgtggccggtaattaagacactgggaagaactagaggtggttgctttcaatgaagcggcggggataccggtcaaacttttgtactctctctatctattttttgatagtatatttttaaatctaaaatttatttttgatagaaatat

SEQ ID NO: 24135 - DNA, 2088 bp, Oryza sativa
atactcgtatgcgtttcacatttcggtaaccaagctacccctccatcccaaaatataagcatttttaggcttcgtcatcgtcttcgagatgctacttttaccaacaatatctataaaagtaagatattttaaataaaataagttacatattatggtagtttgtttaatgataaatctagtaatatcaattttatatgattgatcttttttatattttttctattaatagttaaagttaaaaacatttgactttgacactatgttgaaaatgtttatattttgggatggatggagtatagattggacaatttatatacgatggatcataaacataaccctcaaagtatttatagtgtttatatgattataaacataatatatttttcaagtttttaaactaatattgaattaatctcgcgctaatcctttgttttgtttttcgtgtcagacagcaagggtgcctccgaactcagtctaaacctgtagttaaccgcagagagacaggagtgttaattctctctgggtacgaagttgcgtgtgcacgagggaaaagcccaggaccacagcccccacctagccaggcccagctcctccaatcccctcatcgccctactgcacagcgcactggtgggggccggggtacacgcccggggtacacgtaccggatcccccgccccccgggtggtggtggggtttagtagtagtcctccatggcttaacaacaagagaagcgcgcaattagggaaaccgtttggtcttccttaattgcgccctcgcccccgcggcaaccgtccttctcctccatctccccttccacgccgctgccctcccctctcctctcccctcccgccgagaaatcggtaagtagtggactagtcgctgcgactccgcgagggttccccggctgcttgtccacgggatcccacgacccggcggcgttgcggcgaggaggaggagagcagtttgggggtctcgccgcgatcgctgaggtgaggttccacgtttacttggtgcagtagttacggtttggttggcgtggagagaagctgcggtgtgtttttgattgaatccgattgagctagggggggaaggaagagggggtttggagctcgtaggctaggacgatgtttggatggtgctccgcgcctccgccgcgtgggttttgacggggatggagcatcggcgagtccggattggcttcgtcgctgttctcggatgatcctggtgcgtggtttgggtttctcgcggcggattccgtggggaactagggtgttgcggcgtgagttctgaggaatctggcttggcatggtttctattggcttgttgccttgttcgttgtctgtatctagggagagttaattttatttaactgcgaaattactttttctccgtactttgagctgttattataggtgatttcggtgcttggggtagtaaacagtgcatttttaaattatgtgctagttaaaccaatttatggcgatcgagccgtacaaatcccctgttgtgaatcctaagagccagggaatatgcctccatctatgctatatgtggttgatttgctcttgctgggtgaattcttctagctaggattatctaatttagagcccaacaatgtaagcatcatgctgttgcctttgagtgtgatattgtttttgcgtttggttagtcgatttgatcgaagaaaattcccggcaacttcaagtgaactctgccaattttatttggcactatgtccactgttatattttttctctttgtctgtattggagcatacaaaatctcaatgcatgtgcatggttcataagtggtaatcattaaaaaaggtccctgtttcccatgctgcttctgatgagaaattattaaacttttttctagcaaagagattcgtctcatctcatgcatgtggattgtcctgtctgttccaaaaccatcagaatctccgcaaacagtttgtttatttgcttcgtcctttctcgaatgctgcatgatcccatgtagcagctgtgattttacccaaaatatctttttttttatgttctgtaatggatgtgcaatgtattcataaatgccaccctcctcccttgc

SEQ ID NO: 24136 - DNA, 688 bp, Oryza sativa
  unsure (1)..(688): unsure at all n locations
nnnnnnnnnnnnnnnnnnnnnnnnnnnnnnnnnnncgacggcaacagcaccccgctcccgccgatcatcaccggcgctcgctccgtcccggtacacacaacacacctcaccccactcacaccaaattctctccctcttctcacctcaacatgttcacgaaatgttctttgtaaaaaaaaattcaggtgagcggggagttcccgatatcgaacagccatggccatggcgagttctcctcttccctgcacaagcgcatccacccctacccggtgtctgagccaggtagtataacgaattcactacactaattaatcaatgttcttgatgaacacacattgatcatctcaatcatctaccgatgaattctgaccagggagtgcaaagtgggacgagaagaaagaggtgagctggaaggagaggatggacgactggaaatccaagcagggcatcgtcgccggcggcgcccccgatcccgacgactacgacgccgacgtcccactgtacgcaatcctcagctgagcagcttacactgatcatgcatgacaactagtatattgatcatgcctgaactctctgtggcttgcaggaacgacgaggcgaggcagccgctgtcgaggaaggtgtcgatcgnnnnnnnnnnnnnnnnnnnnnnnnnnnnnnnnnnnnnnnnnnnnnnnnnnnnnnnnnn

SEQ ID NO: 24137 - DNA, 721 bp, Oryza sativa
  unsure (1)..(721): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcagatgaacttcgagaagcggttcgggcagtcggcggcgttcgtgacgtctacgctgatggaggaaggcggcgttccgccgtcgtccagccccgccgcgctcctcaaggaggccatccatgtcatcagctgcggctacgaggacaagaccgactggggtctcgaggtaaccaccgttatcagacactaagccatattaccattgagtgagtttgtggtgtgaacgccatggatgtgtgtgatgcagctggggtggatctacgggtcgatcacggaggacatcctaacgggttcaagatgcactgccgcgggtggaggtcggtgtactgcatgccgaagagggcggcgttcaaggggtcagcgccgatcaacctatctgaccgtctcaaccaggtgctccggtgggcgctcggctccgtcgagat

SEQ ID NO: 24138 - DNA, 628 bp, Oryza sativa
  unsure (1)..(628): unsure at all n locations
nnnnnnnnnnnnnnnnnnnnnnnnnnnnnnnnnnnnnnnnnnnnnnnnnnnnnnnnnnnnnnnnnnnnnnnnnncgctgcagatgttgacgcgctgcacgaggctcagctcgccggccggcggccccgcgtagaggcaccgctcgaggctgccgttcgccatgaacggcagcaccagcgccttgaagtccggcaggctgcacgccgtgacgatccgcatgaggttccggtggcggatgcgcttcagcacctggcactcgcggttgaagctcttggtggagttcccggactgcagctggagcaccttcacggcgaccatggtgccgtcgcgcagcgtgccgcggtacacgcggccgtagctgcccgtgccgatgagccggtctgggctgaactcctccgtcgcctcgaccagctcccggtacgtgatccgcgggaacttgtacttcatcaccggcgacgagccgccgccgccgcggcgtcggcccctcctgaactcctcccgcaccgccgccagccgctcccggatcttccgaatgctgaccgcgcagaggatcgtcagcacgaacgccagcacggcggcgcagatgnnnnnnnnnnnnnnnnnnnnnnnnnnnnnnnnnnnnnnnnnn

SEQ ID NO: 24139 - DNA, 1002 bp, Oryza sativa
  unsure (1)..(1002): unsure at all n locations
cggaagggataagggattggaatggctagggttttgtaaatgctttatatactctatattttgggcctggtttttatgggccagatgggccaaatatacataataatactacatatacactattatgtcgggcctccacggagagcggggacgggggacggttaaccaaacccgcctccaccagacccaatggagggtgtttttgctccatttaatcctccgtggagacatattttataccaccctcgcctcataataggaggattcaccgtggagaatcggaggacggggaaccattgccatctctagtcctcatggaggcggtgatggccgacgcgtggaggaagcggggcggagcccgagatgtctggatcgcgaaggatggccggtacgccggtcggtgatgggcgcaagcacccggctttagcggcgaggccctccaggttgggtgccgagggcgatgacgacgtccagtgcggcgttcagcgggcaccacgctcgcccacgccgtcgccttcggcttccacttctgggtcggcgccggcctcccctcccgcgtcgcaaccgccgccgcctcttcgccaccgcgctcgctcgcggacgccgcctcgctcagtctagagagaagaatgagagagagagagaggaggaaaggagaggaagggagaggctagcctattgacgtggcatcctgacatgtggggcccgcgtgggtcccatgttgactcagccatcatgtcggacaaaaccagggtcagaaccgtcgaaggacctagtttgcactggttttgtaagttcgggggtacgttgtatccggttttgtggttgggggatgatttagtaactcgaggacaagttgagggaccttcggtgtactttttccttccagcaaaccacgccaacagcccaacagtccatgaggcaacaaccgcgcggnnnnnnnnnnnnnnnnnnnnnnnnnnnnnnnnnnnnnnnnnnnnnnnnnnnnnnnnnnnnnnnnnn

SEQ ID NO: 24140 - DNA, 733 bp, Oryza sativa
  unsure (1)..(733): unsure at all n locations
nnnnnnnnnnnnnnnnnnnnnnnnnnnnnnnnnnnnnnnnnnnnnccgatttgcgtcgggacatggtggatggtattagtggtattccaagaatttctgcgggaaagaagaaggggatgaagttcaggagaagagggcagggtggaaatagattgacacggcgtagtgctccgaggcgtgccagtggaaagagtgggcaagatcagaggattttgttgagcgaggatgatattgctgcaattttgtccagtgttacccatgaatctagcatcgaggagtgcaattctgttctcatctgtctcgagaagcatagtgataagacagctcttggtttctttgagtggatgaaggctaatggaaagctgaagggaaatgctgaggcgtatcacctagcgcttcaagcgatcgcctggaaggaggattgggaagcagctggacagttgcttcatgaaatggttgctgattcgggttgcgctctggatgctcaagcatttaatgggcttatatatgtttgtgccaaacggaggcttgttgactggggaacaaagtggcttcatatgatgcttgaaagagatgtgcagccgaatgtgtctacagttggtatgcttatgggactttaccagaggattgggacccttccagaagctgaattcacttttgctaaaataaggaaatgtggcattaagtgtgttaatnnnnnnnnnnnnnnnnnnnnnnnnnnnnnnnnnnnnnn

SEQ ID NO: 24141 - DNA, 456 bp, Oryza sativa
  unsure (1)..(456): unsure at all n locations
gcaggtgtgcgagatatgcggcgacgaggtcggccgcaccgtctacggcgacctcttcgtcgcctgcaacgagtgcggcttcccggtgtgccgcccctgctacgagtacgagcgccgcgagggcacccagaactgcccccagtgcaagacccgctacaagcgcctcaagggtaaaaaaacacactcacatcacgctacgcccttgataccgcgatcgcgaggtttccgttgattgatctctaatggcgatggtggtggtggtggttttgttacagggagcccgagggtgcccggggacgaggacgaggaggacattgacgacctggagcacgagttcaacatcgacgacgagaagcagaagcagctgcagcaggatcaggatggcatgcattacagnnnnnnnnnnnnnnnnnnnnnnnnnnnnnnnnnnnnnnnnnnnnnnnnnnnnnnnnnnnn

SEQ ID NO: 24142 - DNA, 717 bp, Oryza sativa
  unsure (1)..(717): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcagcggcgcccgagcacggcgccgcagagccgcgggttgccgaggtatgacgtcgaggtgaagttggcgaagacgccggcggtgggcacgacgccggcgaggtcgttgtacgacaggttgaggtaggtgagcgtcgtgcatttggtcagggtctgcgggatctcgccggtgagggagttgtcggagacgtcgaggcgctcgatgctctcgaggccgtcgagcgacgacgggaggacgccggtgagcgagttgtgcgacaggtcgaggacctgcagctcggcgcaggcgccgagctccgggaagatcgcgccggtgagattgttccatgacaggtcgatgacctccgccatctgcagcctgctgagccccctcggcagccggccgccgagcaggtttcgagagaggttc

SEQ ID NO: 24143 - DNA, 9363 bp, Oryza sativa
  unsure (1)..(9363): unsure at all n locations
nnnnnnnnnnnnnnnnnnnnnnnnnnnnnnnnnnnnnctagtgttgttgatgttagactttgttttatgctctgcagttgattttgtttgtggtgtttttggtagttgggaacatacatcagtgttgtttgggtggttttgttctaggggtggggcattaccattatgtgctacattgttgccaccctgcttgcttccccccttgctcttctcttctccactcttctcttctcttgttgtggtggtatctttttgtgtgaataggcttgcttttgacatgtagacgcaatccaaaaccttggcagctagttgtgcattttttccgtatgttgtgtcagaatgttctcttgtgaaccacttgcaaactgtggaaatgtcatcaatgagctgcatttaaaaaaaacacaatagaaggtgggtaaaaaaatcatatatacaaaactagggattaacaaaaggaaaaaagcacataaatcattataaaaaatgtattcatcatttaagtgtggcgaggagagggattgaaaagggtgattataatctgattggtaggattcatacaataggagtgactatattggagcatacatatacaaactaggaaaaaacaatttttttaaaaaaacagagcatttggaggagcaaaaaaaattactcgtgggttaaatgatttgctatggtattgccagagagcatcgttgcatgacatgttgctattgttgccctgttgctcaatgcaacgggcccggggatcctctagcgtcatatacttaatttctccattgctttgatacgagaaaataaacagagtatgatctaagaaaaaaagaaacaaattgacacagaataaaatttttctgttgtttttacttactggtcgctttccaaaatctcctgttttgcattcatctatttttgaatactcttttatcattccgcctttccaaacagagattctaggtggtggaccaattgggatatttctaattccaaaatctttgaaatcaagataattaatctaaggaaacaacacaaaagaaaaagaataagtcaatctttagaaatattatgggtttaaaaaatgacttaagtaataaagaagagatgcatacagcaagtaagtgtccgcagccaccaagggttttgatgtttgttccttgattaactctccttttggaacttggctatgtatgtcataagccattcataaacaaactttgacaagttccactttgagctggacttgatatcactcagaggttcaaggtattttgggctggggtgagtgtctgagttggggcaaagaaaggttgatagtgcaaccaccatgaaacaacgtaggacatcatcttctgatagtttgttcacacccttgtcgctaagcaacttagtgccaaagaaggaaattaagggttttgtgctcccaaaatgctgatgaaaaaaatgttttcctgcatcattgtcattcttgatctctaaacctccatttgggataccaagtatgaagttggtggtgtttgggttgattggtatggatctcccattgacaactatatctgagcagctgacatcagtgtgactagctatccatttgacaaaagatagtggtatagcacacctttgaaagtttagaagagaaccaaaagcagaattctcaataattgacctttgctcgttgctaagcccttcaatcaaattggaaaagtatgtgatgtttagtctgcttcttggttttggggactctgcacttccagatttatcttggtcatattcaagttttgtgcgctggaagaaaaaaaatagagatgtaattatgtcttgttaacaaagaacaacataaactaattaacatactagatgtggaaaaaaaatgtttaggaaaaaaaagacagaaagtgataccttttgtttttgtctccttactggtttgtctgtcctagctcttttccttttgatcgatcctgaaaactaacagaggcaaaacaagtatgaagttaaagttattgatagctgtctgtggtagtagaaaatgatattttggaaaaaaaaaggaagaaacatatataccagatcttttaatgtgctgacgagatctttttttgttatgtatttgtcagaatcactggtttcttcctcttctgaaatagagttggcataatcagaatctgccaccttgttgtccgacttgctatttgatgaacattcatcatctgatgatgtcctgtcacttgccatactggaaaaaagaactagagaagtaagcacattaaaaggaaaaaagagagatcttgtcaaatgtcttgatattttcatgtgtaaccaatcaaaccccaaaaaaaaaaaattctcaatgtcctgataggctgctaagccacatgttaaactgtgccaaaaaaaaaagaagcagtgccaaattcaaacaataccacttgcatcttgttgctttttgagaattcgtgcaaaggttgaaatcatgtgcaaaactgcatatgcaggtataacattattaattcacaaaatttaatgtgttgcacagaaaatttgattactatctcatataagtaaatgtcaactacaacatcttggtattgtgaaaaaatgtgttaactattagcatgattatagttgcacaaaatcataattaaagttgcacgaattaataaccaaagttgcacaacattaaaaaatggcgaccgtaggaaataggaaggtgcaatttttgcatataaaagtaggacaaactggatagatatgacattatattattcgaccgcccacatttccaagctcaccagcaaaatcaaaaaacttagcagaaggaaatgtactcttcttggcctgcagcaagctcctcccccgtagatccaacgctccctgaaaacaaaatcgtagtgagttattacatctgagcatacaatcagtctgaagttgtgcttgtttataaccaaaattaggaaaaaaaatcatatagtagtcagctaaaaaagaattagttgcacgatttattaattgaaattgcatatatttataacataacttgcgcgaaatgtatagtattagttgattttgctatttggactatgctgctggggtgtagatggttaaagcggaaaaacacagtaaatgaaaaaaagagacacacttgatgtcgtgtgttcatgagaaaaaaaagatacaacatgaaaagtagtatgggttgcaaaaagcaaaaacacatgaaaagttggacaaaaaaaaactttataaaccaaacttgtagagacttaacctagaagttgcccatgtttgaaaaaaaaaggcaattactaagctatataaaaacatattaatggttgcgcatgtctagaaaagtgtcaactacaacatcttgggtgtgcaaattctaaaaaaagaaatcagtactgccaaagagatttatgaaaaatgaagaaaaaggtaactaataacaagggaactaacttctagccacaagctccaccatcccactgtcgaaccactgccaatccttctatatccaatccatccttagactactccccaagttacagccaaaaaattgcaaagagagtcactgttgattatactactactgtattagcatccgcagtttgctcaggtttttcaccagatcaggtatttcaggtttttcaccagaaaaacctgagctcgccaaacatccaaaagaaccgccgatttgttgtggcgttgatcccgagtcccgcaaaacaccaaatgaatccccttcccatcataataaaaagaaaaagaaaaggcaatgaaattactaagaaaacaagttgtctaccaaaagtcctcacttgtatgcatgttttcccaaacaacaaacgctatttatcaaagtaaatggaaatttggttaaaaaaacattagttgcacaaaattattacatgacttgcacgaaaattcaaaatggctactacaatagtcagggagtgcaactagcgtagatacataattttcagaaaaagaaataatgaaaatttaaggccatgtgctgatcgaaagcataggttttagtttgaggccatatttaaagcagtaaataagtgaatcattgatacaacataactgtacatagcatatgaagagatatgctttatactgtccatttatacagtactatcgcaaattatattatccatttattctctgtattttagtttcagattaatcctactgtttccattaatctcaccctcgtttgcgtttgccactgtcatttgctgagttgctaatgacacagaccgatgcttttgcgaattgcgattactctcctctctcagtgatctactggtaatctcaaaaagattaaacataattgataggagcagagcctggagttcatttttagggaggcttatctcagattgatcactgatggaatggaagcaaaagtggcttagtatgtcacagttgagcaggagtatgtcacagttgagcaggactaccattaaaaaaaatacacagcacacaaaacaacagatagcttttgtctacaagcagaaaacacaactcctccctgtatacagtgacactgaaatcccaaaaaattgtggtatccctgtatacagtaacctctgattaaactccctgtataatctgacaatactggggacaaatgtaagaacatttgctgggatttaatgaaatattggttagttcttgagctcgaattgctaccaaatccctaaacccctttctaaaatgccacggcacagaggtcatcactgccctacaggattaacgactaaatctagagcaaaaccatgtgtgtgcattccatgatatatcagatccaactagtgaaactgcaaaactccctaacaaatgaagttagagagaaaataattagtgccaaggtttagaaccaggcagaggcacagcccacctcccgccgactatatcatacacgatgtgcagtaaaaccctaaaaaaatttcccaaactacatcgaacaaaacatcaaagcacacacaccatgtggtttcagatccaggatgctttactcgacattgggcaaaatcaactcaaaactcaagcaatgaaacaaactccacgggattccccccccttgaaatggtagccaatccagccctaatagctcacaatccacaggatagaaatctggaccaaaggaaatcaggccgccacggcgtgaggatttgaacaaaaaagagagatgaaaaacctgcagtgcatcaactcctctcccccgcctctcttctccggcgccgtccgcggccgctcgcggtgcacagcccacctctcgccgcccccctccccttcccctccactgcctaccttggaagaatctccggcgccttccgctcgcaggactccgcctcctactcgagaaacagaaacgtcgagaagcagaagcgctctctagagagtcacgggtgtggtggatttttccagagctatttgtgggctgtgggctgtgggctgcgggctctgggcttattagcaaggaaaaggtgatggaaaagcacgacccatataaaaaaagagcctttccactagcccgatagcgcgcacaaaagttgactgatcgattaaaattttgcaggcgactacaaaatagcaaatgcgttgtttttatgtaaaagtttgaataatttgtgttactcctctcaaaacttaaagagaactgtaaagaaagtagccaacttggttggtaacatatgacaaagcctgcatagcgcataaaggaataagttcactttaggtccgatcgaatataagtcaagtttgatttgcattcttcgaccgcaaaacttggtacaagacgtgctccaacttctaaaactagggcaaatcaagttcatcggtagcatttgagagtggtttcctatatgtcatcctagttagcaaaaaataaaataaaaaagcaaaggtcatgcgggacccacttgtaagtggccaaccaccatcttcaacttttgtctactctttctctctttaatccttgtggtggcggcggcaggatctcctggaggtcgtggcgaggaaggtggacatgccagcaacagaggagctcgaggaggccacggcgacatgggagcttgatgaggccggcgagaagggtgctcgccacgctgtccccatttggccctcacctccccaatctcccccgctgtgctcgttggccggcaacaccttcacggagccaccagtggacttattatttcgtgcacaaacacatactccctctatcccataaaaaacgaatcaaatctagtatgatgtaacacatctgttactagattggtttttttatggaacggatagagtacgtgatacgccccgatatggtttagaaaagttgctcacacggcccaaagagcccatagaagttcggccttttggggccaattgggagcccaccaaggagcaatttttatgggtgggcttcgagccttccttgtccagcgtggggcggggcactcccacatccaccgcatcccaagccgacggccgcggtggcgacccgccgagtcgccgcgtgccggtgccgtgtggaccgggagcgcgccgtggcgcggttgaagggagccccaccacacccccttgagttcttgtcgcccactcagcctcccgtcgctgccggcgtggcgcccaccctaggacgcccgccacctgctcgtgcaaatgcgagagccagagccggccacagcggtgctacccgtttacgcgcattgtcgttggggggaagagtgcggtcatgattcgcgtgtgcctccagtaccgtcctgttggcaggctcacagcagagccgctgcggggctccggtctctgtcgtggagtcacggaactgctacttcgtcggatccttcatggagattcaggtaccaacctctcaaatttagctggtttacaactgaaccaaggtgaatttggtgatgattgttcaatgttcagtagatatatgtctgattatcacgtagtagtaggattgtaggagttgtttttcccttcttgaggatcttccccaaccaagtcaaatttctttgcagggaacaaatggtgcaattttcttgttccgaagaagttgacagcacagaaggaaactcacacgcttgtgcatatggatcacttccactataattctataaaggtcagaattagtatttgctaatttatcttgtaggtagttactgataaggctaggaattagctgctttggaaaggtagtggcatgctggcatgcgttctcttgttgcgtaagctcatgggaacagcatgcaactctaaatataaatagcatgcacaatcttcttaagaacaggcatatctttgatggtggaatagtgccagaaatgtgtaaactgaatatcattcttttagttaggaacacaaaagggggcaaatgaaacattctcaactctcaaagagtgccccactagatttggttaaaagggctggcatgatgtacctaacaaatcatttaagaactgtcttagacatgtaggcagatctttctagccacacagtcctgcaatatcacaatgtgctaattattctttgacactttcttgatcacctagatgtcaaaaaaaggagtgagtgtcataggtagagttttctggcccaccgctcgtgcgaagcagcaaaggtcactctcctaggctgaaatttatattccccataaaaatctacaattgcagtgttgcatcataggccaaaccgttgaaaatctgatgtgtgaatcatatgtgaaccttttgaaagctggaattttttgctggacatatataggggcgagtatgcatgtttggcatgatgaatggaccccatgtatataccctgtgaagtcgggtcctgatggcaacaggccagataaatgacgtctccatgagagttcagttagttgaggccagcttatgtgttcttcaggggtatgtctattgctcccaactcccaagttattgccacgcatgcaaaatattacgtgaatggtacttcctccgtttcaggttattagacgttttgactttggtcaaagtcaaattgctttaagtttgatcaagtttgtagaaaaaaatagtaatattttcaaccaaagacaaatttattatgaaaatatatttaattattgatttgatgaaactaatttagtattataaatattactatatttgactataaacttagtcaaacttgaaacagtttgactttgaccaaagtcaaactgagggctaggaaaaaaaatcacataaacccctagaatgacaagaaactgaaataacccagagagatatgactacgtgagataaacagaccatcaataattccgtcctccttttgtattccttgtccttgtgggagggagaagttacttcttctgaattttctcttctttataatgggcctgtttggagaactatcccagggatattttttgggctaaagattatcccaccaaaatagccccctaacaaaatagccctcttgctgtttggatccaaaggctatttagctattattgtaccatcccaatcatttgcctccactaaaagtatacagcagccggatcttctatggctaatccaatacaggcacatacaagcatacacaattccttacaagcacaaacacataatttgtctcaaatatataagcaagtatgtaaaacaatcgtgtcacataaaagatacaattccatacaacaatcgtctcacataaatatacaattacataaaacaattgtctcacataaatattaaaatccatacaacaattgtctcacataaatattaaagtccatacaacaattgtctcacataaatattaaagtccacacaacaattgtctcacataaatatacaagtcctcaaaccgtaaaaaaaaattacaatccattaaacaaagcatttgccaagtcatcgcggaagaaattcatgttgctatcctcaacaagaggttcatcttctggccagttagagtgaggtgatgtaggcattggaaaataatctgcatccgcatccagctccttcctcgccgccaccctggaggaaggcaccgtactcgtggaggtgagggaactcctggcccgacgccgcctgggtgttgaggtccagcgtgtccacgccggcgcggggaacggatccgtgggaagggccggacgccgacggctgcgacgaccaaatgttgccggcggcggacgaaatgggatcttgggagaagaaatcgaagccgttggggtccatctccgcgcggatccggtgcaaggcgatgcgtcgacgacggatctgatggccggcaacgcgggtggggtgagtcgccggcgtggatgcctctcggtggatctgaaggaagggcggcgcgattcgagggagaggg

SEQ ID NO: 24144 - DNA, 3152 bp, Oryza sativa
  unsure (1)..(3152): unsure at all n locations
acgatttctgccgcaactggatccggcacaagtgggggaaagtgggaatcggtggggcccacagcaaatagccccaattagcacccctgggggtgataattttttggggtgggctatttgcaaatggccctaaaatagctctcatgtttggatccccttgagctattttaaggctaaaaggggtgggctaaaaaaaatccataggatccaaacacccccaatgttttggtttaggcccaaagcctcaaattagctaggccatctaactggattatgctagcttaaacagttttatcaacagagatctacctggtccaaacttgcttcttatctagccagattagcctcgcaactgaacacactaaatcaatttttgcatgttgcttaacaggctccagttttggtttttatcgttttaatcacttccctgttgagaacactgtatggaatggaaaccaagttgattctgtccatgcatcctgcaggctgcctggcaaacaccacacaccactcaccggtgcaacccgcaagtgcagccgtgtgcaggtggaagacgaacagtattaggggagcttaagattttgaaaatcagttggtgagaagctcacgggtgagaatctggagactttaattcattttttgaattctaaaactataacttctcaaaatcagagtgaaaatttggactgtttggggaaagcttttggtatctgcagattccagaaaaatctctagctgcgagaagctctcccaaacaggctcaaaacccgcagttagctagcgtgcgccaagcccctcctacattccggtgcgcgcgcgccagcgcccggagcccaccgcgagtcgtcgaatgtgcgcagagccccgtccctttcgtccgatccctcggcgacttgcttccccggccggcagcctactcatcatgcacgaacccatcgccccaaaaaagagccgcgcatcgtgcgcagcataatcatagctatcgctgaaacgcctgcaccttcccctcctcctccattcgcttacctcgccattgacatcgcatcagctcttctccatctgtatctgtccgtttttctttcatccatctccgtcttttcgtgcaactctccagcttcagcttcagtgccttctctctaccaagtacgtgaagaagagcttcatctatgcctctactagatcagagatgctagctagcgctctagctagctgctagcaaggagcgcaccagcaagggcaccaccactggcttaagtacatggctttaggggagagggcgagggcgagggctcctcccatggtcgtgcggcgcacggccgtcctcctcctcctcctacatctcgtgttcgtcatcgccgcagcggctgccgcggtggataggcgtcggccagccgaggcgatcgtcggcgggtggcggcagcggcggcggctccaggctctgatgcaggagaaggccacgctgctggccttgaagcggggcctcacgttgctgtcgccgaagctgcttgctgattggaacgactccaacaccgacgtgtgcggcttcaccggcgtcgcctgcgaccggaggcggcagcacgtcgtcggccttcagctctccaacatgagcatcaacggctccatcccgctggcgctcgcccagctgccgcacctccggtacctcgacctgtccgacaaccacatctccggcgccgtcccctcattcctcagcaacctcacgcaactcctgatgctcgacatgtccgagaatcaactctccggcgccatcccgccgtctttcggcaacctcacgcaactccggaagctcgacatatcgaaaaaccagctctccggcgccatcccgccgtccttcggcaacctcacgaacctcgagatccttgatatgtccatcaatgttctcacaggccgaatcccagaagagctctccaacatcggcaagctcgaaggcctcaacctcggccagaacaacctcgtcggcagcataccggcgtcattcacccagctgaagaacttgttctacctcagcctcgagaagaactccttgtcaggttctatccccgccacgatcttcacaaattgcacgcaaatgggtgtattcgacctcggcgacaacaacatcaccggcgagatccccggcgacgcctcggatagcctttccgacaggttcgccgtccttaatctatactccaacagcctcaccgggaggcttccgcggtggctcgccaactgcactattctctacctgctggacgtggagaataactcgctcgccgacgatctgccgacctccatcatctccggcttgcgcaacctcaggtacctgcatttgtcgaacaacgtccatttcgcgagcggcgacggcaacaccaacctggggccctttttcgccgcggtgtcgaactgcaccagcatactggagatcgaggccggagcactgggcatcggcgggcggctgccgagcttgctcggctcgctgctgccgcctaacatgtcacacctcaacctggagctcaacgccatcgaaggcccgatccccaccgacatcggcgacgtgataaacatcacgctgatgaacctgtcgagcaacctgctcaacgggacgatcccgacgtccatctgctggctgccgaatctgcagcagctcgacctgtcccgcaactcgctcaccggcgccgtgccggcgtgcatcagcaacgccacgagcctcggcgagctggacctgtcgagcaacgcgctgtcggggagcatcccgagcagcatcggcagcctgaagctgtcctacctctccctgcacaggaaccagctgtccggcgagataccggcgagcctcggccagcatctcggcattgtgcggctcgacctctccagcaaccggctgaccggcgagataccttacgccgtcgccggcattgtccagatgtcgctgaacgactctagacctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24145 - DNA, 459 bp, Oryza sativa
  unsure (1)..(459): unsure at all n locations
nnnnnnnnnnnnnnnnnnnnnnnnnnnnnnnnnnnnnnactgatctgccagctttgtcagacatgtcaatactccttgacaaaatattgctggccacacggccactctgcattgctggccagcggtgttgttcgattaccctcctaggttggtccttgagggttgagcattctcacattgttcaccaatgttcttccttctcagaggactcctcttcctctcggctataacactagcttgccccttcgtttgatccaaagatccactggggactaccttatcctttttattaccgggggtaaccacagattctgactggaaaaggaagataggtttcgcattgctggccacaagccatcagtattccttgtgcttgttattcgcctagaactcttatgtccctctgtaacagtattacgaactggtgtgacagaccttgatgcaggggtggagggtgtt

SEQ ID NO: 24146 - DNA, 619 bp, Oryza sativa
acaagtaccgggtaagaggtatcacagatatcaggtaccatgtagctggtaccaaaacaggtatcatactgtcttatagatgatatcctgttacaacatgataccgttgtttgaaaaaaattacccacacattatttttctcgcaaatcatcgcttctgaagatcacacaacggaagtccggaacccacgcccaaatcaaaaagaagcggacgccccccaaaaagttcaaaactttccaaaacatcgtgtgcgcggctgcatcgccgcccacccgcctcatcgcattcacaactctcgcctaaaaggctaaaacccttcctccgccggccgaacccgtctggattcgccaatggagttcccccgccgcggccaatcctcccatcccgccgacgccgacgacgacgaccgccgccgcctccgcttccctgactccaccccgccgagcggtaaccaatcccaactcccaaaccctcggtattcccccaaattcgttgtgcgatttttttatttttatttttggctacgaatcgcattatctctgttgcaaatgatgatctggtggtagattggtagtgaatgatgctaagatttgtttcatgatgcagtagttgtaagcgg

SEQ ID NO: 24147 - DNA, 1549 bp, Oryza sativa
  unsure (1)..(1549): unsure at all n locations
ggcgaattcgagctcggtacccatcaaatactagtcatctcatatgggaaaagctgacagttggctaatcactagtactcctccaataacaaatcaccatgggtgattgacaaaaaggtgttctagaagatcatcccaagtaaagatgttctagaaggcggtgcagaataacacactatcaggctctatgattgctcacaagtcaactgctcttttccaatactaataactagccgaattgatccaaaaccaagttgcatctcctatccagtagacacgtctcctatccaagtactctatcatgcccatgcatgagagcagaacaagaacagctactattatactccagtacaacacttacacagttatatgtatctatccaaatggtcgatgtatttgagtatttctaactgtttgtcaacgatgacagaattgcacacctagcaattaactagccacacacactaacatattaaaggctacagcttggaaacatctagcgaggtgggccccactgataattgacagcgtcgataccttacaaacacgagcacgtcgacatgtacttaatcacatactgcagaatgcaacagcaccacacgacgcagcttgcaagcttaggccagattatccagcgggttattatctacttaattacacaatacaatagaagaaacagtcacttaatcttgctcgcaaacctcgattaattaaaggagaatctagaagcagagcatcaaatcagggaggtcacgagcggcacagcaaacctatcagtccacgaaagaaacagtagaaacacgacgaacagtaactacaggaccaatcaagattttatcgagaggtgccgattttttctgttcggatttcgacgaagcttataaatttgccaagggacttatattcgaaaaaaataaaataaaatttgccaatggacggtcgacacgtcatcttgcgacccggtttgcaaattgcaagtccgagtcgacctgtgtgttaactgcatcgagacactgttcaggtgggtcccactacgacgtagccccacatgacagtggggcgatatttatgaggctgaccaaacggcttgtactcgtttgtacttttccaccgacgtgccacgcaaagaaaaagaaatacaaagaaaaaaaatactactactcctttttttttcccggaataatacgaggagaaatttacccaaggggggggggggtaaaaaggtggcagaaagttaaccatgatgggggtggggtgattaattaacggagaattggagaatacctggaccatggcgaggacgcaggggggctcgccggaggcggcgaaggggacgaggaggcggcgggcctcgggggagggctcgaagtcggtgaacatctcgtcgccggtgaagtcggccctggcgacgacgtacagcgccccctcgccgttgcagtcgatctcgagccggccgccgggcccaaacaccagcaagcccgccagcgggtagaacggcannnnnnnnnnnnnnnnnnnnnnnnnnnnnnnnnnnnnnnnnnnnnnnnnn

SEQ ID NO: 24148 - DNA, 6130 bp, Oryza sativa
acgaacagcgccccctcgccgttgcagtcgatctcgagccggccgccgggccccgccgccagccgccccgccagcgggtagaacggcaccagcgccctcgccagcgcctcccgcagcctctccggtgcgaagaacccctccgcctccgcctccgcccccgcatccgccggcggcggcgagggcgcggggtagtagtagaccagcggggtgtgcgtcttgggcacggcgaggtcgaggttggagagccacagcgcgtgctgcggcgtcgcctcgctcggcgccaccagcgtcgtctccaccacctccaccttcatctcgccctctctacctctctgtgtgtgtgtggatgccttgcttgtgacagcggcttgggtgtgaatttctgtgtgtgcagagaagggagaaagggcgtgagggggtttataggcggaaaggaaaggtggagcaggatgatgcgatgggaataacgtttattttttttattactactatattattgtttcttttgggagacaagattaattctgctaggtgatgactgtcacaactgtccaatttggacagaaactttaataccgaaaagcagcttcttgtacaagtttttcttatgaatatttttatattataagttgctcttaatcgatcaaatttgtagaaaaaatagcaacatatataataccaaattaattatattaaatacaatattgaacatatttgttttatattaaaatgttgttatattttcttataaacttgattaaacttaaaaaattttgactagaaaaaaatcatagtgacttgtaatatgaaatagagggagtactgtgtactgttaagcattaaaatctggttgaaaaaactgaataacgacagaaccaaagatctaattatcaataaaggtgtattgatacaccgagagttggcaaatggatggattttttttttcgattccgtttgtatgaaagtttggctgtgggaagtgggatttgggaacatgagaatattagagtcttggttttatctctcccaccatcccataggttatttttttcgtcctataaaaaataaaaccagtacgaaaatataatatattctaataatatgattttgtgtcgcattttgtttcgtggtattagaatatatcacatcttatacaaggattatttttatgggatatagagtattttaattgccaagcgtcctaataatattgcaatataaaggatttgtggtgagtcgacatataaagatataagagtagcattcaagtttgaaacttcgaaatttaggaaaaatgttatcatccacaaccaaataatatgaaaaaaaatgttttgggggttttctagacaaaaccattatccaaatctcctttgaagatataggtggtgtttgtagtgtttcacgtaaaataaggtggtaataacatgtgattaattaagttttaattattacaaacttaaaaaatgattaatctgatattttggaacaactttcatataaaaagtttttgcacgaaacataccgtttagtagtttgaaaagcgtgccacgaaaatccaaattttcatccacttcttacagaagaaacgaacgggaccatagaagtctttaaaatttcaatactccttccaccctcacatgcttcgatgttatttttatttcagaaagtttgtcgacaaacaactttattacaactaattttcgttgcaatttcgtactttcaaacttgttttgtgccttcaattttcaacacaaattgtcttatatatcacacattcgtttctatgtgacattacatgcttttttttagataatggaatagagcatcccggcctttgctcaaaaagttatagccaattattacaatctcacactcaaaatgagtgaagttcaaggaaacttaaaagacgaaaccaaccatcaagaagaaacaaactaaagattgccaacccaagataaagagtacacaatttattgaattctgtttgtgaatctccattcaaaattgacaaaaaattgcataaccgttgtctcaagaatacgacatgcagcttttaaaagctcactatcttcctcacacttttgtagttgtgcccaagaccggagccaatgtgttggcctgaaaactacctgcatgtatgaaataaatggtgacttgttaaaaatgacatcattcctactcaaccatagagcgcaacatataacagatgctcctatgaaaataagttttcttttttttttcacccctagaagccaattatcaaaaatatgtgatataccatgaggaaggtaaagaacaaaagaaaactgaactgctctccataaaaacttttcataatgatactccacaaatagatgttgaatagtctcatttttcatacagaaacaacatctcaagctaccattccaatttctcgtggccaaattatctttagctaatacaacccctttaagcaagtaccacataaaaattttaattttaagaggcatccaaagtttccaaataatcttgtttatctcaatataaccattgtttattaaggctaaatacatcgaccgaacagtaaattgaccattttgatgataattccatcgaaaacaatcattcagttgactcaactgaatatgcacaatagaagcacacaagttataccaatttgctaaattctgatcaaccaaagctcttctaaaagaaatattcagcggaacagatctcataacattaataattgaagaattcttccttcgaacaatggcatatagagacggacacttgtctttaaaagccacgttacctatccatttatcttcccaaaatctagtttgttcctcattattaacaatccagaaacccatatttaagaaagtatttttaactttaatgagacctgaccagaaatgagaatcccttgtttcatatcaacttgagttatagaacgattagagagatacttctttttcaataagtcctgctaaaccccttgcttatttattaacttgaacaatcatttactcaaaagacatttattttggatctccttttgtaacgttacatgctatgactcgaaaatcttagaaagctcatcaacaagcaagcgtagccgattttcattatagttttaactttatttacttgtttcattccttcatctttccacgcaaattgtcattttctatcacacatggacaaccatccatactaaccttattttgcaatacttccatgaacaacaagatgaagctaaggacgttatagagtggcaaaggagtccatgtaagttgccttttaggcatctcgacaagttttcttcttgccactagtgcatgatcatgattgcacattgcgccaagtcaatcttttagtgtagcgccccacattgatgtccttccacataataaaagtatgttaatcgcaagctaattgtgttcatttgtgcttgtagcctctgtcaaaaattttcatgacttcattgagggccggtcgagtacatacccttaaaaaaataaagtgcacaagcagtccttaaatttgtaggatgtgtcatctaagtctataaactctcaaaatacatatccaagtctcagaacttatcaaagtgtgttatcaaggtcctaaattgtcacatctcatccaggatcctacatgacgctgatttggtatgccacacagatgtgacgtggcatcaccttgactgaaaaatggaactcacttaattttttttctttttttttcttctctttttcttccacttctggttttcttctcccccctttttttttcttctcctttctatgtgactcgagatgtggcggtggcttagagttacagtgagaggaaggagaagaaaggaaaaaaaaagagatgaaaaaaaaaaagaaaaggagaaggaaacaatgaaaaggaaaaaaattttaagtgggttccatttatcagttaaaattatgtcacgtcacacctgtgtgacatgtcacatcagcgccatgtaggattctacaagagttgtggcgatacatcctacaagtttaaagaccgctcatgcactttataaaaaaataaatttaataatgttgtcacgagttcattttcctcttcacatagaccaaagtacgaaactacattgtcatggagcatccaacacaatatcatcgtttatcttcatacgaatgcatctgttatatctctatgaaccaacactactttcggccttgtcacacagtcctcccgtcacatagccgtccatctctcacccctgatgacaacagccgtagcgtgcatcacgttctcaacataaggaagaagacgacacatagaaccaaacaaagcataaagaaaagcatttttagagagtgccaacagacagctgattacgcaccgatagaaaacttgaaaacggatggtattttttccaaatctttttcacgttagcaatagcagctttttaacacgtctgcatcgggatggtattttttggctacaattgcgaaaggtgctagtaaaaaatgacttgtcggaccacattattcaacaaagattaattatgcagtaatcaattagcctttcgctgtactactactcgctgatcacgtgcattatttactggccccaacacagggaatgtttaatcctgcatcggcgcttaattgccgggcgcccgttgaaatttgcagcctcgacgccgatggtttaaattttgcatttaaatttaaactacacccgggaaacttgtctcctgtctcgattgatcagcaccagtacctttcgtggtttgtactagctaatcttcttttcatctgcggtttccttttcatgtcccggttttttctccgttcctatccttgcgtgaggtaaggatatgcatgcggacgtgtttcgccgcttggttaattgcagcaatcgagtatcttttttctttttttttttgaacgacttgacgatgccgccaatttcatttaatagtggagacgaaaactgtaaaaaaagataaaagtatagaaaacaaaagcaatcgagtttcttgagagctgacgtgtcctgtttagacttaggtcatgcatgagatagataaaattgatggattatcttacttattatatctatgtcaaagtgtaaacgagtgatttataaaaaggttacttttagaacagtattccaagacatatagaaattgttttttttaaagaaaggaaccgcttagaaagcgtgcaaactaaaatctataaaatctagagtcataaaacaaatactagaagtttagttcacatggttaaattaagttgggtacggaatgaaaacatagttaatcttaaattttaaaaactttaaattaatttaaggcatttttgtcgttttcatcgtgtaaccatagcatatgtcttaaatcgtctaaagtgaaagtgcaaaagaaaaaaaaaatcttatttaaaagatttaataaattattttttattaaagcagtgttgatcctccctccgtcctattttgactttttgcttgcactgtttcaccatccgtcttattaaaaaaattttgaaattattatttattttttttacttactttattatcaaaagtattgtaagcacaacttttcatttttatatttgtacaatttttttaaataagacgagtgatcaaacagtgcaaacaaaatttcaaaatcccttatagtatactccagatggagtatattataagccctagaaaaaacaaacaaacaaatcactacgtttttggcgaagttttggcgtggttaattacaatatcaaggtgtggttttgttctttctcctcagttcattgatctgccatgcttgcttttattgcctggtttgtgccggtctccgtcgtccggcccatgcatcctggattaattcccggtcgacagaattgtgaagttgatacagtataactaatacagtattcactactagaaaggtagggtctttttttaggcgaacataacccttgaagccaaatgaccgcctacaaaaatataaattagggtgattttcacaggcggaccacttaagcagcgtcagcgaaaatctattttcacagatgaaccttatgtggtccggctgtaaaaatcgtacctattctaaaaaaaatctcaagtacttatcttcttc

SEQ ID NO: 24149 - DNA, 2921 bp, Oryza sativa
  unsure (1)..(2921): unsure at all n locations
ccgcctgtaaaaatcgtacctattctaaaaaaaatctcaagtacttatcttcttctccaccccctccccaccactcatttccctctctcaactctctctctctctccctcaacacttctccctccaccggctgggccatccccctcccctcccctcccctccctcactccaccggcggcgcggacgtagcggcggcggcagcgtggacggctcccctcccctcccagatccggccggagggaggcctggggagggcggcgccggtggctcccctcccctcccctcccagatccggccgagggaggtcggcggcggcgaggcacgtggcggtggcagtggcggcgaggcgtgtcccgcaatttttttcgttcattggattttcataggcgggctgttgccccgactattttcgtagttgttggtttgtaggcggtccttcccctatctgaaaagattacttttggccatctgcaaaaatgatttttctagtagtgattaactcaacttaaatccggtcttaatctagagctatcaaagtacattgcaagtagtagtgtgtactatatcgacaccggcgggttctattgcaatactataaaacacggatacttagcgtgcttgacttgtaatattcgacatcatcgaattgcagaaatattagtgctcaattcaactttacacagtataagtactacgtaaaatatgactcacaaggatatatgttcaataataattgaataatctactctctggagttatatgccagtgcgtacaaatcaaattaaagaagcacaacaagcaactagaacggcagccacaggtttgaaattgtcttcggtcagaactaagctagtgctcatagaaccaagctaattaaacattttcatccatctatcaatggtgccattatattcttgctttcgtgccagtgtttgcagtcatccattcgtcgcaggatcggtatcaatatctttaatcaatctgggtaatgttaattgaagcttattaaattgctaaccgatcggtgtagcctttattaatctgttagtggatgtccatcatgctatggcacatattcatcgtctatccaattggtcactgaattgttatttaattagtgaattctttctgaacttttttaggtaaggaagattcttgcttaaccactgtaattagtactctgttttgtttagtgaattgatgtacagataggttatctgctgatctttgatttttggaaattttctgttcatgtatacttggtacatcctccctatgtccatatcatcctctctcgatttcagaatatatcaatccagaatcgaatgagatatatcatagtattgtacaaatctagatacgatatctgtctatattcgtagcactacgatacatcccattcgatgttaggttattacaatatattataagacaaaagaagtatataaaagtgagattttaaaggagtttgaaatgtgcactgccactcttggtactagtctaggtctggtacactctactatacgatagtttctggtcaatggtcatgtgctcgagctcgtcgtaaatctgcatcactcaaaagataaacctgccccttccgtacaagcatacctggaacactgatttgtttagattcgtgatagaagtaaacaactgagccgtatcatctaaagttcaatgtcctcgtgttcaatccccgtgttttactcaaactgcaggtgtttctttgtgtacgcagtctcgcctctcgcgctgacggacggagaccgcaaatggtcatgaaaacttgcgagagaacgcgacgtttttctgagcacgtcgccttcgccgcctcaccgggtatacggccgaacccgcgggacacggccggccaaggcggtgcctcctctgatttcctcgccgcgtgacgtcgcagccgccgtgcgccgtgcgcggcgtggctggaaaaagaaaaatcagcgatcgatatgcacaaagtcagcgatcgatatgcacgataaatcggtaatcgagtagttatcgctaaaaaaagggaacagatttcacaaagtaaaaaacttatattcctacaggcccaaaattgcatggatgaaagttcaaagcagaaaattttggccgataacaacgcgaattttgtccatggcctgacgatttatattgacaaataggaagcacatggttcgaacttcgaactttggttgataaaaaagatgatgaacggtcggtgttatgccaaataaaaagatgaatatagcttaactggttaagttaagtttctagtgctaaaatatatccatcccggttttaattctatgttcacacgtgccctcgtatttacgtataatatatcttttttttaaaaaggaacttttcttcatcgatctaaagatatattagtcaagtatcataaaatttatgaaaagtgaaaatttaataaattgtattggttgtatcctagtctttattggttgagtcttaggccctgtttagatcccaccctaaaatttttcaccctgtcacattgaacgtttgaacacctgtataaatattaaatataggctaaaaaataactaattgcacggattgcgactaatttgcgagacgaatattttaagcctaattactctatgatttgacaatgtggtgctacattaaatatttactaatgatagattaattagaattaataaatttgtctcgcggtttactggcggattctgtaattagttttttttattagtactcaaacacccccatatgacaccctatataatacccgatgtaacacgtcaaaactttacacccctggatctaaacacccccttagttctttcaaatgcctagctccaccactnnnnnnnnnnnnnnnnnnnnnnnnnnnnnnnnnnnnnnnnnnnnnnnnnnnnnnnnnnnnnnnn

SEQ ID NO: 24150 - DNA, 2919 bp, Oryza sativa
  unsure (1)..(2919): unsure at all n locations
nnnnnnnnnnnnnnnnnnnnnnnnnnnnnnnnnnnnnnnnnnnnnnnnnnnnnnntgctaaggaggctcttgtaaccaatagactacatgccctttcgctataaggtacataaaaactatggtttagttagctaacatcgggatcttacgcaggacatatgtgaaaatttcttttattttttccttcatgccaaatctaaaagtttttggagcaaaaatcttacgaaagttttctaacaattccgttcccattacaatatagttagaatttaacatgagatgaaaaaaaaatgcttcaattcttatttatataagacgcaccctaagctagtgctattcccaagaatacatatggctcattagtaatgcaattagtcttcagggtttttttttttcatactttgtggttgctctcaacgaatttgggaacccaatttgctcggcctagaccggacgtacgtggcggccggggtgtgtcaggcggcgatcgaacgcatgcacgcgtacgtgcaaacagcacagcggtgcggctcaccgtgcatcgacgtggagacttgtggacgcctcctgtcaactgccactgccaatcatcgccccaaagccgtggaagcggcgcgcggctcacgcgacgtgccgacgccccacacgacgcctccccccaccggaggacgtacggctgcgaggctcacgtgacgccgcgcgcgcgcggccggtccgccccgttggtttggttggttggttggttggttggtggagtcgtggagagagctggagatgcatgcatggccggatgggggtgacggcctgacgggcgaacgctggctggctgaacgagccacactgaacacaagtcactgccctgaacacccgtcactgttgatcacaatgtgacatatatactgatctctgatgctactcttaacattgacattttccctactaacgtgtctatggttcttaccattgcttatatcattaataatggttcctccaaagcaactttaaacatcctgatcacaatgtggcatatctggaaagctagaaatgatcaaaaaatttcggggggaaacaaggagccgactcaggtatacaaggcggctgaagcaatgagcaaaacatacacgaatctttcttctcatactttgttgcatgtagatcaaaacgaggagacaatcagaagatttgataaatcacctaatgcatggtccccgatgttatactgatgctacctggaacaatggccaaacaggacttggaattttcttccatataccaaccactcataatgctatcttcattaaagccacaaccttagtggcccaatctcctttgcatgctgaattgatggctcttcaacttgctatggaacttgtcaaacttcttaacattcttgcaaaaaaaaaggaactttgaagaagaaccagggcactggagtctaagaccaatatggagtcaaatctgttcaagaattccagaatgtcttttgcaggttagctgaatcccaagggagataaacaagtcagcagataggttagctaaagaagcaaaatccaagcagccttctgctcctgttttcatttgtcaaaacatatctcatctagcctatcgttatgcaaactctgtcagagacaacatcagtctcagaaaatttgtaatctagcatgttctatgcttctaagttggaataaagtgctctttagttttctttttttaaaaaaaaaaatcatgtcgcccagtacgcggggacgtggagacttgtggacgcttcgtgccattgccaagcgcaaatggtccgtcgatggatggagatgggtgaagccgtgaaggggtgaacactgacaagtgacagctcgaagaccgcccttgctaggctaaatccgtcgcttaggctgaatccgacgctgaaatatcttgaattgagtgttcttgaagtactagtgcagggccaatggattgaggcccatgcttcaagtccaacgccgcgaatcgcatatcggcatcagtatcgtcaaattaaggaaaaagtacaccgaaggtccctcaacttgtcattgagctataaaatcatcccccaaccgtaaacgcatcccccaacttacaaaaccagttttatccgacgtggcggctgagtcagcgtggaacccacgtctcaggataccatgtcgacaggccagcctctcccttcctctcctttcctcctctctctcacacacacacacactcttctctctagactgggcaggccggccagcggtagggaggaggtcgctggggcaaggaggtccgacggccggccggcgacgcggcggcggagacacgggagaaggggagggtagcggcagggcgaggcggcatcggcgggcgagcacggtggcggagaggcggcggtggttgcgacgtgggaggggaggctgccgccgacccagaagcggaagccgaaggcgatggcgtggcgagcgtggaggcagaggaaggccatggtgacagacgccacgtgcgcgaacaccctcgcggcggcgcaacacggcaaagagcttcctggggcagcgaggtcgacgatggcggccgcccacagcgacgtctccgttagacatggcaacgggaaattccccgtcggagattacaccaccagacccgcctccgcggacgagaatttcccccatcaccatcagcgtgaaatgcaacggggcaacatctttcaccatcaccttctccgtgcgggtaatttatccccgtggagcctccatccccgcgagccttcatcctcggcgtcctcggtgccgccgagagaccgagacgagcggcgccgggacttggcggcatgatggccttgcgcgagcgtgggcgcatcgagcggcagccttgcgtggatgacggcagcgctaggacctgctgaggcggcgcggcggtcctgcgcgg

SEQ ID NO: 24151 - DNA, 3206 bp, Oryza sativa
ggagcaaaggagaggaagggaaaggctagcctattaacgtggcatcttgacatgtggggcccgcgtgggtcccatgttgactcagccatcatgtcggacaaaaccagggtcagaactgtcgaaggacctagtttgcactggttttgtaagttcgggggtacgttgtatccggttttgtggttgggggatgatttagtaactcgaggacaagttgagggaccttcggtgtactttttccttccagcaaaccacgccaacagcccaacagtccatgaggcaacaaccgcgcgccgtggtggttggcccgacccaccgagcagaacacgatcgcggcgcccaaccccacgcatgctcccgcccccgcgacggcttgggttgggtggcggctaggggtgaaaacggtacggaaatttccgagaattccggctaccgttttcggtttgcaccgaccgtttcaatcggtatcggtaattgtcggtatcggaaatggaaacggtaatctttttcggaaatggtagcggaaatgatatggggttttttccgaccgttttgtcggtaaccgttttttatcggtaatttccgtcaaatttccgacaaaattccgaagaaggaagtcggctgggcctggctagcaggaggaggagcccattaggcattaaggagcagcccattccgaataaagaagccaactaggcctgaccgcatcgtcgtcttcatcggcgctggggcaccgccgcgccgtgttgggcgccgccaccaggtcgccgacgccggccgcaacctccttcgccccgacggcctccgtcgcagccggccacctttccctcccccatgctccaccgccggcttccgtgccaccgagccaagcgccgagcgccgcggcaccggcccagcctcctcctccccaccgatgccgcccctttctcctctcttcttcccccaccgccggcctgcgccaggccgccatctccggcgcttctctcctctcgggcgcgcgtgaaggagccaaaggcagagaagagaacaagagagaaaacagagaagaaatcgagagagcaggaaaaggaaccgagagaagggaggataagagagagagaaaataaaagaaagagaggaaaagaaaggctgtgggatccaccggcgggccccaccatcttgactcctctctgtgatcgacctggaaataccaaaaagtctagtttagcatgaaacttaattacaacggtagttatacagtgtcaacataaaagttcttatgcaatgtgccactgtaggacgacgatatagctatgtcaattgatgatgaaataatgaatgatatttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttgtcaatcttattgtcaacttattaatcatcatataacggtgttgtgtggcagcataatgatgcaagggtgaaattataaggttatcttcatacatagttaaatgcgggatgataccacagttcgctgtttccgacatgaattttcgacttccgtccgatatcggtatattcccgttccgacggttccgtttccgagataccgatataaccgatatccttaccgtttccgagtatacgttccgattccattttcgagaaaataaaatgaaaatggaaatggtagagggtttttccgaccgtttccgaccgttttcatccctagcggcggctgcttcggcctgcgcctgcctctcggctcgatctccggccgtcgcgagcgagtgttggctggccgctttgcgtgaccggcccaggctcccagcgatagctccagtaagagcaggtttaatagtacagctataatagctggcggtaaaaatgcttatctcagcaaaaaattgagcctgaatgtacaatagctagctattgagttggtaaacacgagtccctataaatcactttataattttctactctaatttgtgtccctacccgtccttctatcctctctacgcagtgcattgggaggtgtataacaagggctgttgcagccaacatcgatggaaaggttggctgcaatgcctcgtttcgtgtgtgtagccaggcgacaggattagcgcccgttcctttctctctcatcgtttctcacccttccagctcagattatgttgacgtggatgagtataccgcctgctgactggactttattgtatgtaacaggcaaagcagcttttacaccttttagcgggctcccggcgcaagaacggcgtgtcgctcgaggacaaccccgcgggcgggctgattctagaatcgtttcgctcttggttttgaggcttatctggctcttagctaaataaactcaatcatatactctcttcgtccaaaaaaaaaactcaacctaaaaacgaatgtgacccctcaatctaggagggaatatctaggaggggttacattctcttttagattaagttttttttggacggagggagtaagtaaatatttcgagtcaacaaaaaaaacttgctatcattcgtttggtttgcaacgaaattttgtctttgcctaattatttggtttaatttcggcataacctatgggtacaaatttagaggcaattcaaagaagctcatttgtcaaaactttagcaatggctagcagatcaccggatccattccctatcacttccacatcaatagagacatgaaaagatgtataaaaccatgtccatttgtttgctatcaagaacattacataagtaaacaatgtacatagatatatggtgggttttctctttattatcgatctattctcgagtaaaagcaatcatcaatgtctcacccttcagttgtatattcaaaaaatttacgtaattatcatttattttttttagttgttccaaataagccgtgacccttgagtcatgttgctaagcagctgatatcacaggtaggatcctatagggactggttttttaagcataacaaagatatttaaatttagattttaaatttgaattcttgtcaaatttcgcacatcaccagtcgcaggaacccatctctcctatccactcctctgttcccctcgccctctctttccttgcg

SEQ ID NO: 24152 - DNA, 3274 bp, Oryza sativa
  unsure (1)..(3274): unsure at all n locations
gggtacaaatttagaggcaattcaaagaagctcatttgtcaaaactttagcaatggctagcagatcaccggatccattccctatcacttccacatcaatagagacatgaaaagatgtataaaaccatgtccatttgtttgctatcaagaacattacataagtaaacaatgtacatagatatatggtgggttttctctttattatcgatctattctcgagtaaaagcaatcatcaatgtctcacccttcagttgtatattcaaaaaatttacgtaattatcatttattttttttagttgttccaaataagccgtgacccttgagtcatgttgctaagcagctgatatcacaggtaggatcctatagggactggttttttaagcataacaaagatatttaaatttagattttaaatttgaattcttgtcaaatttcgcacatcaccagtcgcaggaacccatctctcctatccactcctctgttcccctcgccctctcttcccttgcgtattctaggaaatagattctaatccctcaagatctttttcttccaaattcaatgcaaacaatcataattttgtttttaaaataatgataatgtgaaatagtgacatctagcactaaggctgcattcgtttgtttgtgttctcctctcctctcctctgttttccgtgtgcacacgctttttcaaattgctaaacagtgtaatttttttaaaaatttctatagaaaagttgctttaagaaattatattaatctattttcaagttagttttagttaatacttaattaattatgtgctaatgagctggtccgttttccgtgtcgaagagggaaagttccctagcaacactaatgaaagcagcctaaattaagttcaaattcaacctgcacattaagaaaaaaacaaattcgggtatgaatagtaccactactattcatctttcgtattaatttttcttttttatatctcaactagttgggtggcccgcgcaattacacgactagcacccacacaaaattatcgtttttacacatggttttctttaaaatttgttaaatagtcatcatgttgtctcatgattttaaaagatcggatattattgccaccgtgtttttaattttatagtttttaaaattcacaccagtcttcaccccttactccttcgccatcatctattcttactcgacatgctacaacttttattcatccccctctacagtttttactgttcgttgtctcgtcaggtctagttttatagatttagaagttccatcaaaacgtcagcactatactcctctatgcacacccgctgacctcctttattgtcattaggattttaaatcaaatagtattgcagttaattcgttttaacttagttctgtcaaccatcagaaccgtgcttcttcacaccttgctgatcgcctcttctcctaattgtcatttggattctaaaaatcaaacctaatcattatttaggggttttggtttatggttttcacatatcccagtaaccgccaccaccctaccttcacagttgtctgctatccctctcctatttaatgtcatttgtctatgtcgtgtttaatgtatcatgttctttcaaaatttcttatttcttattctatctgttttatttataagctgtattcctacttaagcacttatttttattttactaattttgcaatttattttttattcatatttttagttaatcccatgttgtattctatataaactgttctttcaatatttatttttatgtcaaattttagctatttctaaatcgtgttcttactcaaattctcattcttatttttctatttcagaattcttttattgtttatttgaattgtaattgatttcttattgtgttgtacatgtactttcaacagtgattttagttatttataaattgtatttctacttgaaactcttttttataatttcaaaattcattcttttttctttcgaaatttacttaatctcgtattgtgttctacatgaactattgcttcaatattacttattttattccgaatttgaattatatctacattgtatttctacgtgaactcttttttttctaatttcagaatttattttatttttattctgaattttaattaatctctaattgtgttcttcctttactcttctttacatatttattattttttattctgaatttcagttatttctaatttgtatacttgtttgaactctttttttctttttcttcgtttaacatgggaatttgtagcatccatagtgaacgtggtgtctacttctaatgttgttttaataatatgatagatttgacagaatgactcgcacaattacgtggctagcatggatacaaatttacattatatgcaaaattatatatatctttttctacatataatcatctttatagtttaatttgcaaagtttacccaccaccgtcttcatgctcttgtgtcatcactctagttgcttgcccgtcgccacttctattcttgtccttgggaaaaaaaacccaaacatttgtgtttttaaagttgaatcttaatgttgtggaggctatatttttatagctttctaaaagttcctgtagccgccaatttctttccttcactttgatctatggcatgaccgtagccgccagtgtcattacacgaccaagccgcccagggagttcccggcaaacagcccgcaaaaaccaaccataagcaataaatacaaccgcctatgtcagcgacattgggctatgctatcagcttaatgttttcaccgttagtttctgtttagatagaatcaaatgtcgaacctgatttcttttatgttatttacttttccttctgtattcgaccatgatttattcatcaaataatccgcttatatatattagcactaccacaacttcgatacattttcaaatatacgtatcaaatatctcggctatatataatatagacccacttgatccaacggtacagatatttttgtttttcaccaattaacaattcctaagactatacggatcaagcaatgtggtgcatttttttagctatttttattggatattatttatcgatttcatattttggaaatacgaaaggtggcttgacgtgtgaaaaatcgggaacatagatttttctttaaacaacaataaaatagataacatatttgattaaatggcaataaaaatttatttttgttcttgtatatttaacttgcggggttctgttgnnnnnnnnnnnnnnnnnnnnnnnnnnnnnnnnnnnnnn

SEQ ID NO: 24153 - DNA, 3856 bp, Oryza sativa
  unsure (1)..(3856): unsure at all n locations
nnnnnnnnnnnnnnnnnnnnnnnnnnnnnnnnntttgtcacgtcttctttgtctgcttgctcgatccaccactgtttctatttattctttctttttagaacatttaaaaatcggaccttatagtttttaaagtttatttctcattggttacatttttataaattttagaagtctcatcgaacgttgtcactatactcctctatgacccgtccgctgcctcatctctttattgtctttgagattttaaaaatcgaacaaaattattgttgggttcattttttactttctagaagtcccgccaaaccttcagcggttgtgccattgtactcctctagagctcgtccgctgcctcccctcgttattgtctttgagattttaatatcaaacatgattatcattggggtttattttttactttttagaagtcccgataaccgtcgtgaacatgttgcttaacggcatgtccgttgtctctccttttaatcatcatcgagattctacttaggattttgttaatatttttagatatctcatcaaccgtcaacactcaactgctttacaggtctcatcgaactgtcggcagcttcgttattatactcctctacgggccgcctgttgctccccctctttttttttttgagatttaaaaactaaacatgattgtaattagggtttattttttttactttctagaagtcccaccaaccgtcgtgactatgctgcttaacggcatgctcgtcgttcctcatcttaatcgttattgggattctatttaaagttttgtttatagttcttagatgtcccatcaattagcaccactctagttctttacgagcatattgtcttccctctttattgtcatttgtcatcattgttctagaaattccatatttttcattccgatggtttttttataaacgatattcctacttgaactcttttaattacttttttgtttttggaatttattttatttgttattccgaatattagtatctgttcatatgttcttagatggtctcttatttccatagtctttattttttattacgaattttatttttattacgaattttagttatttatagattgtattcctagttgaactcttcgttttctttttctaattttagtaatttttttctaactctaggtggcctgcgcgattgcgcggctagcacccataaagaattatctattttttacatatgattttacttaaaaattttttaaatagctatctcattatcttaagactttgaaagttgtcatcccggtgtttttaaaagtcaggcccatcaataccccttagttctttgtcaccgctttatttgcttgctcgatctaccactgcttttattcattctccttgaaacctttaaaattttgaccacgtggtttttagtgtttctagttgggttttgtttttatattttttaggagtccctcaactacggttatcccattgctcttactatttattatcattaatattttaaaaatcgatcatgccagttggtgggtttcccttttataattttagaagtaacgctagccgccgttaccctattcctttgccacccctacttgccctcttaaaaatagaatttgattattgggttcaaatcatatataatttacatgacttgtgacttgtgatgcgtcactgtgtataaatacctactaaatgaaaatagctattttgagtattattttacgtggaccctttttttaagtgtatttactcctaattttgacgatttataatttgtataaagagtagcacactcctgaacgtatctaagctattattattttatttttattatgaaatttatttgctttagaattcgtattgatttgtattttaaatttaatttattcccgcattgtgtttcatttgtttttaatatgtacgatacgtacttggcggtagtaatggcggcaataatcactgtacataagttcatgtatatacatgtctatgtcttacgtcaattttaagcgctgctagggtacacaaaaagaagtgcttctatgaagaaatttattttaaccaacgctgctagggtacacttgttgagttgcctcaatcggacaataagtcctattcaaattaagctgcgttggttaggagtccaatccaagtcagatcgtatatatttctatgtttgattttataatttcggaatttattttattttttatttcaaatttaatttaatcttatattgggttcttatatagactcttcttccaatattgtttacttttaattacgaatttcagttatttttaaattatatttctatatggattctttttttctttttctttttattatttattataatgagagagtaagagataggaaattactgcatagagtccaaatgggacttctgctcacgcatgctctattattgatcatgcacctgatttgatttacggtagtatttgttgtgcccactatcttggttctactcggattgctttcccgtaaatctattaggagtatctcttatttaatttaaatttccatataaatgattgtattttatatacaactctattgatcaatctataccactataatctggatctattatgatctaacggtctattttttttcttcttttctccgattaatgtgagaatttttagcccccacagcgaacatggtgtctcctttcaaagctgtctgagtgttgtcggtgacggtgttataatagatagatagatagatgtgtgacggtgtgagtagtttatatatatgctgtatgagtgttgtcatttatttttcatacgaggggtatccccttgatggtttaaaacggtttctccatattttcatagagcaccgctacacgtactaaatttttcttactaaatttgtactaacaatcatctcaaccgtttgattcaagtagatggaagttataaaaaatctagatgcactcatagcatgacatgtcagtgttagtaaaaatttagtaagaaaaagttagtacgtatagacttttccattttcatatttccctgccatcattcctcgcaagaaaaaaaaagtgctacatctctgtaggtgcaatggtacaaatggacgcttatacaatgcgcattaaactgctaatttgtattatacatatgtatataaaatatatagatacgtatatacatgagagacttatagagggagaaacccaccgcgccctcgagagagtggttgcgtattaggcgcccccaacgtacgggcgcaagaaaacagcagcttcaatagcgtagaattgcacaatcgtcttagcaactttacatctcccttcttccaaattgcaaaaccaatatttattagaacatgagcaacactgcagctagccgagggagagaacacatcaactcccggcccaatatatagcacaccacaaggaacagagaacagcaggccggcgcaaggaggggctagccccagtaagctacagtttccatagcgacagtgatacttcgcctttaacacgaggcagatctcgcaacaacgacaggatgatcaccagccaaaatcaaaacttgcgtcctaagatgcttcagccagctgctgctgctgctgcccctcacctgcatttcacatccaggatggggacgtttcttcctccaggtcgtcactggacgcaacgacatgatatgctgcgtaccttcnnnnnnnnnnnnnnnnnnnnnnnnnnngtttcatcgtgacggtttcttcttcctcctttttccggcgatgatcagattgcatatgttcagatgccaatggaagctgaagctttcgtggcgtttttgtatatgtgtgtgtgcgctacacgatcacaacgtgtgg

SEQ ID NO: 24154 - DNA, 7834 bp, Oryza sativa
gggcgcaagaaacagcagcttcaatagcgtagaatggcccaatcgtcttagcaactttacatctcccttcttccaattgcaaaacaatattttattagaacatgagcaacactgcagctagccgagggagagaacacatcaactccgggcccaatatatagcacaccacaaggaacagagaacagcaggccggcgcaaggaggggctagccccagtaagctacagtttccatagcgacagtgatacttcgcctttaacacgaggcagatctcgcaacaacgacaggatgatcaccagccaaaatcaaaacttgcgtcctaagatgcttcagccagctgctgctgctgctgcccctcacctgcatttcacatccaggatggggacgtttcttcctccaggtcgtcactggacgcaacgacatgatatgctgcgtaccttcggtaacagcagaagacgcatctggcaggtttcatcgtgacggtttcttcttcctcctttttccggcgatgatcagattgcatatgttcagatgccaatggaagctgaagctttcgtggcgtttttgtatatgtgtgtgtgcgctacacgatcacaacgtgtggttggtggcaaactggcagggtgtgtgatggatgatgctaccaaactaaggtgcctggtcaccttctctgaatcgctggggatgccaagaaaaaaaaaagaaaagaaaaggtgatcgatcgatgcctcgtttgcttatggctcaatgctgtgactcgatcgatgggcagaaacgtgcgtttggcttgggacagaccaacctactctagacttgaacagcaattttcggttggatttgagttgataggaacgactatttgtgcaccgcaagtagaaagaaatcagttcgggactctagggatcccccttgtcaaaaagactagttttgatcggtttagctattgaactcggaatccatttcttgtaatcttgtcactgaactgaaaaaaagtggttgtccttcacttacagcttccagtaatcccgtataaacaatggcgtcctatatcaaatgtgcattatctagacttccgtataaacaatgtgcagactctagaaaattggacttccttggacgcataatctcgtcggtgtgcgtcagtcattccagtgtactaatctactccagtaatcaactggagaggacttccgtactcaccaaactaatcttgaagcaagctcaggtagaattactcgcggcaaccatgcatcaaattttaaatgccccaatattggtactactacaactatactactaccactcaccaatataatctagcccttttaattcttgtttgtttaaataaaagagcaaaggggagaaaaatgaggagatggcgggaaagccaagcatcggttggtgactgatctcgcgggttggtccgcgaacgcagcctgacaacaacggcagcagctgcatctgcagcagcagcagcagcagccaacgcacgcacgcaggcctcctctcctctcctccctcgcgccaacgcgccaccatgcaaagcaagcaagcaacacacaaccccttcgcttcacttggcggcaacggagacgccgcacccaaccaacccgccaccgtctcccacacgcgccgacgccttctcgacccctcctctcccgcgcgcgcgcgaacaaacagccacccctcacctctcgatccctcccacccgccaaaaccccccctcccatatagcccctgccacaagcgggtggagcaagcgatcgatcgcccttcctcctcctcctctcctccttcctgcgtcgcctccctgatcagccgcagctcgttgccggccgttgttgcgcggccatggaggcgagcgccgggctggtggccgggtcgcacaaccggaacgagctggtgctgatccgggggcacgaggagcccaagccgctgcgggcgctgagcgggcaggtgtgcgagatatgcggcgacgaggtcggccgcaccgtcgacggcgacctcttcgtcgcctgcaacgagtgcggcttcccggtgtgccgcccctgctacgagtacgagcgccgcgagggcacccagaactgcccccagtgcaagacccgctacaagcgcctcaagggtaaaaaaacacactcacatcacgctacgcccttgataccgcgatcgcgaggtttccgttgattgatctctaatggcgatggtggtggtggtggttttgttacagggagcccgagggtgcccggggacgaggacgaggaggacattgacgacctggagcacgagttcaacatcgacgacgagaagcagaagcagctgcagcaggatcaggatggcatgcagaacagccacatcaccgaggcgatgctgcacggcaagatgagctacgggaggggccccgacgacggcgacggcaacagcaccccgctcccgccgatcatcaccggcgctcgctccgtcccggtacacacaacacacctcaccccactcacaccaaattctctccctcttctcacctcaacatgttcacgaaatgttctttgtaaaaaaaaattcaggtgagcggggagttcccgatatcgaacagccatggccatggcgagttctcctcttccctgcacaagcgcatccacccctacccggtgtctgagccaggtagtataacgaattcactacactaattaatcaatgttcttgatgaacacacattgatcatctcaatcatctaccgatgaattctgaccagggagtgcaaagtgggacgagaagaaagaggtgagctggaaggagaggatggacgactggaaatccaagcagggcatcgtcgccggcggcgcccccgatcccgacgactacgacgccgacgtcccactgtacgcaatcctcagctgagcagcttacactgatcatgcatgacaactagtatattgatcatgcctgaactctctgtggcttgcaggaacgacgaggcgaggcagccgctgtcgaggaaggtgtcgatcgcgtcgagcaaggtgaacccgtaccggatggtgatcatcctccgtctcgtggtgctcggcttcttcctccggtaccgcatcctccacccggtgcccgacgccatcccgctgtggctcacctccatcatctgcgagatctggttcgccgtgtcgtggatcctcgaccagttccccaagtggtacccgatcgacagggagacctacctcgaccgcctctccctccgctacgagcgcgagggggagccgtcgctgctgtcggcggtggacctgttcgtcagcacggtggatccgctcaaggagccgccgctggtcacggccaacaccgtgctgtccatcctcgccgtcgactaccccgtcgacaaggtgtcctgctacgtctccgacgacggcgcgtccatgctcacgttcgagtcgctgtcggagacggcggagttcgcccgcaagtgggtgccattctgcaagaagttcagcatcgagccccgcgccccggagttctacttctcccagaaggtcgactacctcaaggacaaggtccatcccaacttcgtccaggagcgccgcgccatgaaggtaatatcgatcgccatcgtcattgctgattctgtaggagcttgacgaagagctaactgttgtgggggcattggcatttgatcgagcagagagagtacgaggagttcaaggtgaggatcaacgcgctggtggcgaaggcgcagaaggtgccggcggaagggtggatcatgaaggacgggacgccatggccggggaacaacacccgcgaccacccgggcatgatccaggtgttcctcggccacagcggcggccacgacaccgagggcaacgagctcccccgcctcgtctacgtctcccgtgagaagcgccccggcttccagcaccacaagaaggccggcgccatgaacgccctcgtacgccacgccaccacatccttcatcttcaaaacaacacaactctgctcgatttgatcgaaatttctggtttgcttggcagattcgtgtgtcggccgtgctgacgaacgcgccgttcatgctcaacttggattgcgatcactacatcaacaacagcaaggccatcagggaggcgatgtgcttcctcatggatccgcaggtcggacggaaggtttgctacgtgcagttcccgcagaggttcgacggcatcgacgtccacgaccgatacgccaaccgcaacaccgtcttcttcgacgtgagctctctcccacacaaactagatgaatatatacaatcttgaaaaatccagagcaaatcacgatcgatcgagcaatgtgactgaaattttgtgtggtgcgttcttggtgagatcatcagatcaacatgaaggggcttgatgggatccagggcccggtgtacgtcgggacagggtgcgtgttcaggcggcaggcgctgtacggatacaacccacccaagggacccaagaggcccaagatggtgacctgcgactgctgcccttgcttcgggaggaagaagcggaagcacggcaaggacggcctcccggaggccgtcgccgccgacggcggtgagctcccaaattcagagctaagaagaaattatggtgtgagaagattttcagctgatggaataatgtaagtttgtgtgtggtggatcagggatggacagcgacaaggagatgctcatgtcgcagatgaacttcgagaagcggttcgggcagtcggcggcgttcgtgacgtcgacgctgatggaggaaggcggcgtcccgccgtcgtccagccccgccgcgctcctcaaggaggccatccatgtcatcagctgcggctacgaggacaagaccgactggggtctcgaggtaaccaccgttatcagacactaagccatattaccattgagtgagtttgtggtgtgaacgccatggatgtgtgtgatgcagctggggtggatctacgggtcgatcacggaggacatcctaacggggttcaagatgcactgccgcgggtggaggtcggtgtactgcatgccgaagagggcggcgttcaaggggtcagcgccgatcaacctatctgaccgtctcaaccaggtgctccggtgggcgctcggctccgtcgagatcttcttcagccggcacagcccgctcctctacggctacaagaacggcaacctcaagtggctcgagcgcttctcctacatcaacaccaccatctaccccttcacttctctccccctcctcgcctactgcaccctacccgccgtctgcctcctcaccggcaagttcatcatgcctccggtcagtcccatcccatcctgccatcaattgctcctcttcttccatggattttcccgccaaaactgaagtttcaaatgttctgaaccttttcttggtgatgcagattagcacgtttgcgagtttgttcttcatcgcgctcttcatctccatcttcgcgacgggcatcctggagatgaggtggagcggggtgagcatcgaggagtggtggaggaacgagcagttctgggtcatcggcggcgtgtcggcgcacctgttcgcggtggtgcagggcctgctcaaggtgctggccgggatcgacaccaacttcaccgtcacgtccaaggccaccggagacgaggacgacgagttcgcggagctctacgccttcaagtggaccaccctcctcatcccgcccaccacgctgctcatcctcaacatcatcggcgtcgtcgccggcgtctccgacgccatcaacaacggctccgaggcgtggggcccgctcttcgggaagctcttcttcgccttctgggtcatcgtccacctctaccccttcctcaaggggctcatggggaggcagaaccggacgcccaccattgttgtcatctggtccgtgctgctcgcctccatcttttccttgctctgggtcaggattgatcccttcaccatcaaggccaggggccctgacgtcaggcagtgcggcatcaactgctgagagagggcgtcagcgatttctgaagatttgtgcataggggggcagcaagaagatcgatttgtaaaagttttgtattgctcgtgttgagttcgtgctatgttcttctgtaatattttgggacccagaaatggtttaaacttttgaagagggaatggacagatggccatatttgaatgttaagcaacaagggctggtattctcactccatgtttgttagattttttgcagctgtgttctcattgctcctactagggatatatgggtaatttggaccaaaccatgggcattaatgtagcttaaaagtatatgaatcgatttggtcaagggctgaagtaatattcctacaaggaatatattcagattgcagcacaggcagctttgctttaaactgactcaaacaaaacaaatactagaattttgagtcttgcatctaggtaagaaagtgttaggcaaggcttagcctaggtgtaaagcctaagtgaaaccaaaaggataccaaatctgagagaacatcctaagaacgcatacggcaaattggccatcccatgagaattcaactcttatgttttaaatttcaactactgcataaggtacttctgacatttcaacaaactgaaatgtgcccagcaacagtgttgtttagagtaaactgcaatccaaagaaaatatatattggtacgagtgagatgtcagcattcacccaacgcttaagttggtcaagctgacgaaaagagtagagctacagacctatatatctggcaacaacagttggaggagaagaaaaagggaaatacacttttttcattacttttgcccttccatttcatctgtgtattttctttccagatgccaaaaaatacaatcggaaagaacatagctctatcattgtagaaatactaacaaataattttagagaaactaaagagaggtaggtgggtgtggggaacctgaatgaatttatttacacatgaggagaccttttaagtaaatctatcatctgtaccgcaccatgagttgttagctgcacagcatcactccatgatcaccaggggatgttcaacgttcttttggtctattatttcatctctacaaactccttgtatgtttgcacaatatgttcatatcgccagaggctcaacttgcactggtgtacctgttcagaaggctggtctgggacttgcagatcttcccttagattgtcaaatcatatgagcaattccaggcctcagttgtgtgagatgcgtccgcaagctggactcctgtacctgattaaaaatacaacagctctaggtaaggctttgtgtatgaactgttgccatcatgggcagtttgccatcaattacagagaaattacattatttgatattcaagggggctctgtgctcagatttaggaaagattacatgggattacattggaagtacctgtagttttgctgccatagctaataattctctgcattcatcaagcatggccttttcttgtcttgctataactgaaagttctgataccaaatatgtcctgtcctcaacctggtaagataatacagtatgaaactaagccaggtttgggcagtttgctgtaaatttgtaattttaaaaccctccccttcttaataaattttggctggcccagcggaaaaaaaaaactaagcaaccaatgaaaagaacttgatagaagatggagggtgttctttattagatacttaaaaattaaaatctattgtatattcatcctcagaaaccagtgcagggttccttcttttttttttttttgagtaaagtgcattagcggtccttaaacttgtagggttatgtcatataggtccctaaactctcaaaatgcatatccaggtcacagaacttatcaaag

SEQ ID NO: 24155 - DNA, 2550 bp, Oryza sativa
acaagtttaaggaccgcccctacactttactctttttttttcagggaattagagatctctaactgtcacaaagatgagtagatgactacaggcgggcatggaagatcacaaccagagataatattttccttataaaaggtaattcttgtgctaaatgtgtactaaacaatgagctaacaaaatcagcttcatatggttaaaaaaatgatttccaaagacagataaaagtggacagtaaaattttcagttgtatgcgcactgttagctgacctttggaagcatacagcgaaccgctgatcccaaaccttgcatgatatcaacagcagagcttacggcattcttaagagcaactacatcagcctgttaacacaataattaaaaccattagccataatcacaaagtagcagttaataatgaagaaattacgaaattgtttgcgatttcagtaatgcaacattttacagcatacctttgctcctgatgtaactggaagacgcaatgtgcttgcttttagagcttcagttgcgtggaataatgaaatactgttctccttttcaagtgctggccattgttcaaggtaatcaatctgaatcaaaataacagcagattaaaaatttgttgtatgcatttgacaatttatattttctcttatcattgtagataccgattactctgtgttgcatacttaatttttgcatatataatagcgatgcctccctgatacaacacaatatttagactttgtgctttctaagcacattattttgaattttcctgacactgctttgattgcaaagaagaagatgttagtgttgtcatgtgatctgctggagtagattaaatgttctctctgctgtccaatagaggataaatgatctcttgcaaacccctacttttcaaatctcacgtctcaccatctttagaaaaccaaagtgtgacataacaagctcacaactatgtccttattgtgcagttcaatgtatttacttcaacattgctaagttatcctaagtttatcctatttgcatcagaagactctttttactctgtaaccagcctttatctttcacagaagagactacatagcaaattgtttatatttactttcaccagccgtgcttcgattatgagcattatagcaagtctgtgccaacctgacacaagttgggattatatctgaacgcgtgataacttgcattttagaacaaccttggtagattatacaattataaaaatcattaatgagtgggaagagcttacctgctctttaagaatgccatgtagcttcaactcttgttgtatgcattgaaccatgattcttctcatattaacaacatcccgcaagttcgaggtattcctcaaaacattatatataatactctgttttacatgacaacatagaaagaactttcaacaattaaagatcactaaaaaaataatggcaaatattaaaggagagtacatctacacacccaagagactaatgctaagaaatagcagacctcaaatttacagtgcaaaatcaattgtcagtttttaagtcaaacaaataaccaccagtagatctagctgatattttacttaatcacatttcatagtctggaagcttgttttaattgatcataaagaaaagtaatctcaaaagcttatcagatcaggaagcaaatcattgcataaacacacttatggacctatggttatgttggtatccatcaaaggaggacactgcaaagggaacaaggaagactgtgcaatgtgatgcaaaccaaatgctaactttacctcagctgtcactttttggaaagacatagtatcttctgcataagcatttacaaagatccattgcaagtatctattataagacaggtgcaattggtggatattttcaatttggctggagttcttctttcctttttttgcatcaaccatgtagctaataataggtgacgcaacacctgattgaatacttccagcactttgtgaccggctaggtgttgaaggccttgtccgagatgggctctgaaaggacctagaaatagaggatgtaactgaagaggccttgcttggcgaagatgagcgatgaagaacaggaacaggtaaagtaactgccctacttggacggctaacggatttacatctctctgttgactgtgaataagcatgacagcgagagtctactttgtcatctcttccacctgcatgaatagccaatctccttgctacctcatccaatgatttattaaaccctttgcctgtgccttcagaagcaagcgtcttccttggtgaaacacctctagaaatatttgttgaagggactgatctgccagctttgtcagacatgtcaatactccttgacaaaatattgctggccacacggccactctgcattgctggccagcggtgttgttcgattaccctcctaggttggtcctctgagggttgagcattctcacattgttcaccaatgttcttccttctcagaggactcctcttcggcgaggctataacactagcttgccccttcgtttgatccaaagatccactgggga

SEQ ID NO: 24156 - DNA, 1395 bp, Oryza sativa
  unsure (1)..(1395): unsure at all n locations
nnnnnnnnnnnnnnnnnnnnnnnnnnnnnnnnnnnnnnnnnnnnnnnnnnnnnnnnnnnnnntcatccaatgatttattaaaccctttgcctgtgccttcagaagcaagcgtcttccttggtgaaacacctctagaaatatttgttgaagggactgatctgccagctttgtcagacatgtcaatactccttgacaaaatattgctggccacacggccactctgcattgctggccagcggtgttgttcgattaccctcctaggttggtcctctgagggttgagcattctcacattgttcaccaatgttcttccttctcagaggactcctcttcctctcggctataacactagcttgccccttcgtttgatccaaagatccactggggactaccttatcctttttattaccgggggtaaccacagattctgactggaaagaggaagataggtttcgcattgctggccacaagccatcagtattccttgtgcttgttattcgcctagaactcttatgtccctctgtaacagtattacgaactggtgtgacagaccttgatgcaggggtggagggtgttgacactctagaagaaggagttgagggccttcttctgtctgctgattgagctctttttggttctggtgtgcattcatttgcggaggtccgcccaggacttggtgatgtgcatctccttgctgtggtggcagcagaatgagcagacagaccattcttgtacctggaagcaacatctctcccacggtttactggagaagcattatgcttctcggatggaactagcggtggtcttagagtctcattgagaataccagtcttcttcacatcactcttgaggacatccatgaagaattgcaacttccacagtagtaacaacgtcaagatgactcatgaaacttgaaccccttggcaaactgagatctaccaaacatccaaagaagaacaccaaacaatcagaaggtttcgaatacaaaaagcaatcatctatttaacttgaagtaagcaagagaaacttctcacatatacaaataaataagcaataaaaaggtaatgcagatatcgcagatggctgaattcagaaatgagatgctgctataccagttcaaggaccaaaaatatttacagctatgattgttgctgcaattcctctcacagggatatcgaaggcagattggtgatgggaagtgatctaatagtggcttggaagcaagggaggagggtggcatttatgaatacattgcacatccattacagaacataaaaaaaaagatattttgggtaaaatcacagctgctacatgggatcataaagcattcgagaaaggacgaagcaaataaacaaactnnnnnnnnnnnnnnnnnnnnnnnnnnnnnnnnnnnnnn

SEQ ID NO: 24157 - DNA, 424 bp, Oryza sativa
  unsure (1)..(424): unsure at all n locations
nnnnnnnnnnnnnnnnnnnnnnnnnnnnnnnnnnnnnncgtgcttcgattatgagcattatagcaagtctgtgccaacctgacacaagttgggattatatctgaacgcgtgataacttgcattttagaacaaccttggtagattatacaattataaaaatcattaatgagtgggaagagcttacctgctctttaagaatgccatgtagcttcaactcttgttgtatgcattgaaccatgattcttctcatattaacaacatcccgcaagttcgaggtattcctcaaaacattatatataatactctgttttacatgacaacatagaaagaactttcaacaattaaagatcactaaaaaaataatggcaaatattaaaggagagtacatctacacacccaagagactaatgctaagaaatagcag

SEQ ID NO: 24158 - DNA, 256 bp, Oryza sativa
  unsure (1)..(256): unsure at all n locations
nnnnnnnnnnnnnnnnnnnnnnnnnnnnnnnnnnnnnncccgaggatacctgaactagggggaatggaagctcttcctgtgcggcgcgcacggcgggcccagtcccccttggggggggggggggggcttggggtaccttgtcgtacccctcgggcccgaggggatgaaccggccccgaggccctcgcttggccaccacgtgacggccatgtgggggcttgagcgggcagggcgccgttcgccaggcgcatttatgg

SEQ ID NO: 24159 - DNA, 1409 bp, Oryza sativa
cattttggatccagcaaaacagaagtagaagcaattccaaccatatctgttgtttcagtttcagcaaccgcaccctttgtgatctcagcatcaataccaacaccactaggacccatcggtataccagtttgagcaccaacagaagctacaccataagttgtcgccgctgcatcctgaacatgaacagtagcatcattaggagccgtgtcactcattgccttcaacccatcttcaatcttgtcactttcattcatcacatatacaaaattttcttttgtttttgatgcatctaaagccaacttaatcattttctgtgacaagatgttgaacctgagtaaagggttgctttcaagaacagcagcaggcatcaatgtgtttggcacaaataattcatggttcttgtctttcagcctccatctttcaataaaatatttctcaggtagttttgttatgttcaagtgaatgagtactttgagcacatgaacacacaaaataccatccttcttaaatcttgaacaaatacattcatattcttcagctatagcatcaacaaccacaatatacttcctttttctgaaatcctgcagtgcatgaatctctgatttgtacacctcaaaaatagaatcgtgcactttcacagtcacatcatacttggtatagctttgcaagatacgctgaaatgcccaaaatatcttcctagtatacagttttgcagcttgcttctcaaattgatattctgaccaagtatctggaacaatattcctagtcagcgattcctattctttgaagcactcataaattgtttttgcaatcctttcatactgtgctaggaatgcagaaacactatgagatgaacaaatgtcagctttgtaccttgaatttgtcccctcactccttgctgttgtctgaatcaaagggcaccaattgcttttgaagtaaactggtgcccatctctttctagtgacccacataagctgaaaatacctaacattatacagattctttcttcttatgaaatctttccacaaatattcaaattcagcctctgtctgggattttgtaacaatatcatggaaatccttgtaaacttcttcatcctctgaattgaatgtccttcctgttttgtcccttgcatttgataacatatggaacaggcattcctatgaacagtgtctggaaaaactatggcaatagcagctttcattgccaagtcttgatcagttataatagtagcaggagcctttgcacccatacaatcaaagaacgtatttgacaaccaactgaaagtctcactttgttcatcttggaggaatgcataacccaataagcaattgcaccatgactaggtattcctacaaatggagcaaagggcaaatcatacctatgtcttgtacgtcgtgtaaaactat

SEQ ID NO: 24160 - DNA, 3574 bp, Oryza sativa
  unsure (1)..(3574): unsure at all n locations
nnnnnnnnnnnnnnnnnnnnnnnnnnnnnnnnnnnnnnnnnnnnnnnnnnnnnnnctgggattttgtaacaatatcatggaaatccttgtaaacttcttcatcctctgaattgaatgtccttcctgttttgtcccttgcatttgataacatatggaacaggcaattcctatgaacagtgtctggaaaaactatggcaatagcagctttcattgccaagtcttgatcagttataatagtagcaggagccttgccacccatacaatcaaggaacgtattgaacaaccactgaaaagtctcacttgtttcatcttgtaggaatgcataaccaaataggcaattgtcaccatgactagttatccctacaaatggagcaaagggcaaatcatacctattggtcttgtacgtcgtgtcaaaactatgtcaccaaacatctcataaaattttctgttgttcccatcggaccaaaacagactcttcacaacattgttctcatcagttctgaatctaaaataaaacaatggatcctctgatcttttcttctcaaaaaaatccaaacactgcatcatgtcatttttcccactttctcttctaacacaatctctataattgctcatagccttttttgtgtaaggaactgtagacaagccacccctaacatatgacaaaacagacataatcgtccttgtgggcacattgattttgttcagagttcttatcaaaagtttctcctgatctgtcatatgtttgtgagaccttaggaattttctttcttctggtggagatagtggatgattgtgctctagattaagccttgtaatgtaccaaaagcccctcttcaatgttatcaccatctcagctttgcaatttgtgtaaaccactttgttctgttttctattttttactaatggatttgttgtgtttgtttgcagacaattctcaacttcatcaacctcaggcaggtccttctcctttggatcacttggtttcctccacctgttgcatttgaatgtgtgccttgtcacaatatcagttttcctactgtggtaattgctagctttgcatgtagagaaaccaaccatataagcataaccattgtagaagtcaaaagcttcattctcatcagcaaaaactttgttgattgacggcacatgtgcactgttagcttcctgaccacctctctgaacagctgttacactttcattctccagaaatatgtttatatcttcctcactaaaattttgatctggattttctgcacttttatcttgttctatttcctcaacttgctgaaatgtaactattgcatgatcagacaataaatcctcttttgttgcttgctcaaagtgctggtcaaaacaggcatcagcctcaatggtttgagtctgcatttcattataaatcacttctacagatgatgctttcaattgtactgttgacctgcacatctcagcttgattatcaacatcagcacttgatttctgcatttcatcatatagcatgtccagtgatgccacaagaggatgcacagctacactttgtggcaaagagttgcacatctgagaggtgtctgtttgtgcattttgcaggtcattttgttgataaccattgtgaggatcgaaaccccaaaagatgttgtcatactcaaatctattggatgtcaaatatagagcagtctgcaatggtaagaaaaaaaattctaataaagagacctttttataattctattttgatttgaacttttagccatattagctatatccacatcaatcatgaatatgtttttaatcaaataatgggatggcacagcacaaatcaaataaacaagagggaacacacctctgattcaataggagcttgcaatagctgcatgaaattgccacaagtgttttggagcaagggaagaccaccctgttttgcaaaaaaaaaaaaacagtgggggttatgactgtgcacataaagtttttagtttaaacattttcatttaatatgtgttttatttctactcactgccacctgagcaccaggaaaaattgcattaggtaagacagagacttgctggattaaatttgtataggtgatgcctccctcctgtgataacctataacatcccatagtcttcatttgattctatctctgtgccctgtacatttggatagatgaaaaaaaaatgacattacatcctttgtacaatgtaatggcattgcatgaacagagagctcccataattcaaagaatgaccacaagagaacaactacttgaaccagagcagttttaacagttagcgaatcaagatattctgagttgtgcactattagaaattcagtcaccctattgtgcataaggaaaagcagacactctgcacaagatttgctatagttgactgcagtattgcattacaaccacatgaaaaaatagaccagatcaatattgtgttgcttatgagcttttatataataaagttttgtgcagggaagcagcagaaaacgcagggacagtggaaagggaagaaaagcaaaaaaaaaagagagaaaggaagaagaggttaaactagagagagggaacacaaaacaaaaaaacctccatcaattaaatttcctccaagttcttcctgttctttcctcaacacacgttgttcttcagaggaggggagtggtggaaagggaagagaaagcaaataaaaatcaaaagatgggaggaagaggtgaaaaggagggaggtggaaacagagaacaaagagaaaaacctccatgaagtaaaaatttctcaggttcttcctgtcccccccccccgagcacacgttctttcttctttttcgtgttctttctctccctttctcctttttgcttttccaatctgagttttgatctctcctctcgtttttcttttggatctaagttttgatctgagtttctatcttggagcacaagacatttttttaagggaaccagggagtggaccatttttgtgacagaacccaaatcggagctaaaaggcccaaaacgggtatcatgtgagagcccatttgttttgttgaaaaaagcccaaatcacagctaaaaaactgaaaatccagactcactgaactataacccaaaaagacttgggcccataccttcgttggcccataacacagcacaaaaaactagggcccaaacattgggcttttgtaagtttttggacccaaaagtgtgttttaaccagttttgggctttgggctttttgttagtttttgggcccaaacatccgcaccagattgtgatcttttttgcacgtcacgttttgattttttgagctttaccgttagatacatatctaatggtgcataaagttgactgaccaaacgcaaaaattgcaatcgactgcagaataggcggtccctaaaaacaaatgcatgcacataaagattggatcgtggttgtatcatgtaaaattaaatgattgcttacactcaaaagtcagagtaaacatgatggagtaatatcaagttctttctcacatattcttcattgagaaaattgctcatgcatctcggttttcatgatatcctttcctgcccctgagtttctattttcat

SEQ ID NO: 24161 - DNA, 3780 bp, Oryza sativa
  unsure (1)..(3780): unsure at all n locations
gatgtgattagaagcaagggttcagtgacatgtagtgattgtgggtcccatgaccataacattcggacttgtcccaaaaaaaagagaagtcaaatgcaacagaactgatgaaggagaggaaatatagagaactttagggacataaaactctttgggtagcaaaaaaatgactagcctatgtcttatgagtagaaacatcaagaaaaatggcattccacagtatgtctttaccccctttttgtttgcgtgttttttggatggtgcaaatacagttacatggttggctttgcaggcataactgattgttaaaaaagaaagaattgcttgtgtgaaaaatggcataccgtagtttgtcttcactcccttctattgtatttaatgtatatctgtcctcccctcactccctacccccccacccccaaaaaaacaattgaacctgcacacagttaaaaagagaaaaagtatctctcatcagatatctctcatcagtgagacgatcagtatcatgtaaaacacataaagaaatcctaaaaaaatacatgtccttttttaatatttgggtgttatgatattggatttaccatatctagtacaggaattaagctccacatagaaaacacatagcacaaaattttgctaacacatgtcctagagtttacaactcagctgtagcacataaaacacaagcaaagcacaaagtgtttgtatatataagtgtatcttgcatttgtgcaccaaaacaaaactgaaactgtatgttactagataatattttttttcaacaagttgaggactgacataaacccaaactgcatgggcttgaaaaaacaagaaaatatgacatctctctctctatctctctctctcttactaccaggtagtgtgtggccccatctcatgagcttgacagaaaaaacaggattgtgtaatctgttggtacacaaacaaaaacaggagtttatttcactgttgccttgcgtattttccatgctttgttggattgaagcttctagctagcatttttgcttcttcttgtgaactgtgttctgagaacaataggtcatttgcaatttgcttcctcatgtttgggatatattctggtttgatcatatatttcaagtgcatccttgggttccaccattccatacacttcatagcgtagattccgcaatcatggcttgatgagacaaaaacaaaaaaaatcatttaagaaaaacaaaaatcatggaaaaaagggaggagttttggacaaaaaaagaaaatgatatgtaatttggggatgtttgttggggttgataggcagttacccattgttttggcgagtaattggtgggtattggatatcaaatttactaaaatttttctccacatatgagaattcttcccacattgcaatgaatcctggtatctgtgtataacaagaggagcatgaaaaaaaaataccagaaaaaaaaaatcagtggatgcatctataaaaaaattgtatggaaaaaaaaagaacaaaatttgtatagctcaccagtagcccttgaattttcttatgatatttgttgttttcatcataaatggagtccaggaagacaaagtgatgccccttgatgtccacagtaaacacaaaccaatgattgtcatacaggcatgggaaaataagctacataacataaaaaccaaaggggcatcactttatgttaatcacacacacaaaaaagccgatcaattttatgtttgaaaaagaaaaatgtacaaaccaagtcatagtagtgcagaggtttcttgttcctagcaaatgtaaaggcttgtcttgcacaattttcagtcttcctcttttccagtaccttcccaattcttcaagaaataaacctgtggaaaaaaaaggtagagaattttgaagtgctacaactggagatgagaaaaaatgtatgtggtagaaagtatgaaaaaatcacatacactagttctgtggaagaagtaaaaattcctgtattcattttctttgttattctggtcgttggcaatcttcttggcatatgcattgaggacatatgtatccaccactccccttggtgatagagatttagacaatgatgaccatgtgacttttacattgtccattagaactgcaaatttgatgtaccagaaataaagaagataaatgcttttagtaatgcttagtactcttaaggcagaaagagtacaaaacaaaaaagtttagattacttaaattcagaaaattgaaatagtcagcacatgctctttgttatgcatattatgaaaaaatgcaaaaataatttgtaatgtcatagatttttcaccttctttgcatgccttgttgtgttaaacaaatagtgataaactttcatttggttgttaatacaaaattcagctgcgcctaccacttcaggattatcatacaaaatataaaatctaaatcaaaagtggaaaattagtgcgacatgtatcacttcagcggtgcatgttctactctatgttatgaacaacatttgtaaaaaactacagaaaacaccccacctcccatttctttttaaataaaaaaagcttgaaatgatcacaaaatctaaaaaaaggaaatgtaaaaaagcaaccattataatgctgttttgtgacacttactatttatattgttgcgtctcaccaatgctgagtatgttgttgtagtgattgagttcagctgccgagatggtttggtgccgtgtgtagttgtcatatggtgagctcttgtacttacttggatggacaattcttttagggcgataaagattgtgtctggtaccagagcagttggcagaagcatttagtgagtcgatgattcttatcattgaatattgtctttcttctgcttgagcatgttgatttggttccctcatttgtgctattcttggagaattcatacctatatcaggtgatgattgtgaactctgcattaaaaaataaaacaagtgaaaaatggggaaaaaaagaatttattgtaataatgtataaagagtataagacatagttttatgtcgtgctgattgaaaaaaattaagcaaaaaattgataggaaagtacttacaatttgtattacttgttttgtagcaggtgtccttgcagaagcaatgtttatgtgcagtggtgtttgagggctactttgctcattgtttatttgttgttgttgcaacgatgaaaaataaaagtaaaagaaaaaggatatgaacttcaaaggatgtgtttgttgttgtgaactcgaaaggaagtggtgaactcaaagaggtagtggctctgaactgagaagatgatgctctgatcaaaattgcaattgtggactgaccttccaaaaaccaacaaaccttttaggttgtgctgttatattaaaagtttaggatcccaagatagtattatatttttcaagtgccagcttttgctactagtttattcctccaatatatacttctatactactacctccatctcataaatataaaaggaattattccttttttgcataagaattattctcaaaaatactataataccagtgttaaaatatcagaagtttagaaattgtccagtaaggagcataccccaaaaagggttgatgtttgaaaaaaaaaagacaagtaaaaaaaatcagaggttattatcgcatgttgttcaaccatatcggtactcgttttcatcacagtgctgtccctaaagcctcctattccccatgtttgcaatgaagtnnnnnnnnnnnnnnnnnnnnnnnnnnnnnnnnnnnnnnnnnnnnnnnnnnnnnnn

SEQ ID NO: 24162 - DNA, 1665 bp, Oryza sativa
gtgacactatagaatagttaatctcttcattcttcctagacattttgactctccccttgatcccctagtacttacgtctataaaataagttaatgatagtaaaaaaaaacattttatgtgtacagagaaaaaatgtcaaagttatacctgataaatgttgaactccatctttattgtttatgcatgtttttggtgtgtgcatgtaactctccccctgcgtcacctgcatgctgctatgttcaatgtccatgatgtttgtgcctgatgttgtttgggacaagaagtgcccaaggctggcacttttgtttgtttttgatttatcatcaaaatgatgtaagcattcaaatttgggttgctgtgtgtgagttacatgagaagaaatgagaaagttacaaatcgggacagatcaaaaatataaattacatttttttctacattaaaagtgcaacacagatataaaaaaaagttagtttatcagtcaatcaatgctgcaaaaattgagaggattaaaatcaaaacaataaaacaaatcagtacatggtactagtagaaaaattgtgacaaaccatgtggagtttagattttgttcttgacgtgtataagtaaagatggcactgtaaattaaagatgacccaaaaaataaaagtgatttagaaaacacctctatgctctagtttcatctgttttctaaaatttgaattctacataggcacggcagtctatcgttttgtgtatagaggtgttttctaaaaaaatgtctatctgcttctaaaaaatcatccacacatatataatatgtacaaaaaaaaattatggaccagtgtacaatgcaaacaaacattatataaaaaatagaggtgtataatacacaaaaataagagaaaatgaaaaaaaaagcggtttgttgctcacaaaacaaacactaaaaaaatactagtgctttaaaatgcatgatatatgtttgatacatttgtgctcttgtttggaatgttgtctgattcatcttgtgtaggatcttggctattatgttcttctgaagagtttgaataattcacaagaatgaacttcgtcttatcctaaaaatattaaaaaagcataatcaaaaaagatataaattgattaaaatcattggaaaaaaaatggaacaaaaaattatttttttaaaaaaagtacattatgtagtcaaaaaaaatctttttctattaccgttgtgtgacctgttatgtcttcagcatcatatggaccctctatatcaataacaaactctgtagagctgctttcaagattcttggtgggctgcaccttttttacaaaaaaaaaagacatgtagtgaaaagccagggggaaaaatataatggtttgaaattttgactcttgcctaattttgaactttacctcctcctttttggctggtatagtacatataggttccacgaaaagagcatccttgtttgattcttccctgtctggttgagtattgataggttctgttgctttcaagggctgaaaaaaatgaacatatattatgcaaactttttttaattttttaatccatgaataatgtattgtatataatgatatgacataaaaaaagtaatagtgtttttacctgtttccttcctgctttgcgaatcttttggtcagaagaatattttttcgatgggg

SEQ ID NO: 24163 - DNA, 940 bp, Oryza sativa
  unsure (1)..(940): unsure at all n locations
catagctaaatcctggagcatattacagcttaaaaaattggtgataaaaaataaactaatcagtgtgatccatgggtagcctactgggccaaaaaaaaccaagatttatgtgaaaaaattgaatgaacaccagatagttgttcgctttgaaaaatttaattgagcaatagactaatagggctctgtatgaacatcctaatatatcttctatatttgtgaaatacaaaacagatatttgggcctggtaacttatggttctggtaacattgagtactgacgcagaactaggctattcttagtcctgttccagattttaaagaaagtatacatgccaagtaaaaaaaatgctatagtccagaatgaacatttttttggactggatagattggtgttggtggtagggaaattttgcttagcattggcacaattatttgatctgttgtgtttgtgtgctatttgtctaaaaagaaaatttacaaactaacagaataataacatatacctgtagggggtgctcctttgctagtgctagtgttgttgatgttagactttgttttatgctctgcagttgattttgtttgtggtgtttttggtagttgggaacatacatcagtgttgtttgggtggttttgttctaggggtggggcattaccattatgtgctacattgttgccaccctgcttgcttccccccttgctcttctcttctccactcttctcttctcttgttgtggtggtatctttttgtgtgaataggcttgcttttgacatgtagacgcaatccaaaaccttggcagctagttgtgcattttttccgtatgttgtgtcagaatgttctcttgtgaaccacttgcaaactgtggaaatgtcatcaatgagnnnnnnnnnnnnnnnnnnnnnnnnnnnnnnnnnnnnnnnnnnnnnnnnnnnnnnnnnnnnnn

SEQ ID NO: 24164 - DNA, 9776 bp, Oryza sativa
tcaagctttaaggaacaatgccattgtaaagtttccatgtaacgcttgaacatggagattgtgtactatctattcattataagctcttagatcatggagattaggactaattgttatgtgccaggcttagattctgagataaggtgaagaaatatttttgggataacatagtctatcttatataaggcatctgttacagacagtgaggacagcattgtggaccaagcaagattgtggggacataacccgtgtgagtgcatactagattcccagtttgaaggaaagggcacacttttgtctaggtttccttcctgatataccttgattgtgttattttctgttgcttgaaagtgattggtgattagtgtgtaggaccaattcaacatatcctattgcacctcacttgtattatcttattgacaagtataaacaaaccctgagaaaaaaaaaggtagcatcataaagacatgatatgaacttgagaagaaatgaaggtagttgctgttttaaagaacatctgtatgcctatgatgtccctgtgttttgtacttctgtattatgtgtagaagtgttgagagcaaaaagaagagtacttgggggcacattgtaaacttggttttccagtccaaaaccatgtgctattggttcaaacttccaatatggacttggattaggccttttatccaacaaatatgctaatcagcgataggattaagcaggcaggtaaaaaacaaaaacatttacctgagaaaatccaggattaggtggttccttgctagtataccagtagaactgtccctcatgagtgctgatactaagcgccagggaaagaaacatgtacagggatggcttccacactactgggtactttattgtctgagccatccctttcactgccatatgaaccttattcaaaacctgcacattagcatcttggtgagaaactatatattgtgtatttctttcattggtataccatatattaagatatacttggtttctgcctatgctttacagcctattgagttcactgtctgtgtttacttgggattcaatccgtaaaggtcttagttgctttaacaagacctgtgatgaatctcagtcactgaagcatcagtttcattttattgtgaactttgctaatatgttacacatctcagaagaacaatacacaagccactcgtctcagcttggctaagccaagtggcatgcagcgatatcagataaaccatcctctatctgtacgaccatatgaagacaccaaaaatatatattgatattcaaaacttggtaaatttcaatgcaggcaaacaaaaaaatatcataattaaatggaacaaaatttcaatgcaggcaaataaaaaatgtcacaagtaaagggaacaaaatttcaatgcacacaaataaaactgtcacaagtagatagaacaatattgcttttcacttcggcataccttctctttcacattatgctgatacattttcagctcatatatgaaaaatcctagaaaaaccaacgttgcaggaggtaaagccatcacacctaatgcaccctacaaaaagaatcatacaaaatttaaattatcaatgaagcaacataccaaaaaatggaacttggcaattcaataagcttcaagaatttaggctgtaattgacctgtgccccaagatggtggacaaacattccacttgtagcatacccaataagtgcacctagagatgatgagaatgcacaaaggctttgcatgtctgggactaatgatggcttatcaataccattcttcgcaatgcatgcatctattgtaacatctgctatggcaactgctgttgatatccccacaaaggaaagtatagcggaagtcatcggtagtccattaaccatggtaacaatagcagctgaagccgttccaagtactcctgtcagcaccagaaataaatgggatttatttgtcaagtttataactgctgtagaaatcgacaaaatgtaacatataagtttctgatcaatatgttccatgtttgctactttctcagactcactttaaaaacttactacagcaaggaattgttaaaatgatcatgcccagcaatttgtaaagtgcaatatcacagatacatcacattgatacttcaattgttctaagaattggcaagataacatcttacaccaaatcttgcacctactaattaagatctggctagacctccaataaacaatgcatatatcatcaaatatccaaagtcccaaacgaaatccacatggtagttgaaccaacacatcttcatccccaattccatccaatgagctgctgatacctagcataaacagttcctgctcgtgcctggaactacctctccagtctccactcaacctctctctacaaagtctaaaagtatgtactatcaccaagcactcgttgtgttatcaattctctacccccagcaaccccctgaaccttttgaaaaagctgaactagcactatgttttcaattaccaccacatcagaccccaaatatcatttaagaacttactatgcctaccaaatactccctccgtcccataatataagaacctagggtcccagactaggttcttatattatgggacggagggagtaccaaatatgccaccacaactaaaatttctacgacattatggacacaggaggaattcaggatgttcttaccagcaagcatattgctaaaatcttcacaaatttttttgttctttaactgtgcgcatactctatctactgataagattctctaatctctactatctatgcacgccaactaaagatcatcaatctcatcattttgagatgcaggattccagtggctgacctgcgaagaggaagtaggggcggcggcggtagccgcggacggggaagacgtcggtcatgatcccccagaggggcttgaggacccaggggatgaagaagacggcggagaggagctgcacggtggccggctgcacccgctgcacgtccttccagtagtagtccgacgccacgcggaagaaggacccggcgaacccctggctcagcccgtacaccagcaccacgccggcgacgaacgtcgcgcccagctcccggcacagcatccgcagccaccgcaccggctgcagcgccgtgctcgcccatccgccgccgccgccggcgatcccctcttccgcttcttgttgttcttccggcattgaccttggatttcttttgctggtttcttgaaggatcacctcacctgctcatgaggggttcttggcgcacgtgcggacgcctcgccgatgagctcgagcaccggaagcgaggtcggcatttggattagtttatttgtccgggaggaggtgttcaccggggaagcctcgagctccgggaggtggagctctcacctcacctgctgcatctgaacaaggcgaggcgttgactaaaaggcatggaggcgacgaggtgttgctgacattttcggcaaatttttttttgactttttagtatggatagtcaaaggaagtggaattgccgtcacatcttttttttgaccgtttagtagtactacgaaaggttgaaatttggagatcgggtctttcgtaaaaagaaaaaattttaggtgttacatcgaatgtttaactggatgttgaaaggggttttcggacacaaatgaaaaaactaatttcataactcgcctggaaacggcgagtcgaatcttttgagcctaattaatccgtcattagcatatataggttactgtagcacttatggctaattatgaactaattaggctaaaaaatttgtcttgcgatttcctcctaactgtacaattaatttttatttttatctatatttaatgctccatgcatgtatacgaagatccgatgtgatgttttgagaaaaaattttgggtaactaaacaaggccatacaactacaaactgaccgaaaacatttggtcaggtacgtcaaaatcaagcgggaaaagttgcctgaattgagatcgcagaaagcgcacagattttacaatgacagattgacagacatgagagggtacaatggacattgaacttgggtttctcaatgaatctttgatcattattatcagaagttcaaaccagttctggtaaaaaaattacaattgtatgattggtatgataaaagttcctatcttgctatccactgattgagtttcatcttgtaagagaatggaaaggtaggaggtttttctgaatctccggtacccataggatgtgtagaacaatcagaaatagttctctgtacaatgtcactcacatgtatgtatgtactctactgaaagatgaaatataaacgtgtgcggatgccagaatttgcatgcaaccaaaactctgaattcttaggcacatcatgttcgagttgcagcaactccagtttgcttcatccagagagaccacttaactgcttccaggaaattctcattcctctgtagagcagctataaggttagtataggttactcggtcagcggcaatgcctttaatcctcatctcctgcatcagtttaacagcatcttcaggcattcctgctatcccgtatgcttttatcaaggtgttgtaactgtacagatctggctcgccaccacggctctttagctccgcaagaacgtttgcaactccttcgatccaaccctttctcccgtatatattgatcataatgttgtaagtatagtgatcaaactcgcatcctgctctctccattttttgcagaacagcagcaaactcctccaactgtcctgccttaccgtaagcatccagcatacagttgtacgcctccagagaaacagggaaccctgcctcttgcatcctctggacgaaataaatcatgctacgaaaatccccattttttgcatgcgcggcaataatggtattgtatgatatgatatctgccataccctgcttgcgagccatgagaaataccttttctgccttattaaaaagcccggcttttccatatatgtctagcaatacattgagggtaacagtgttggccaagtgcccttgttgaatcatttcatcaaaaattcttgagagctcatcaaccggtattgcccgcccacaacagtttataatgcagttgtacatggcttcatccaattcaacttgactctttagtatccagtaatatgtatcagataatttctcgagtaggccacatttttggtaagtccgaagcatgtcaaggaaaaggtacttatcaggaactatttccttttgtttctccatgtcttccaaaaccaaacaggcatcttctggtcgcccagctttagtatacatcctcacaattacgctgtaggcaatcatgtcaagaacacaggatgatgctttcagttcaagatataaagcttcagcatcagtgaatctctccatgatgctgaaaacatcaatcatactgcaataaatacgcagatttggatgtgttgccgacttaggcatctgattatatatcctgacagcatcatcacaacagccagcctctttgcaagaacagatcaagatatgatataaattgtcttcaaaatcagaatctttccacttcttttcgcgcaaaacacgcatagcttcttctactagagaattttgaacgaatcctgttactaaaatagagcatgaggtggcatcaaacaaaatcttcttatagaagcatgcttttagaatctgaagaactttatgcatccttcctactgacccatatgctcggacaagaacagtgacaatcgatgaacactggcagcctgctgcccgcatgtcctcgagaatctctgttgcaccttcactgtcatcatgtcttgctagcaagttaatcattgtgtaaaagttggatgcatttggtttaaatccagagtttcggagtttcctgtagtacaaaattgcctgtttgtatttgtctgctctaccaaaaccttcaatcattgatctataggttgtttcatcaggagctaaacctgcactcttaagcctatcaaacacttccattgccttctgcatgtcagaaacttttccataacctgtaattaccgtattgtatgccacaacattcagagcaattccttcatctaccaaggacttcaataccaattcagcttcttccattttgccttgttgacaataagcatttagccgcactaaccaattttccatgttcggaactacttcatcattattcattagagtaataacctcctcagatttggcaaaatggcctaaccgtgtatacaaagtaaccatagctgagtaggcattaacacacttaatgccacatttcctcattttagcaaaagtgaattcagcttctggaaggttcccaatcctctggtaaagtcccataagcataccaactgtagacacattcggctgcacatctctttcaagcatcatatgaagccactttgttccccagtcaacaagcctccgtttggcacaaacatatataagcccattaaatgcttgagcatccagagcgcaacccgaatcagcaaccatttcatgaagcaactgtccagctgcttcccaatcctccttccaggcgatcgcttgaagcgctaggtgatacgcctcagcatttcccttcagctttccattagccttcatccactcaaagaaaccaagagctgtcttatcactatgcttctcgagacagatgagaacagaatggcactcctcgatgctagattcatgggtaacactggacaaaattgcagcaatatcatcctcgctcaacaaaatcctctgatcttgcccactctttccactggcacgcctcggagcactacgccgtgtcaatctatttccaccctgccctcttctcctgaacttcatccccttcttctttcccgcagaaattcttggaataccactaataccatccaccatgtcccgacgcaaatcggacaacacttttccactggagctagcgtcttcaggtgaatcagatacgcatagcgcaggctccccgccgctactgtcctccagagatgaaaccacaccattcaccagacttgccctgggatgattcttcctcctcccactgtcagcacacgagagcccatggcatgcggcaactccaccagctgctgcgtgcctccggtccacggcatatccggcgctgattggcagcacccaagaactgaacccgatcaaatccggtccatgctgaaccgcgctcccggcagcagcaagactgcctcttctggcctccggagcaccaccacccggcgtgcagatccgcagggcagccattcggatccggacaagggcatagactcactactccggatcgaacaatacctgcgcatcatagcaaaacagcgaaacagaccgcgatcagcgaggtgcaggaccaaacgattctttacaaaaagatcagctggtcagctcgcgaactgcaagattcacattcggtgctgtggtttaccttggagggaggctggcggtgacgaaagcagagaactttggaggcggcggctgccggggggggaggggagaggaggttttgggatgggataggcggatagggagtgggtgacggagggggaaagccgttggagcagctgcaggcctgcaggggtgaccggtggtggtggctgctgatcagcagtgcttcagtggtgagattacagagatctgctagcggtgatgagggatcagatcagaatatcccaactagtggccgaaattttgacaatttagggttttttttaacttattacaacaaaaagaaccgtgccaagaaattattttagaaataaatcacaattcaacatcgtcgaggatgacgctgaagtataatgtatccgcgcacataccttttagcgtttagaacattatcacattggcacgaaatccctatccgtaaggtttagcgctattaagcttggcgctgacctcacttatataggtacaaaagtaatagcgccatccgagcaataattagagcttagtgcggtggcgcgaagtttgtgcatatatgtggacgaggcatgtttgacactacagcaatatttttgttgttgtttctatttggtgacatttctttttttacactttactagccagtgttttttttttaattcttggatatcatatataggacagctttatcctacaccccctcccagctaaacagctgatcttttgaaagagatcacacaaatagctaagttgatattagacaaccatttaaagttccaaaaataaactcaattccgtttatgagatataaaattgagaaacattggagaaaaagatgatagtggctttcctctatgatttgttaattttatatctcataaagggagttgaatttgttcgtgcaactttgtagggttatttgtttacacattacttacatgtgtgattttttgagatttttttaagaccttttatatatatataaaaggtttcaagttttgtcggtgatataggcccgaggatacctgaactagggggaagggaagctctttctgtgcggcgcgcacggcgggcccagtccccctcggggggggggggggggcttggggtaccttgtcgtacccctcgggcccgaggggatgaaccgcccccgaggccctcgctcggccaccacgtgacggccatgtgggggcttgagcgggcagggcgccgttcgccaggcgcatttatgggcggcgctccaaccgcccccgtcgcatttaatgcgacgtggcaggtcgtgcgccgcccactgatggacgtgcgcctggcgaccgctttttgaccggtctgtgacccggtgatggatggatgggataggtggcagcgcacccacgtcccgctttgtgtcagacggcgtgggggctggtatgccccgtcccatcatgcacaaggggaggacatgcagatcgccacctcccatgcgcgtgtgcccacaaagtcgtcaaacgtttaataggggatgacaggggatgtcccccgtgtcagacgaaaggattcagtgggggccacccaagggcagctgcatggatcgcttctggcccaaggcatgggatgctttttaatataggcaatgtgggcccctttcctgtgaggagagtgtaggggcgatgcatgtggtatccccttcttctataaaagaaggaccatgccctacgagtaaggggacgtctcttagaaagccggattctgggaagaggccggccaagccctagctggtactcccagggtctgaagtctttgtaaccacacaaagatcatcgctcaaataggagtagggtattacgcttgatagcggcccgaacctgtataatccctcgccttccacctcataagcccaatccccgcggatccacctcgcttgcgtgagcacacgttccttggcattgcacccggtcccctagccgaactcacaaaggggagcctcacagcctcccgctagggaggatcacacctcgacaagtttctacctaggatgtgatttttaccatatgttagccacgtagttgcgctctgcgcgacttttgatcccatataataacttttgtatacggtatattagtttatagaaggttataacatgagttaattgatttacaaagtatcaattggtctaagctaactatagatttagctaagttgtgctatatgagaaatcactagaagcctccaagtttttttatttctttattatctttgccccctctcttggcactagaaacctctggaaattaccatacgcccatttgttgtttttttattgcatgtgtaccttttgatgtgacgcatcctcgtgtgaaaaagcttg

SEQ ID NO: 24165 - DNA, 2923 bp, Oryza sativa
  unsure (1)..(2923): unsure at all n locations
nnnnnnnnnnnnnnnnnnnnnnnnnnnnnnnnnnnnnnnnnnnnnnnnnnnnnnnnnnnnnnnaaattaccatacgcccatttgttgtttttttattgcatgtgtaccttttgatgtgacgcatcctcgtgtgaaaaagcttgctgctttcactatataagataagataagataagataagactagaaaagtagcgtaccttttggcgcgccgctatatggccccctatgtgtttaccatcaatttttcctctttccttttaaattttcctatgatttttttttaataaatttgccctgtgaatttttgttactggtttctgtattggagtaaccgaaggagaataagacagcagttcagatttttaaaggctctcgctttctccattttagtttatatttgagaaggttctagatttctcatatcttaacctcttctctctctgtttcttgtcctacacaagtgagtttttcttttttttccccccatcggtaaatgcttgatttatctcaatatttaacaacatcatgtggtccaattgatgctagcttgagattagttgatgtctgtgtgtgttacagagaaggcagatactaaaagctgagacccgttgatatagattggatttaccttttgtttttaacttcacacacatgactggatgcatctagatcattcacttcatgcacataatattgcatatttctagatacttctattcattaatctccttttacatatcctagcatttttttaatcctcattactcctggatttatcttaaacgttggcacgccacgtggaccaatcaacatccggtaaaattgcaattgagatcccttacagtaatgttcactgacatgtgggtccgaggggctgtggggcccacatgtcagttgcaaacgacctgcatccgtaaaattgccggcttgagaaggattgatgattgattgattgataagattttccacggttattctttatcacctatttaacctataaataaggtcaacacaatttaccttggtgcccttgctgatgggaatttcgcaccagtgtgtcgatgttcgtagcaacataccctttttggctgagatgttgtactttggcgttattatactatgtgtattcaagttacggtttattactgaaataagttttgacatgatctgttcttatattaagattttaaaaagggttcaattgccaaattttcattctctagtggatcttgaattctgaatttatgatgggattggaaagttttgcatatggaatggaccatggtgtatatgtcctttttgttagtggatactcacgataccatgtactctttgtcttaaaataaatggatccttatatctggtgaaaactttgtagtgaggaaaaaatcaaagtggatctaattaatagaaatggtaatagaggatgggaaggtaaggtgtattgggataaaacttcttaatttataaaacggagatagttaagaagtaaaaaaaaatcttattttggaacaagtctaaaaacacttattttgggacaaaaaaaacagacgatagcatgctagatagcttatgtggtgaagtggatcttacaacaaaatatcatggacaatacctttgtagaccgccattgtggaagaaagacagaaaatatagtgaattatatagtgtcacagagtatcctgcagagaagacgagtatacaatatttttgtaaagtttatcaaaaatatgctttgccaccggaaaatgtagatagaagtttcggcaatgatcggtttcgctctgagagcatatacaatagcaggctataagccagctgtaaacatattttaagcagataaatgaggagagagaagggcagcgggctatagatttgtagccagctgtagcacggactccaaaatacagtgtgtgtatgataggtgggatcggatattaatagtgtagtatatatgtaactattgtatgaatgagctattagattggctatagatgaattggatctagtaattggttatactattaaacttgctctgaacatgctaaaaaaagcctttaacaatatccaatgagaatcctcatcagtggaacattagtagactaatatttggataagagcgcaacaatgatatgcataatctgcataaccgcatagtatgcaagatcatgctattgccctctattatatttgctagactggtccattataggcattgctagtttgccagtgcacagcacatcctcaaacgtgctcatatcgcacgctcggtttacctcaacgatgcgtgtacaattttccaataaccagctttgtcaccagcctattccttaataaatgagcttagagtcatatagaccagattttggtctgaaaattttatgtgcagctacaccatgtcattcatgacctaaccctctttgtaaagcctaagaagaaaggtgtcaaagctattagattttttttcagtcgaccttttcgcaattttgcttctcatttaattacactgcagtttcttgctaagctagagtcaatttagcatggttgtctagagttcatgttcttcaggcagcatatacagtttgaacagacgcagagataggaaggaagagcatgcataagcaatacgactgaatcagctacacactgggattaatgtatttatcgatatctataaccgaagatatcactccatcaaaatttaatcagatacttccaaagaatcctataaatctcgcaatatttctgcacaaattgcacacttctttaatttcctgacaaataatcttcctgcctcttagctaaattcctagctatttacacatcatgcatgattcatatgcgtccttaggagatgctgctgcctgctgctagtcgtcgagatcttcaaatgttgaggatgagaagcccagcgacgacgg

SEQ ID NO: 24166 - DNA, 1365 bp, Oryza sativa
cgcagaaatagaaagaaagggcatgcatagccaatccaactgaatcagctcccccctgggataattgtatttatcaatatctataaccgaagatttcactccatcaaaatttaatcagatacttccaaaaaatcctataaatctcgcaatatttctgcacaaattgcacacttctttaatttcctgacaaataatcttcctgcctcttagctaaattcctagctatttacacatcatgcatgattcatatgcgtccttaggagatgctgctgcctgctgctagtcgtcgagatcttcaaatgttgaggatgagaagcccagcgacgacgcgaacgtggccgtggtctcaccgccgatgtaccgcttgagccggtccaggtcgtcggcggcgtccatcatggtcgggcgcacggccgcgctctcctgcgtgcagaggatgccgagctccagcagctcgccgatggccacgtcggacatcctcctgacctccggcgtctggtcccgcaccatgcgcgccagagccgggtcgaccaccgcgtcggcccggccgtggtagtggttcttcacccacttgtgcaagctcagccccgcgtcgaacatgtcgtcgatcggtttcttcctcgtcaccatctccagcaccagcacgccgaagctgtacacgtcgcccttcgtcgtcgggttcgagccatacccgtactcttcagaatcgaatcgattaattagaatttgtcacgagaaaaatgatgatgagtttgcttgatgatgatggttaatttacctggaggaatgtatccgatggagccgcagagcatgttggcggtggaggcgccgacgtcggcggcgttggcgacgccgccgacgctcatgacgaggcgggagatgccgaagtcggagacgagagcggtcatgtcgtcgttgatgagcacgttgctgggcttgaggtcgcagtggatgaccttgaccggggagtggtggtgcaggtaggccatcccctcggcgatgtcgctgcagatgttgacgcgctgcacgaggctcagctcgccggccggcggccccgcgtagaggcaccgctcgaggctgccgttcgccatgaacggcagcaccagcgccttgaagtccggcaggctgcacgccgtgacgatccgcatgaggttccggtggcggatgcgcttcagcacctggcactcgcggttgaagctcttggtggagttcccggactgcagctggagcaccttcacggcgaccatggtgccgtctcgcagcgtgccgcggtacacgcggccgtagctgcccgtgccgattaaccggtctgggctgaactccttcgttccctcgaccagcttccggtacgtgatccgcgggaac

SEQ ID NO: 24167 - DNA, 449 bp, Oryza sativa
  unsure (1)..(449): unsure at all n locations
ataatggatccggatccacaactaaagtccatgattgagtgctagaagcgctcagattgggacaaatggaaagcatcaattgaggcaaggatgcgctcgctttataaaagagaggtttttgggcctgcagtcccaacacctccaagaatcatccctgtaggatgcaaatgggtctttcttcggaagaggaatggccaggtggtgaagacttgaccaactgttgtactctttttcccttggtgagtttttttttcccattgggtttttatcacaaaaggtttttaaggaggcagcaggtgcaacacaatattcagagtgccatgaactcttttctcctaccattttttcccactgggtttttgggaggagattttgatgaggcatgtgcataattcaannnnnnnnnnnnnnnnnnnnnnnnnnnnnnnnnnnnnnnnnnnnnnnnnnnn

SEQ ID NO: 24168 - DNA, 2119 bp, Oryza sativa
  unsure (1)..(2119): unsure at all n locations
nnnnnnnnnnnnnnnnnnnnnnnnnnnnnnnnnnnnnnnnnnnncatggatggtaatgcaggatataatcaaatttttatggctgaagaagacatccattagactgcttttcaggtgtcctggtgccatcggcctgtatgagtgggttgttgttgatggctattaaataccaaattcacacagtcaatacctgcataaatctgaaagtataaaacatccaacatagtggtagggtttatttctaacaataaattctcaaccatcaaagttgagaagaaatatacataaaggagaggaagaattacattcatatccaagcctatggagtcttgggcccataagtccaacgaaatacatgtgggcccaatcactatgccactagattaagggccttcctgccatgatcctggagaaaattcagggccaaatggcccagcaagggttcagccgaacccaaaactggcctgttcggccccaaatttcatcggcagttactaccgacgtcccaatgacgattgtcacagttttcggtgctccaaccatcattacgaggacggattgcaagaggggagtgaagatgtcgtcaggattccatggaggatctccatactcccaaggcacctacacctataaatacccctcacctccttcattccaacacacaccaagtatgaactgaattataagatgcactattgtatcttttatgtacattagaataaggagagagtaagtgagaaagagttggagaaatttcggagttgtccgtaatttcctcttacttttgtaccttgtcaattactctgctttaattgataatatctttattgagtaattgagattcactttgtgaggattatctcttagttcctattagcgtactggaatattgttcactagaaatagtgtttactttaatgtttgatcggcattagagtagtattaaatagtgtagacgtggtgtatatgctattgagtacctgtatttgctgcttattccacagttcggtatagaggtgggtatagaggtggtgataaccctcaagattaatagggagggacttgtatagatacatgacatgctatctaataggaccacaaagactcagctaatgcaatatgccacgttttaggttgttcaataatcttccttttcaccaacttgatcaaactcttgttacatgcctctgtctgtccaatagcttgtgtataatcaggagaagaattcaacaactttatgcccatgctctcagcaaattgaacaatttcattgacacaaacatagatccttgatatgtggtgattgtttgtggtatcccaaatctatatataatatgttccttgacaaactcaatagcatcttgtaacaccctggaaattcgaccgacaaaaatctaaactctaaaaatatgggccttcaaaaactttttaaaataaattgcatcatgccgattttattcgcctatttcattggattttgaattcggagtttgttgatcgcgaataaagaataattaattaggaataaaacctaaaattaaatgagcaaaataaataactgaaatataatttaaaataaaggttgaggtagggatagaaacgaataaaatattatcgcgatcatatttgtattaattaaatctaaatacgacggaatgagaattaactctaattaaaatcaagtaaattatataaaaataaaatatgggtacaattaatctagagtggatccattggttgggataatacacgtattgagcaaacttcatttatgcaagatttagaaattatagaatcaaatttatataggaaataaactaaaattgggataaataggaaaatacattgttcattatggcgtaggtgttcgatgcggtccctagccttccccctcctctcccacctctgcgccctagccggtcttgagctccgcgtcgccgccgcccgtcgcgtcgccgccctgcgtcgttgccgtctgccgccgcgcgccgacgccatcgccgctgtcgccgtcgccgtcgtgtcgccgcgcctcgcgccccgagccgccgtcgccatccatcaccgtcgacgtcccatcgccgcgcgcccgtcgccgtcacgcctcgcgccgcgcgcc

SEQ ID NO: 24169 - DNA, 818 bp, Oryza sativa
ggggtccacacatctctagaatcaaccttctttaatggaattgcttcaacccacttggtaagtaatctgtagccaccaaaataaatttatgtcctttgcttgatggtggatttatctggacgatcatatcaattccccatcctctgagcggccatggcttgattattgagttcatagccgatgcaggtgtcctctgaattgacccaaacttttgataatcttgacatcctttgtaatatctgaaacaatcctctagcattgtcggacaaaaatacccaactctcctaatcgaccacttcatcttatgagccgattgatgagttccacaaattccttcatgtacctcacacataacaactttggcttctaatttgaagcacttgagcaaaactccatcaatcatctgataaaacaaatcatcatccaatatcacatatttgagagccttgtatttcaatttccttgaagcttattgagaaggattttttaaatactcaaaaattccgtacctccaatcatcgacttgtatagcagcaatttcaatctctatatcttttaacatcgcttgtatgcagatgcacttgagctagatcattggcttcaacattatgttccttgggaatatgcttcatagaatccatctgaactcctgcatcaactcgtgatatttcacattataaactctcaagacatcattcttgcattcatactctcataattgattgatcaccaataatgaatcacccataatttcaatagcgtcaccttcaacttccttcaacaactgtaatcccttcaaaattgcctcatattctgct

SEQ ID NO: 24170 - DNA, 11033 bp, Oryza sativa
ctaaaatccactttccaatccttcccttccacacaggagccgatagcatatatatgacaacattggctttgcaaatcaccgtgcactcatttgaatgtagataatgcctctactttttacatgaaaaatacaaacttaagcacaatttttccactggggtataccttgtttcagcatccaaaatccttctactaagataaaatatagctctttccttgccttcaaactcctggattaacactgagccgattgttttttcatcagctgataaatacagctagtaggttactcctttctatggtggaatcaagactagagaagaactcaaatattccttaatactatctaaagctctctgtcgcgcttctccccccaaacaaattcttgatcggctttaatcctcaacaatgtagtaaatggttctaatttccttgataaattggagatgaatcttcttacaaaattgatcttgccgatcaaggattgtagtttctttttattcactggaggttcgatatttttgatagctttcaagcttctttgagttatctctattcccctcccatgaaccaaaaatccaagaaattgtccatacgatacaccaaatgcacatttatttcgattcatcttcaaaccatatttccttgttctctccaacacttggcgcaaatgggctagatgtgcaacaatctactttgatttcacaaccacatcatcgatataaatttcaaccagcaagtcgatcagaacatgaaatatataattcattgcacgttgatacgcagcagttgcactctttagacgaaaagtcatcacaacccactcatacaagccgattgcaccaggacacctgaaagcagtcttgtgaatgtcttcttctgccataaaattttgattatatcctgcattaccatccataaaacttataatcttatatcctgaagctgcatcaactagtaaatttgcaatcggcatggggtattcatccttaggagtagctttgttcaaatctctgaaatcaacacataccctaagtttcccatttttcttgatcattggcactatattggaaatctattcagcatatcagcatggcctaatgaatttggcatcataaagtcttgttatttcagccctaataggatcatacatgtcagactcaaatcgtctctagggttgtttgaatggtcgatatcctggtttaatagacaactgatgttcaactatagatcggctaagtcctgtgatgtgaccaagactagggatggcagtattgcccatgggttcgggtatccgcagatacccggcccgatgggcacaggcatgggcacctttttttgcccgtgggcacgtctgacccgatacccgtgaacttagtgggcacgtgtgggttttatatttcgtccgtggataatccatgcccgacccgaaaatcttttagcccatgtatatccttcatgcggtcatgcctcgttgacaagttcagggatctcagatgaacttattcctcaatagtttaacctcccctcatggcccaatagcccgtttggcccatttgcatacaacaatatatacattcactcaaaaccctagcattatccttctcccaaacccaacctctcaatcttctatcggttctacgcggcggcggcgcaggggaaataaccaggaggcggctggcagcgcggcgtggcggtgcggcgatggctggcgacgaggtggctggcggctgggcagtgcctagcgacatggtggtgcacgagcgcgggcggcggctggggtgaggcgggtggcggggcagtggttggcgatgaggcggtgcacgagggcgggaggcggctggcgcgcggctggctccgcagcggcccacgagcgcggacggcggcgcaggcggcggctagcaacgcggcggcccgagcggtgaccggcgacgcggcggcgcacgagcggcggccggcggcacggcggagcatggcaggcaagcccagtgggtatccgtcgggcatgcccgtgcccgacgggcatgggcatgggtatgggattttgcccgatatgctttgcgggcgtgggtcgggcacgggcacgtgggtctcgggccgggcctggtttctctctgcccgtgcctgacccgacccgttgccatccctaaccaagaccactgctggttctatgctgttcttgtgaagcaagataaaacagagaataatgaaagtaaacagttgaagctgaatcgaattgttaaaattggctctatgctggttgagataaagctggcataggtttcatatttatttcttatcagtgtgggctcctattaggtgttagctaattactgtcattagtggcatcattacctagttgcattaattagattaattatactgggtttattttggtttgtttgggctttgatcgagcaagcccggagtgcatgttcatgggcttcgattaggactagtccagtatgcccttgtgcatataaataggccaagtggtcatgtaatttagattagattggttattgttttggttggtctagggtttaacccctgctgaaggtatagacagcgctcccatatgtttcctactgaagatcttgccgctggttggtttggaagaagagcgagtccaggtgattctttcgtccctggttgcactactcggtaccacaggttcctctcctttctgatcgtgtttattcaagcacgggtagatggaatatttatctagggtttggagtgcaatacattgtaagctgaagccagttatctattattgaatttttgttgccacttgaattatattttgtttgctgattggtaccgtgaaagagagggaaaaatcagggcgttcacagcctggtgctcatcaccctggcatctcatattattaccaagcaaaacaatctctgtattctttcaataattccactatttctttttaaatacatctaataattttgcactaatatatgtcggcctaggcctatcacctggtctaatatgaacttcctctaactcattggccaacataaacccttaacctagcttgccatctaaatcatctcctctgtccttggtgtagaaatttgatccctccacgatgccttcaaagtaaaagctggggctctccatctccaactggttgtataccacaaccagacacttttagataatctccttcccaaatctttcctaacaagaaatcaactccttccatctcccaaacagatagatcaacattagcaacagttactgacctgttggctggcacaatctctatttggtctgcctgccattaaatcaaactctggtgcatagtataaggaatgcaacaattagcatggatccaatctctccccagcaacacgctatatgaacccttcctatcaatgacaaaaaaatgtggttgaaattgtcttgctgccgatggtcaactccatattcaaaactccctttgtttctaaagaattcccccaaagtccttcaacaccatatttttttgatcaagtcctctggagctttacccagttttctgaaagttgtatatggcaccaagtttacagctgctcctccatcaaccagcatcttggacatgggtttcccattaacaaaagccttaacatataatggcttaaggtgccgatcctctgtgccttcaggtttctcaaaaacagcttgttgtggtgacaatatcaattagccatgaatagaagtaccggaaaggtacccggaaaagtcaagatcgtggcataacccaccgtttagtaccgtcctaaacaaagaagaccgacatagacttccacggccagtagaccctggataagtatttcttaacgatattactagaaatataattcccagcaatggcacagaaatattcctagtataatacgattacaaatatgaaccgcaagcgcatagatataccattgtagcatttcacccgaaagtattccaatgtatcgtatttatttaatcccaagggaagattgataagagaaaactatgctaatagtttatatattacttgtataagtcagagtcaaaacaggggtgaagcatctaggcccctggtgctaatttttggtaattaatgacaagcgctaattctggactaaccgttctattgagctatatattttaagttaggttcacattatgtgtgcgcatggatgtctaccgatggattaaaattgacggcgcaaagcaaaaggaagagaagacggtaaactagtgttttcattttaatttgatcaaggcgttgggcgatcaaaattatgctagtttatttatagctttactgtactattaagaggggtaatgacctagcaaagagatgatttaaattgccacattaggtcattgtgcatttagactagtgctaaaactcactttcatacacttgtatgtgatcagcctgaccaggggcggtcagaccggccacatagtggcggtctgactggcatgccctagccggtctgaccggccaacaaattaccgtgctccgcaggttagattagtgtggtccataatagtgtagttaaagattatctcattgcataattttacaataaataattctaagtcacggttgaactacaattgtgtgaggtcaagatttataattagtatttatctactatacacgtttatcatagactccttagttattgttcttgtgtatgatttaaatggactgtacagtagttgtgagtgcaatgacatactaatattagatatttactgagcatgagctatttactgtaagctatacagtatatgtgatgtaggtggatttggcgagttggtactgtttattaacttgagattgattaccaacttaaaagatactactccatggggcgtgacattaagtaattaattccttatagatgatttaatcacactagctctgttatcatttcgcataaacaagtcaaagactcatctatgtgtattcatattttatttacataatcacaaggctaaacttgctttaaataacctataagtcatgggtttaattatatggccattgaatattaaataagtactaatattgtcctatacatccattcatttgagacatcacttatacttaatttacatggttgctactgtgacaaaacatgctagaaacaaatattattacatttactctactgtacaataccaattctatttattagcatatttttaagttgaccataacctaatcatatgatattaattatttataattataaatatattttattaaatagtgaattacttcctccatttcacaatgtaagtcattctaacatttcccatattcgtattgatgttaatgaatctagatagatatatatgtctagattcattagtatcaatatgaatgtgagaaatgctagaatgacttacattgtgaaacggagggagtatataccattggaaagcttatgaatttaggttcaagtttcactcaaatccgagttaaaatgaataagttatgctaggtaaagattcaaatttgaattaatccgagaaattgtaaaaaggcactgttcataattcatttatttttaatccaaaatatatccttatccctaacagctgctgacatgtggggtcaaagctttgattttctttttcatataattaattttccaaaggaaataggaggagtggagacggctcgtcagtggctcggctggaggtcgtcttcaacctcccgactgagcggaagtagcgagggaggatgcggctgggcgcggccgggttggcgcgaggccggcacggcggcggccgaggaaggtgcggcgagctcgagcgacccaccgactgcggcagcggcgcgtggcggagagagggcgagtggcgcagcatggacacgccatggcccgagctcgggttgcaaggggatagggtgctagggctaggatccaacaaaattgatgggagcgtgaacatctacggggtatggggattcgatttcaccagctagatggagaggggagttcccgggatggcttgtcacggcgacctcaccgacggcgcaatggcggccaggccggcacggccacaggtactagttggcaaaattggagctggcgctagctattagagggttagaggatgctacgtgcgcgagggtgtaccgtgagaaggcgagacggcgaaacgcggcggagtagggctcggtgtgtcgcggcacagaggcaaacagcgttgatggcgcccgaaagtgttcgtcagcgttccttgacgtccaacctccccaacggcgacagcggcagcgtcgctccgcctccatttcctccaacctccagctccggccggggagcccctcaatggtggtctctagtagcggtgagatcatgcatagaaggtgctcgatgaaatgtatttgagggcaaaagacagagagaaagggggtttttatggggcttggcttagggataagccagaatggcatggaggataaaatcggcggctggcgcactcgatggctgtctacggtctaggttagggaagttgacgcggctaaagttgtgttcgggaggaggggttgggaaccctcctccccggcacaaaaaacaaagcgcctattattgcagaggtggcatggtcggtcgcgtgcgcggcgtccgggcgcgagcgcggatgcggagggatgaggcgcgaggggagggaggcgcggcacatagaagcggcgcgggtggagttgggttggcgcacggctgcgcgcgtgcgggatggatgtgggcagacacgggcgtggctggctcagtcggtttgggccacaacttgatcgagcacctggcggcccatgaacagttgcgccaggaaaagaaaaagaaagagaagagaaaggataagggaaaaaggaagggttaatctgtaaatttgccaggaaacctaatttaacatttaatatccaaaaatctagattttactcaaaagttgtgatggcacaattatatttccattgcattatttaaattaggtttaatcccaaatattagcctagacaattttgggggcgttgatatatcttaggagtttattaaaataatctaagtagacatagtgatggtgtgttgctccattactttacacgaccgtttattttatatgaatgaattttatgccctgagagacttgataaagtgttttaaatatttatttaaatattctagcgaaacactcttttataatgggattagtgtaatgaggtggtcattatttcatgtgagattggattcagatgaattcgatttaatcttactgtttccatttgttaaataatcaaacatggtttgaatatttaatatttgatttgtaatttatccaatagaaattactccctccgtttcacattgtaagtcattctagcatttcccacattcatattgatattaatgaatatagctagatatatatgtctagattcattaacatcaatctagctagattcattaacatcaatatgaatgtgggaaatgctagaatgacttacattgtgaaatggaggaactaataattaacttttccttcatttagctttctgccttgtgcataatatttatggaatcgatagatagcgtattcttgcaaattgtacatctttaatttaatgtttcattgtgacaatttatagtttggcaagcaatagcaaccataacatctagcatgatgcaaaagttttaaaaagttcgaaattttagttatttttattgttgtcaggatgttacacaacccgtgcacgtgaaggtataccatactcgtatattccataagtcgtaggataggaggtatgacttatccgtaaccatgacaaaagttaaattgctttaagtgcgacgaaatttatagacaaatattgaaatatttacattaccaaattagttttattaaattagtaattaaatatatttttataataaatttatcttggttcgaaaatattactatttttttctataaacttggtcaaacttgaagtagtttgactttcaccaaagtcaaaacatcttataagctgaaacggtgggagtcgaggggagcgatactgcgagagattgacgacgacgcgccacggcggtgtctcgctatgtatgtttggttcccttttggctcgggctagtatggtgggttgtgttgagaaaccagtttattctactgatcaacacacaagcagataaacacagagctgtggaacatagaaaatataagcgagtggaagctttatttcttctgtatttgagtacaagctacaagaggagaggcaggagactgaagatcggttgtcctcgccttggaccttctgggccctatttataggcggaggagggtagaggcttgcatcgtaagccttgaaccttctggcttgcgtcgtaagccggcttacgccgtaagctagcttctcctgtaagctggcctctggtgtaagctttcttctgtagtaagcttcccactcataatttaattcgtccacaataagataggtttcataacactaccccttggacgaatttgaattatgcacatgcctcatcaaaatctcctcccaaaaacccagtgggaaaaaatggtaggagaaaagagtacatggcactctgaatattgtgttgcacctgttgcctcgttaaaaaccttttgtgagaaaaacccaatgggaaaaaaaaactcaccaagggaaaaagagtacaacagttggtcaagtcttcaggacttgtttgtgattcttcaggatcacaatcatgggctattctcttaattgtttgctccccctgatccttgcaattcactaagtcgtctcatgccaatgccacgaacatatttgtaaaaatttgatgctggcagagacttcgtaaataaatctgcgagattttcgcatgacttagtttgtaggacatttatctccccgctcttctggagctcatggggataaaagaatttgggagcaatatgctttgtgaaattgcttttcacatagcccatatgtacttgtgcaacacaagcagcattatcctcatagataatggtgggggtgttatcaatatttaggccacatgacttctggatgtaaccgatcatccgcctaagccacacacattctcgtgtggcctcatatagagcaattatttctgagtggttggttgacgttgcaaccagggtctgctttatagaccgtcaggaaatggtagtattaccacaaagaaatacaaacccagtttgggatctggcattatgaggatcagacatatagccagcatccacatatcccaccatggatggatcttggttcttcgggaaccacaacccaagatcttgagtacctcgaaggtacttgaggatagttttgacgccaatccaatgtcttctgtttggggttgcactatatctagccaatagattaactgcaaaagcaatatcaggtctcgtgcaattggctagatacattagtgctccaatggcgcttaagtagggaacttcgggtcccaacatttcctcatcatcttccttgggtttaaatgggtccttatctgcttccagggattggaccaccatgggggttttcaaaggatgacatttatccatattgaacttaccaaggaccctcttggtataggtagactggtgcataaacactccttcagggagatgctcgagcagcagcccaagtagaacttggttttccccaagtccttcatctcaaactcggtcttaagataagccattgcttctttaatgtcctctgtggtgccaatgatattaagatcatcgacatagactgagatgatacaaaatccattcagggatttctttatgaacacacagggacaatcatcattgtttcaatccgtataatgatcgctgcaggcgaacactatacatgttgcaatttcttttcggattcagaatcttgagtccttcagggaccctcatataaatttctgaatctagtgatccatacaagtatgcagtcactacatccatcaactgcatatccaagtttatattagttgccattgagatcaagtatcgaaacgtgattccactcatcacaggagagtaagtttcatcatagtcaataccggtctctgcgtgaacccttgtgccactagcctcgctttatacctcaccacctggccattcctcttccggaggaagacccatttgcatcctacagggatgattcttggaggtgttgggactgcaggcccaaaaacctctcttttataaagcgagcgcatccttgcctctattgatgctttccatttgtcccaatctgagcgcttctagcactcaatcatggactttagttctggatccggatccattatgacggcaacctttgaggcaaagtgaatgtcgacaatagtggtctttctatgatgtaactctcctgtatcagcatagttagtggaaatctcctcatttatttcctccaacttgtcgtgatttcccataacgaccgagttggggtgttccgatcttccagtgccaaggtgcacgcgtaaggcactgggtcctccatcttcaggatagtgtccttcaggttgagttgccacttatggggctttctcaacttcaggttgagcttcttcaactgattctttgagtggaacaagtggctcagatccttgtctccgcggacgtctccgcggaaccttgtcccgagcacccagaggtctccccctcttcctaggatgggaggtaagagcatagtcagtaaccttatgggttacctctactctttttggagcatttactgcaggtatagcgaccttgtcactcccttgtaatcagtgaaggcatctggcaacttatttgcaagattttgcaaatttatgattctctgaacttccagttcagcttcactagtgcgtggatctaaggactgtatcgcagttgcattccatattatatcttggcattcttctggatgcctttctccccctaatgctgggaaatggccctcatcaaagatacaatcagcgtaccgagccttatgaagatccccagtcataggctcaagatact

SEQ ID NO: 24171 - DNA, 8572 bp, Oryza sativa
  unsure (1)..(8572): unsure at all n locations
nnnnnnnnnnnnnnnnnnnnnnnnnnnnnnnnnnnnnnnnnnnnnnnnnnnnnnnnnnnnnnnncactgggtcctccatcttcaggatagtgtccttcaggttgagttgccacttatggggctttctcaacttcaggttgagcttcttcaactgattctttgagtggaacaagtggctcagatccttgtctccgcggacgtctccgcggaaccttgtcccgagcacccagaggtctccccctcttcctaggatgggaggtaagagcatagtcagtaaccttatgggttacctctactctttttggagcatttactgcaggtatagcgaccttgtcactcccttgtaatcagtgaaggcatctggcaacttatttgcaagattttgcaaatttatgattctctgaacttccagttcagcttcactagtgcgtggatctaaggactgtatcgcagttgcattccatattatatcttggcattcttctggatgcctttctccccctaatgctgggaaatggtcctcatcaaagatacaatcagcgtaccgagccttatgaagatccccagtcataggctcaagatacttgattatggacaaagtctcataaccaacgtatatccccaacttccggtggggtcccatagaagtacgctgtggtggtgggatcggcacatatactgcacagccgaatttacgcagatgggaaatacttggttcttttccacgcactagctgaaggggggatgtactatgatatgtagttggcctgagttgaattagtgttgctgcatgcaacacagcatggccccaacaattggttggcagcctacaatcctgcaacagtggccgtgcaatcaacttgatcctcttgatcaaggactcagctaggctattttgagtgtggatatgtggtactgaatattctaccttaatgcccatggctaacaataatcatcaaaagccttcgacctgaactcaccagcattatccatttgaatggattgtacgcggctatcaggggagctagcttttagcctgatgatttgggcaattagctttgaaaaagcatgggtccttatggacaacaggtccacatggctccacctggtaaaagcatcaatcagtaccatgaaatacctaaacgggcctgacaggggctggataggtccacatatgtcaccctgtatcctttccaggaaaacaggtgacacatccctaatcttcaggagggatggcctaatgatcaacttcccttttgcacaagcagggcaaataaaatcttcaggattagggaagtctttggtttcaacattgtggccagtagaattattgatgattctcctcatcatacccaacccaggatgacccagtctgtcatgccaaactctaaatgactctgggcttctaaatatggttttcatcgcaacatattcctcagtgggttttatgtacgtgtagtacaaacccaatggcgatgaagggagcctttccaccacttgcttttgatatccatctattttggttatgagaagatattcaacatcttgctcaatctcggtttctatatggaaaccgtttgcacggatatctttaaagcttaagagggtacgctttgaatcaggatacaatagagcatcctttacaaagatatgggtacccatagggagaactagagtagcacttccggtgcctactatatgagcattgcttccggcaatggtcataatatttccagttttcttagttaaggtgtggaaatatctagtttcccttaagattgtattagtggtggcactgtctagtagacatatatcctcttctgccatgggatacccacccaagtatgtttatggaacataaacataaatgaaactagatgaataccccgcgcgttgctgcgggattttgtaaaaataatttggatgaaattcgtatggatgatgttttaagagaagataatatgctacatgtaaaataaactaattccataggtagagagaaaaagagagaatcgatatagcaaacttaaatactcgctaccaaatgtttcaacagtacgtacacactcgtaatctagtacaacaattaaatatcttctctgcttaataaagggaaatgttaaacccttgtgcatattttgttcactcgcttattgcttactattcctctctcctgcttcaggttaggttggagtctactgcacgcctcctcaaattcagtgtttgatttggggtaagtgaaattccgatcttttaattcagtgaaacctaacagtccctaaaacatgtatcttgttgtcaaaggatcaagaaaaaaaattggacaacaacaaaaagatacaaactcatatacacacacacttatccctataaaggcacatatgcacactctaactctatgaggcacctccgagagatagggccagcatatttttaacatttagttggtcaccgaaggacgttttgttctttgatggatacatcaccttcaactgaaaaacaattagccattcatgctcttacatgtttttttgttaggacacaattagagtaaagcacgtaataacaaattacacttagctactgaaatgtgccaaggaattcgatcagaccaaacaactctaagtcttataaaatcatgcccacagaaaagtacaaacaattttgaaggaccaattccggacacatcttagacccctagaaattggttttgtcgaatcgttcatgaaatgctaatatgattttagaaaaaggctcacctttatcatgtttattccaccataaactttaatttctcagagctgtttcagtgacttgcactcatgacacaggaagcaccaaaaacataagatttatttgactcaatatgattcaaaacaaagagatgagcatgtatatgttatctaaccatgtaaaacttaaagattagtgtgaaaattcagcaaccaacaactttacttggccattagttataaacaaaacttcaagctgaaattagcattgcctgacagcaattgcaatctgcactaagcaacccaaacttgtgaacaggggggtcaacaaacctagagcagcttgtttagaaaaaaaaatagtgattcagatttcaccatgctcctaagtcgtaaccatcaaatctctgaaactatcagatacgtacctgaattcattcccttcgcacatagcccaaatacatatccataaaccattaaccattattggatcaataaaaattgggggttaactattttcagcaatataatatatatgtatgtaagcaaaaaggtgatgcagaagtaacggaagaaacacagtgggagtggaccaaccttgatactgaagaagaagcaatgtgcaggatatggtacggtaacccaaattcccaatgtgaacgctgcatcaagaagaagaaaattatcatagcagcctcaacatatgcaactgcaaagaataaacagcaagacattctcacactcgcatgatccgaatatctgtttatggttctgagagccagatttaacttgcctgttgtgaatatgagaggagaggaattcaaagagagaccatgacggatgtagaactggagaggccggccgttttatacagggccatgagtaggcgatacgacgatcttgagtaaaattgttgcagggagtagagcacataacttgtattaaccactacgcctcctcacccaattaatttggcggtttttattgtaaatgcgggtgattaagggaggaagtgaataccgtctctaatgctgaagaggatgagggagggggcgtttgaagctggcatggtgctagggctcttcaaacgcgcgatacctgcagccgtgccaggctagggctacaggggcgcaacgctgcggtgtggctggcgcgtgggggacggcggaggcaatgcgacacggggaggagaagcgagcaagccggctggtgggcctgcacgtgctgggggaagcagccgctgggggaggggaatcgaccacaccgcatctcgcgcacacgcacgggggtggaagagaagcgagcgcggtgggcgaggggaatccgcatctacggcgggcccacagtgcaacttgcgtgggcgcatgctgggcggagaaagagcgcgcatctggcggcggctgagaaaggagaagaccgagcgcccagattagatcgcagattagattgaatggctgagattttacaggtgacgtggcttaaccacaaatcagctttgggtcttaattatatagaaagaagggattaaacatggagtaagtttattctattaagggaaacattacaaggacttcaggcccagtaaaagactaagcgtgctcttcaggagcattattcatgaccaaagttctacatgtgctactcatgccgaacactgcatatgactgacatataggagattacttcaggtctccaaatatgtcatcatctttttcaagaaggttgtctcaatcatcgtccatacggatgtccccaccatccttaacattgataagcatgtcatcatgcttttcaatctgagcttcaggctcaatggtgaagtgggactcatgttggctctttttctcattcatgctttgttggtacagctcaaccaggtgcttggggacatggcagttacgggaccaatgccctctgcctccacatctatagcagttatcctgcattaccccagatgattcacctgtaaccttcttgagttcgcctttacctctgggttacccttactcttgcccttgaatatgatacttcccttacctttccctttcttctcaccatggcctcttttacggccatgtgagtttccaacaacattggcttgtgcttcaggcactaccatagacctagtgggtcgagcagaatgattctttagaagaacctcattctgcctttctgcaactaacaggactgagataagatcagagtacttcgggtactttgagttcctgtattgctgttgcagcactatgttgttgggatgaaaggtagataaggttttctcgatcatctcagcgtcagtgatcttcaggccacataaatgcaactgagaaatgatcctatggtgggcagagttatacgccgccacagacttgtagtcttggaagcgtagggtgatccagtcatgttgtgcctgtgggagcacaattgacccttgctggtcaaagcgatccttcagggattgccataataccagtggatctttctcgatcatatactcagacttcaggtctaggtaaagatggtggcgcaagaaatgcaatgcctttgctttctcggccttcgtagactccacagtgccaacttcgggcagcacaatagtatgatcgagacccatggagtcgagtttaatctcaacgtccaatgcccaagtgaggtagttactaccatccaaggcaagctcggcgaattccttctttgctatgtccgacatgtcctgcaacatcatttggtatttacgacaggtaaatacgatgtgcagggtcaacatgaattggtcatgcgtaatcttcaggattactagtgtgtgtaatcttcaagattatcacacaatttcccatagaatctttcctagcaaattaacttaagtaatcttcaggattacagattgcttgattaaatattatcaatcatgctaggaaatcaatttcataacaataaaataaatgttatgaaagtcatgcaaacaacaaagtaagcatgtaaaacaaaatgaagagcattcatgggcacttcatgcatattgtgcccacgcttcatggtggcagagctgaccttagaggcgtcaagggcccatatgggtgatatccataaaacaaaggacatccataacgacacttcagggtcgtgcagaaggttcgtttgcctccgatatttggtggcaacggcggcagagccgtccattaagttgccatgccggtgcttcaggcacctacatcacctctagcatttgggcgataacggcagcagagccaccatcgtgttatcgaatagtgctaaggggatgtaccatctcaagcctttggacggtaatggtggcagagccgccatcatgttactgggtgttgctgagaggatgtatcaactttagcaattgaacgataatggcggcagagcagccatcatgttatcgtgtattgctgagaggatatcggaggatggtacttcaggtaccatgttcttctgcttatttcaactatagcagaaggataatttgcatatcaagagcaagatgatcagtagaaactgatttctcactggtttacctttttagctcgatagagtctcgtgctgataacgtgttgagaaaccagtttattctactgatcagcacacaagcagataaacacagagctgtggaacacagaaaatataagcgagtggaagctttatttcttctggatttgagtacaagctacaagaggagaagcaggagaccgaagatcggttgtccttgccttggaccttctgggccctatttataggcggaggagggtagaggcttgcatcgtaagccttgaaccttctggcttgtgtcgtaagccagcttacgccgtaagctagcttctcctgtaagctggcttcctctgtaagctggcttgcgccgtaagctagcttcttctgtaagctagcttctggtgttagctttcttctgtagtaagcttcccactcataatttaattcgtccacaataagataggtttcataacaggttgcaccagataccatggacgtgggcaagaacaacgtccccttgtggacgttgatacccacaaacgctgattcagtctgcgtccttattatttctctaaatccaatatagtactatgatttaccatttatttaattcattaaataataattactccctccattttaggttataagacattttgactttggtcaaagtcaaaatactctatgtttgactaattctgtagaaaaaagtaataatattttgtcgggtcccaaaactaataattcggaaactgacatgtttagactgtatcaagcccaagatcagtagattggtacaggttcaacaatctggatcttcattgcatacatttgaataaggctccgaaggtgacttctttacataaataatagggtatttacaagcttgtggctaactaacatagcagaagctataggatgacccaaccctaatgttttgctatagaattaaaccatctacctatgctagacttgggagctaagttggaatgagactaacttatatgattatatgattgaactcccggcttcggcaaaaactctaaattgattctgaaagagggggttaaagtaaaggtgagtacaatgtactcagcaagctattatatcaaatatgaattcatgaaatagaagtaattgagtagggctaggtttacttgcagaaagttgagattatagaagtagaaagcctgtaatatttggaatgcaacagtatttaataaaatcttgaattatgtttctaaccaagatgccatagttagtccctatgctcaatatccgtgagcataggtattcgaatagtttcaagaatattcatactacagtagatatatgctttacccgcaatccatgacatgccaatattcattagcttagtcacggcccagcttttcggtttctaacatcagtggtacctgttccatgaactctagtccccatgcactctgaacgtatgttatcagcagcgagaggagttctggcattcccggggtctttagagaggactgattgtatgacaccatgtcatcgcaatcagggtttacaaataattcgtgatatcacagtttatatcaaatatttacttgtacctcagtaaatatcaccattgccctactcggcataagtttgcctcctgtgcaaggacttaaatatagaaccactatagagagaggtaccacctttgctagataacttaattggctaggtctacacccatccgagaattgctgtcgtactcgttcgttcttcacaggtacttggcagtgcttatgttgatcgacataaaaaaaaagctcgaaagcatttacccaaattcgagctcgaaaactaaaaattaattgcgacgaggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactccattgaaacgtaagggggacggcggttttcgaacaaggttttgccttagctcgaaaacatgacataaaaaaaagctcgaaagcatttacccaaattcgagctcgaaaactaaaaagtaattgcaacgagggaaacacgttcggggtaccgagctcgtcacttctttgaaaagtaagggggacggtggttttcgagcaattttttgccttagctcgaaaacacgacataaaaaaaagctcgaagcatttacccaaatttgagctcgaaaactaaaaagtattgcgacgagggaaacacgttc

SEQ ID NO: 24172 - DNA, 3842 bp, Oryza sativa
agctcgaaactaaaaagttaatgcgaagaaggaaacacgttcgacctcgtcactcctttgaaacgtaagggggacgcggttttcgaacaaggttttgccttagctcgaaaacacgacataaaaaaaagcttgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacgggggttttcgaacaaggttttgccttagctcgaaaacatgtcacatcctgaatttcgttttaggatttttaaagtatttaataaattattattagaatttatattaaatgttcattaattttcaagtgaagttaaatgtgggaaataaaatttcctaaatataaaggatggatggatttaatttttattaaattcttcatggttaattatactctttggaattatctcggattttttcggagctcaattcctaattttaatcatacaaagaacatttcagtaattacccacatatttaattaataattaaatggtctaattataattttttatttactttgagtgtccaagtattttcaggatttttcttgaaattatttgagcattggaagtatttttaacaattcaaagatcatttaagtgattattttaattggaaaagtaataaaattctcctctcccttgtcttaggctgaatcggcccattcctttccttcctctctcttccgccggcccaacccgagcctgcatcctctcttcttctctcagccaaagtccggttttactccctcttctaatcaggctgagaaaagaaaagcccggcaagaagtctacttttcctccctgtcgctacagtgcgtcttcaagctccagccgccagccgagccgagtcggctgccatgccgagccgccttgccgcgccgaatccgccccaatctctccccttttcttccgtttttttttgaggggtttttatcctctcatcttcctctatccttacccccaaaaatcggagcaaatcgttgagtattttatccgaatcgaactcgttttgagtttatctccaaaaccgagtttttgatttcccggagcgatttcttgcgggaggagtccgatctattcaacccaaggctataaataggaccccctagtcctcctctttcgtttgccccctctcccgtgatctcccgtgcctcgtagcgccgccgccacgtgctccaccccgccatcgtcgccggccgagttccatccgcgtcgcgccgccgcctccgtcgtcgccgccggtcgccgtcaccaccgttaggtgcgcgggagggtggagaagcccggccgcctgacccccgaagccgccgaccaccgcagctccggcgccaccgccgaccgaagtcgtcgccgccgctcttcctctccgccggccgtcgtccgtcgtcgtttgtcgtatcggtgagcaccattgagttcgcaatgttgtcctctacgcgtatgtgtcctccaaaagtccggccgaccaccctagctccggcgaggtcgccacccgtgccgtggctgccgtcgatgacgtcatgacgtcatcatctcctctttttcagttttttttaatagattaaatcttcggaaattcataactaaatcatcgtaactcggttttgagtggttcaagttgctaaattcatctaaaatcatgatctttgtactgtttatttggtttttattagtctttttcctcgttttgcgtgttagcttgtcgtttccgtcattgcgaaggttcgtgagtgcgtcgggagtgttcagaagattaattgagaccgattattgcaaggcaagtcacacagatcctaaacacaatcatttgagcatgttgatcctatatttaaattctctatttattttaactgtgcatttattttcgaatgtcactgggtggtgtgaacctattcctttgttatggccaatctgcattgaatgccctattccttgataccttgggtaataaattgattagcttgaaccttatgtattggtttggttcagctaaatgttatatatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacattaaccgtgccaaccacaagccagcgtgggcaacggctttaccttttgtatagcatggttcattgtggagcaccagactgagaagtggcggagataagcccacgggggtcgctggggagtccatgccttgttttataaggggtgattatgatccaggaatggtgtactgtggtgagttgtgttgtgcagagggtattgtcacagcctctattcgggtactttccagtatcgcgacgcatggtagacatgatgttgaggctgtgtcttgtaggtacagtggtacacctctggctagagtaaaactattcgaatagtcgtgcccgcggttatgggcgagttgagcaatgtttttcgtgattagtctcacgcctctcacaataattattgatgctataactggtaataatttgtttagctcctggtttggagttagatctgtacagccgggtatggttgttcaggatggttgggcctgtgcagcatgggtgtgttgttcagtgttgattaaaatttctgattaattactctactgttttactactcttaactctttgctaaatgctgctttcgcaaatgagactatattatgccatcctttggtatccttgtgcacttgcatatttgctgtgtggcttggtgagtatatcatatgctcattcttgcaataatcaatcaacctcagttgaagaaaagggatccagaaggagaagacgtttggcttataccccagttgagttgcctgtgggagtggagctgaagccatcgctagaccgtaattccgctgctgtttt

SEQ ID NO: 24173 - DNA, 3511 bp, Oryza sativa
  unsure (1)..(3511): unsure at all n locations
nnnnnnnnnnnnnnnnnnnnnnnnnnnnnnnnnnnnnnnnnnnnnnnnnnnnnnnnnnnnnnncttttagaaacgaaaaaaagtccgactctggattggtgaaaaaaattgatgagccgaactgaaaatctgtttaaaaaatagaacctacaggtcgagatcatttcatttttatatgattttaatttttgggtttgtacttttgcatttgagtctctataatttttatatttacatttgagtccctataatcttgcaataaggtatttgaggtcgtttttgttaaaaaaataataaaagagagaaaataaaggcagaaaggtgcataaaaagaaaaagaaaagccgcacaaaaaagaaaataaagaaaaacaacgataacaaaagtttttttcccctaagtggccaaaaaaactgtagatccaaataaaaaaaaatctgattcatataaaaggcaaaaaaaagtggtgaaaaaaaaggctagaaccgattcctttaaaaacaggaaaaaaaagtctaattcctataaaggcgaaaaaaatccgaaaaaacatctaaaaaagttcgtccgattccctaagaaagtggcgaaaaaaatggttcttaaaaaataaaaaactggttcatataaaataaaaaatgcacgcgaaaaaaaatttggaaagggcggaaaaaatcctatttctaacaagtatatatctcttctctatctctaatctaatctaactattaaaaaaagagaaaatacacgagaaaaaaaggttaaaaaaacgcgtgaggcaaaagtcagaaaaagctcaaaaaaacacgctaaaaaggttttccatcttcaataaaaaaataaaaaaacacgcgagaaaaattatttccatcgtcggtaaaaaaattttaaaaaaacatgcgaggaaaaactgtcagaaaaaacatgccatttctaaaaaatggttttaaaaaaccacgcaagaaaaaataccgtctattaaaaaataaatcgctctaaaaaaactatcagaaaaaagctaaattgatggacacttgagtcggataggattcatcgattttttgccatctactacacggcttttattttgtcatatattctcctgtattagaaaaaagaaaaaaagaacattcgaaaaaaaacaagcaaaaaaacgtgcgagaaaacaggcaaaaaaacaaacgagaaaagaaaagcaaaaaaaggagaaaaatatggttttctttgtcagtaaaaaaagcaaaaaaaatgctaggaaaaaactgttagaaagaaatacgccatttctgaaaaatggtttgagaaaatctcgcaagaaaaaaacattgtttataaaaaacaagccgctcattaaaataaaacattgtcattgacatgattatgcatgaaaaacgtatattttcattagaatgtttttacccattgcaacgcacgggtatttttgctagttaaatgaaaaatacgaaagaaattaaataaaaggagaggttttatgcgacttagttttaggagttccctctaattataattataatgtccttggtttaggaggttattaagaatataagaatcaacatgatgcataattagaaaataattaattttcgggatgttatatatttataacatcaatatagttttattaaatatacaattgaataaatttttataataaatttatcttgagttaaaaatattactattttttttctataaaagtagtaaaatttaaaatagtttgactttgaccaaattcaaaacgtactgtaacctgaaacactgtaccaaaaaattcggttcaaatagcccccccccccccccccccccataatccacgtgttccaaacaaccaattggctcctacccgttatctttgtgtttccatccagngaaccccacctcatcattctatatttctatgattctatcccctccagatttatcggcgcctcaaatccccagtcgaccagggtgctcccaacaagaatcccaccgccaccggtcgccatggctgcggtcgccaacaccgtcacaaccctccccctccttccctcccctcatgccttcgccgtgcccgcaatgggctcgctgcccttcctccggcgccgaatgcgctcccgtcgcctcgccgctgtccagcaggatgcggccgtctggacccccgcccccgtctcctccttcggcccagccaccgccgacggctcgctcgtccacttctccgtggacctctccgacgctaccgacctcgccgcatcctacaccacgccggggcagtatctcctaatccgcgtccccggcgaggatgagctcaaaccggcgttcatggccatcgcctcgccgcctgggggtgccgcgttcgagttcttggtcaagaccgtacctggtaccacggcggagaagctgtgtgggctccgcgacggggacgtgctggagcttggcgcgataatgggtaatgggttccccatcagcaggataaatccgcccgatgaggcgcaaactgtgctcctctttgctacagggaccgggatcaggtgattgcttctctctctgatgaatgcttgtttttgtatatatgctgagctgagtttaatgtggttaacactgcaatagtcagttgtcacacatattgctttattagtagcattttgcagtttacacatagtgaagcttttaaaatagttctgagctataacaaatttcatatgtataagcttagagatatcgcaatgttcttcagtaattttgaacatgttgtcactgtaatgcaacttgtttcttttgatgtatctcattaatcggacgactcatttacttactataatccagtttgctaaaataaataaaggctgacttagcggaagaatgcaagatgagaaaataacagtatcgtcgagcaacagtatctctaataataaccgtaggtgctgacataattgtgttatctattacttatgcatataaatcaagcctagaaaattagtacctcacctttggttctttcctaaaaaaatgccttttgtttttgttttgctaaggatcaaacattccttacagatgaaatagatcacaaaagaattacctatatgaaaaattaacatgagaaatggatggtatgtgtacgaagattagcaattacgctatactgcattacatacttttatttaaatggcatgtttactacagcagtatggtgaggcaacgcactttgccttacagcatatgcaatgtgacacaagttgagatggcttgttaaacagcatgtgatcctgggcctgttggggcacacaccctctggccaccatccctggtcagtagtcatgccaaaatttgcagcggtggctaggcggaagaaatagccaaaccttagttgtgttgactgtttgattgctagccttgataaaccatatcaagatttggttacaaccgatatctgggcatgacaaaatgtttggcattgaaggattgggtagatagcatgctgttttggcaaataggtagggtagcgggtagc

SEQ ID NO: 24174 - DNA, 4103 bp, Oryza sativa
  unsure (1)..(4103): unsure at all n locations
ttgttaaccagcatgtgatcctgggcctgttggggcacacaccctctggccaccatccctggtcagtagtcatgccaaaatttgcagcggtggctaggcggaagaaatagccaaaccttagttgtgttgactgtttgattgctagccttgataaaccatatcaagatttggttacaaccgatatctgggcatgacaaaatgtttggcattgaaggattgggtagatagcatgctgttttggcaaataggtagggtagcgggtagcctttggcttgagcaaggtaaaatgccaatatgtatatgactatgacgaattggtggttctaccttccttctattactctctatgtaaaaaaaagtgaattttctatgactggactgactgggctaagttatgagaaatagatttttcctaaatggattacaaaataaatacttttagtttagaatatatgatcttttaagcattagtactaaataaaccaatagcatatttcatgcatccaatcaccaccttccatgtcagcccagctgccccagcatgctgattgggcagcaaaagattgtgagctgtttgtttcccatcgaatggtctgcagattggctagttttggcttagtattactaatttcctttcgcatgccaatttttttaataagccaaatagtgggcaatttcctttggctttctcaatttttagtacgaaatttgtataggttaatcagcactcttggttttgttgatctgcttggccatcaccccccatttagccccaaatattcttgtagggaaacatgtaagaaagtaggacttaagctaacttaatatcatgtaatcaagggtttaaaagaatcatgattttcatgtctttgtctcatggcccatgggcccaaaatggcgatggcagttatcatggaagatatcgtattctgtgaaagctaagcttataatatagcaatactttttcttcaagggaaaacttatatcatatgtcactactcgaaattgattaggaaaagtaaaaaaaaaatagtttttacatataaagcatgtaaaaccgaacattaaactaatttgccagtttaatatctgttcatgtgaaattttaagagtattgaagattcaaagtagtctcttattcgtaagaagccatagaggcaaacataaagtaaagcaaagaaaaagaaaattaaagaaaaacattactccctccttcccaaattgatcatcatattttatgcatcaagaccaatgataatttaaatcacatcaatcaagtcatcatgaacacattctcccacaatgcatgcatcgattaaaacatcattccagttagagcaagtttaatagtatagctaactactagctccatatcatttatagccaatgtaatagccaattcatacaatagttgcttacaacactattaatacatgatcctacacactgtatgtcttggagtctgtgctgcagctggctacagatctgtagcccgctgctcttctctctcttcctttatctcattaaaatatgtttatagctggcttatagcctgttattgtacctgctcttacaccttagcatgcacacattctcccatgttgtattaattgtattctgatgaaatctgtgtccatgcggttatatgatgatcaatttgagaaattttgaattccattatgtgatgatcaatttgggaaggagggagtagatgccaatgttaatgtctcatagctgcctgtgggaattcgcttggatatttgttttacaaaatcatgagctgcaattaggagttcgatcgtcttagttagcatgcgagtttttttaaagagatttcttatacgactccttctgtatttctaaaagcgaacgaacttaaaaaccgactcaaacacggatgacataccaaaggaccggcataaacatcttcaatttttataatagtagagattaaatagaaaaatgcatttgtactgtagtagtaaagagaacaatgcataaagttaaatagataaatgcatttgtactatagtagtaagggttctgctttctctttctgctcctatatgtttttgaatggttgtaccaatttactggacctaaaatgaactattgcttcacatttgttagaatattgtgagaatgtttagttccctttcctcaccatcaaagcaaacttagttagcgtttggcaaggacatgtacatgattttattttttttttttgaccaagggtatgaagcccccatttccattactagaaatgagcatactacagagttctttcatacaaaggaaacaaggactaccagcaagctagttttctgaggaaactacatccaaaatacggttttccagaagactccaaccaaaatctcccctatgacacaaaggactcaactccctgcagttttaaagtaaagctaagacacctaagaatccaaagaccatagcaaggcagcagccaccacaggtcttcaaatctaagctgacttcacagtccaatccttcttgcgcctcctctcaatccatacttggaattgaagatctcatttgctacctgtcttatgagtttggcccccaatagcagccttctttgatctacctccactttctgcaaaggaacccaagattcaatccaatggcaaacaaagaaaactacatcagttggatcattaggaaattttttgtcaaaacaagctttttgttccttgttttccaaatagcccaaaacactgcagccaccccagtgactaccagatttttaagttttttcccaaacgcagaaagccatgtgccaaataactgattactgttcaggataggtcccaaattaaaagcacacatgacaatgttccagatcaacctagcaatagggcaatcgaaaaaaagatgttggagtttcatgatagtttcactaacatgtacatgatgttagttggcgtttgtcaaggacgtgtattttgtttgtaactacccaagagcaggaaaaggtttccttgcttctaagggagatcagcatgctgttatcttatttgctggataggaaagacagggctaaatatgtcttgaatgctgatacatcttttacgataatttagtctgattccatattgttgctgactgtctggttttggtgatcaagtatagtctggcatccttttgatggaatcctacccaggttaatttgtatgttaatcatgcagtccggttcggtcacttattgagtttggttttgctgcggatcaaagagctgatgtacgactttattacggtgccagaaatctccaaacaatggcatatcaggttgagacttggaactttccttcattctgctctatgtaaacaatatcttcacataaaccttttctctctggcaggataggtttacaaactgggagtcaactgggcttaaaataataccggtattgtcacgagcagatgatagttggaaaggagaacggggatatgttcaggtaatatatgaaaactccaacattactataatcttgttatatgttcataggtacatacaaccttatatcatatcattttcattttccaggatgctttcttgaaagcccagaacatagcaaatcatttttctactggggcagtgctctgtggacaaaaacaaatgtctgaggcatgtttatcctctcttttttttttttacttttgcacattcctattgttatgtgtgctacaggttacaaatattatgtttggttcttctggccaaagagctgaaaccttaaggatataattcaatactgtgcagtaaatactccaaaagtgaaccttttttttctaggccgatagctatttgttcccaaaaaaagaaaaataatttacacttactgtagcaatcaaatgttgccctgcactttgtagcaatcaaatgttgccctgcgcttagtgtagttcctagattcttatcataattgtgataaacccaatgctgtctgttgcaagaaatatagctatatcaaaccaccactagctcttgcactttattttgtgtgctcagatctgtattannnnnnnnnnnnnnnnnnnnnnnnnnnnnnnnnnnnnnnnnnnnnnnnnnnnnnnnnnnnnnn

SEQ ID NO: 24175 - DNA, 5437 bp, Oryza sativa
atatgttcataggtacatacaaccttatatcatatcattttcatttcccaggatgctttcttgaaagcccagaacatagcaaatcatttttctactgggcaagtgctctgtggacaaaaacaaatgtctgaggcatgttaatcctctcttttttttttttacttttgcacattcctattgttatgtgtgctacaggttacaaatattatgtttggttcttctggccaaagagctgaaaccttaaggatataattcaatactgtgcagtaaatactccaaaagtgaaccttttttttctaggccgatagctatttgttcccaaaaaaagaaaaataatttacacttactgtagcaatcaaatgttgccctgcactttgtagcaatcaaatgttgccctgcgcttagtgtagttcctagattcttatcataattgtgataaacccaatgctgtctgttgcaagaaatatagctatatcaaaccaccactagctcttgcactttattttgtgtgctcagatctgtattacatcttgagataaagctaatttgattcaccctgaaattttattgaactctgcaagttgcagtcaggagctagtaatgttagtttgcacacttatgaattggagtataatccacatcatgaagtgtccaatacatacgtttaatcaatataaaattcagatttgggtacaaaatgctactctccattccacaatgtaagatgttttggtctctccatcactcgtctatatttactaacatccttatgaatttagacatatatgaagcacatacttagatccatgcatgaatctattcaaaacccaaaatgtcttatattgtgaaatagaggaagtattataccatcaatgtgcatgtggtaagtaaaattttaagaagattgaatttagttcaactataataattataatattatttattgagaagcaaagctaaatatttgttgatatttttatatatattataatagaaaacaatggttaaagttattttttggagaccatgtcattgtccaaaacgatttgtggtaagttgatgtcatcttctttggtgacaatagatgtaactaggggttggcaacggagtggggcgggtgtggattggacaagaacaaccccagccccagggtgaagagtggggcgaaatcagtccctggccactctgaggacggaagtggaagatgaagcgacacatcagaggaataggaggtcaaggccagccatcagccaccgtcgaccaccacgctttaggatagaggaatatgaggttgaggccagctgcagtgtcgtaggagccctggccgctacttcatcgggatgcagagtcaaggtcaagggataggtccgcaacgacgaacgtagcatagtggtttggctacatgcgttctagtgcagatcaagggacacgatgtcgaaggggaggtctgcgatggtggtgtgggatggatttgtggggaccgagagattgacataacgggatagggttttcttgatgggcttttgtggagtatgtattttctcatctcctatgtatacggggccttgccgatcaccgtggatgaaacatataacccgcctccgcccctcggaagcagtaagtgcctcaccccgatcaactcgtgggtgagaaaattgcctaggccctagacccaatggagaaactaccacccttagttctatctagttcaagttagtattgttggttaagaaagcagcactacgcagatagcttaagtttctaacgtaagtacgaccttctcctgtgttaatgatgtgaacatttgttttcagagtagggttgtggttggttgcaccacggtgcaccacttctccggagtagcacaataatgttaccatatgcttgagcgtgatgaggagtccttcatgacctcactttttagataatatgcacatggaccacgaatgtgtaacaatctgttggcaaattggaattactccacctaagaggtttaaggaggaatatgccaaacaacctccatgtggccatgtgcctcactcacactttccaatggcgtttgatagaggacatcacagccaaaccagttgccaagccaactgcgtccaatgagccaccttcaatgcttacagcaatgccctaacagggcgctagcgaccctcacccccaatgtaaggccttatgtcttggtccaatcaactcacccaaagaaaatggggttaattaaattcatgccatagcaaatttcacggtttggaaaaataccactactatttacctatttatagccataccattgcaatacatataaaattggattcatgccactttgtacacttcaggcccgttttgaaatgttcttttgctattgtattttcatagtgaccaaaatacccctggtcccatttctcacatgggacccacatgtcagatccatcatcttcctccactctgcctctcttctttggataagccatacccatgggggtagtacacagcggaggactcgtccacctcgaccgtcactgccagccagcccctcgcaggcttgtccgcgcgcgctgccggagccatggctgagagtagtagcaggatcaggccgacaagctgaccgacctggccgctatgggaggaggtctgcctttgcagaagcaccctggacaggagaggagatttgctagctcccgtcatctgatttgtccctttccccttaatattttttcagttttctagttttcttcagaagctaccgttattattttttaagttttcttcagaagataccgctggttggagcttcgtttccactgcacctcgagcctggcggagagcacaattcaggtcgcggcttcgtcggatgctactattgtcactgcctccactatcaggagccgtccctgcaaaccatcggaagagcttgtggagagagtgggaagaggaagattgggaagggtggaggaagatgaacttgacaggtgggtcctatggggataggacgaggggtattttggtccctacgaaaatacagtagcaaaaatacgtttcaaacatgtttgagttgtatagagtggcatggatccgatttcagatgtattgcagtggcatagttaaaaataggtgaatagtaatggtatttttctaaatcgtgaaatttgtgatggcatggatctaattaacccaagaaaatgaccaatcgaacccaggcggctatgttagaattgcctaggaattttggtctcatccaccactacatcgcccatggtgctgtactatagagagttggaagagccttgtaagccaaccgaggacatctaggtatcacttaatgttatcatcatccacacaagtagaatagttgctagtctctatcaagggcacctccaatgtgttgcactcatggtctacaactcacacaactatgtgcatgagacaatgcgtgtaagcttggcatcactaataacaattgggtgacaagcacctggcttagcaaaagggtgacaattcctcttggaggattcgacatcgtcaatgtatagttgtttaaaatgttggcacatgtatggaaatttgatggctcgcccatgtccttctagtggcagaaccatctcgacatctcatcacctagcatggcttagaggccacaccatgtgagctaaatacctaatcctctacagcgatagatcttatggtggttttgtgtggatactacaaaacgtttatctaggattacgactttgtttagctatccaagcttgtgaaggagttttttggaggaccaaaggcgagcgtacattccaagctcttaaattttttgttgatcactagcttgtcttgcagatcctaacatcaacacactttctgcagtcgattgtgacaccttgggtctagacttcagtcagattctccatcaagttgattccctccttgctttcttcaacagggcagacataccttaacacaaagttattgtcctaagagtgagagttgatccaacttattaaggttgtctttagtagtgaaacgctcacaactctgtaattccaatcgatatgagcaaggatggtccaatttttctgttagttgatgatacctataatttgggagagaagttgatgacccgactacaattgtactagacgttgtattgcaccttagcgatctatacacctctccatctgttgttgatcttacctggtcagatcaaccttatttctgcaagtaaatcgaagaaacaaggaagaacaagattaaagtaatttgataatacaaataggaattcaagctcacgataaatcgaacactcgataaggtgtggttccgaagacgagtaattaggcggtctggcagacacgtgcaactgcaaggcaaagtagcaatgactaactttaatataagaaaacctgagaaatactgaaggttacctagctatttaaggagatgggaggatgaccttggggtgtgtagggttgtgctccacatgattgaggggcactccacatgggccccacttggaccgaggtcctagtctccacacaaaattataagcataaaggctcatgacaggtggcacaacaccatctttctttaattgtggccaactttgatggaatatagagatgatgttaaatctgttggaaagaggactccaagagctttccaccaagtacttatgggcctgaaaaggagcccgtatgcacatttggtaactgtttgaatctagcattgttgtgtgacttgatctcgatgtctcctcgttgacctatgatgtgagaattgtcacacatcaagcaacaatgatgttttccatagttttcacctacctcttagcttgaagtacatctaggatcaatgcctctccacgatcccaccaaataattaggtaagctgttatgcttttagggtagagtataggcaggcctcgatgcaatattgtgatacaaggaacatgtaatattagagcacggtcgatgggctcctacggcaccgtggaaagttccatgtgccagtcgattgatagatttcgctaacttgttggccgacaccatggtatgacgaggacacccaaaagaccttgcaccaactacagttgcacttttgcatgtgtccaccatgcacaggcagatccaagggtggtcccgggaccacctaaaaaaaatcctagcccaatgcatatatatacaaaaatgaatttttttgggggaaaaagaaaaaaagcacccttattaatgcattttgatgcacatttgatcaatttatactcctagcttcgttatatttagggttttttaaaaaaatatatattggttggaccacccatagaaaaacctagatacgccactgccagcatgcgacatttgttataggacttttgtataggcgaatatcatgtggcaaaacaataatatagaacacctccacccctttagtatcatgcaac

SEQ ID NO: 24176 - DNA, 845 bp, Oryza sativa
gaatgttatgtatgccgtcctaccgtcaaggactggttcttgaagtgcgctcacatcattgcccttgaacgtcctaatatagctccgccccaagtgctttcttgtacaacatcatccaaactacacagtagcgattcatcgcccttgaccatcccaatatagcaagctccatcgcaagggccttgtccaatgcgatcgtccagctacagagtatcccgttatctattatgagcaaaagggatcccatcttcaccagtgccttttaagaggatctcttccagttggtatatgtcatgctacacatgagctttgccttttatccccaatcccattggcagatgtacctttactgcgtcgctgatgatcggcccacagtgagttcactgaatgccctgtgctaagattcgttgcaactcatttctagacagctaagcattccactccatttcgggtcatctatggtaaggacctgctagtccttcatgtctatgaagctggttttgcttgggttgtggccatcttcaatagcatgataagtttctggtggagattgcagcagctgtggtaggctcaaaccaccatggtgtttcaacacgatggccagcactgcgatgtcgatttcattgtcgatgagtttgtttggttcaacacacaacactggccagcctgctcttggctaccaatacatgggtgcaagtggtgcaaagttacaaattagtttgcggtttgcccgtgcactgtacggattttcgattgtacagatgaatttatcggtctttgttgtcttgttcttttggatggcagtttggtacgagttatctcattaagttctatcgttaactaaa

SEQ ID NO: 24177 - DNA, 268 bp, Oryza sativa
aatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgcta

SEQ ID NO: 24178 - DNA, 733 bp, Oryza sativa
  unsure (1)..(733): unsure at all n locations
nnnnnnnnnnnnnnnnnnnnnnnnnnnnnnnnnnnnnnnnnnnnnnnnnnnnnnnnncagcagagccaccatcgtgttatcgaatagtgctaaggggatgtaccatctcaagcctttggacggtaatggtggcagagccgccatcatgttactgggtgttgctgagaggatgtatcaactttagcaattgaacgataatggcggcagagcagccatcatgttatcgtgtattgctgagaggatatcggaggatggtacttcaggtaccatgttcttctgcttatttcaactatagcagaaggataatttgcatatcaagagcaagatgatcagtagaaactgatttctcactggtttacctttttagctcgatagagtctcgtgctgataacgtgttgagaaaccagtttattctactgatcagcacacaagcagataaacacagagctgtggaacacagaaaatataagcgagtggaagctttatttcttctggatttgagtacaagctacaagaggagaagcaggagaccgaagatcggttgtccttgccttggaccttctgggccctatttataggcggaagaaggtagaagcttgcatcgtaagccttgaaccttctggcttgtgtcgaaagccacttacgccgtagctaacttcttcttgtagctggctttctctgtaagcttgcttgcgccgtaagctaacttcttctgtaagctagcttctggtgt

SEQ ID NO: 24179 - DNA, 1492 bp, Oryza sativa
  unsure (1)..(1492): unsure at all n locations
tttaaaattagcaacccttagttagctatactgtgattcctctcctgtcttgtgttgcagtgctcccataggtaattcatcgcatttacttccttgtttaatactttcccgttttatgtacatcgaattgtttcttcctgttttttcagatgccttttgatctgttctgtgatatatctcccacgagtaagaattggaagatctgtgcaacaatagcaaggaatgaatcttgtcaggttggaacgaggatcagacaatattcctcgagagattgcgagtgttgtgtcccaaaaattcactttctgcgtttctgtcaccgaaaggagcttgatgcagaggaacatcgcgtttcaagtcaatagcattgaaacttctttggcagacaaggcactattccacaggttagggatcagacattgcaactcacatcatctgtcatttcaccttttgctggtggttcaagtatatgtagagaaagtgagtgtcctgatcatacttcgacaccgcctgcttcttctaatacccctgtgggtgatatggagaaagcccatgctgatagcaggaaacgacgccccattatgcgccttgtatgttctgctcctaccttaggaaagacagaccatttgttttttttttgttattcggtcaaggttctgatttatacattattgtggcagcctctaggtgcatcgaagaagctaacttttgaggtgggcgcgtccgaaggaaaggatatagatacagctgttgtttcagaaaggtgattttgtatttctttgctgcattaatatatgtatgcagggcttatgtggtttatgtttttccgctatgcagtgcttccttacctgcacatgaaatatactatttatcgtcggctattgactaagcattgatagatataacaacttttgtgctgttattctcagggtgcagaattagcctccattgatgggaaaaaaaaggggtacagcattcttgatgccatgctttatagacttcttatctacgtattcttttcagtcacattaccgttagtgtgctttgctcaccgcatttattttttttatttcgtagcaccgtcaatcctgctggtgctcagaggacaagagcttcctatatgaaatagaagctacaatttcacgccatcggtcttcactggtctgtgctctcttgcatttccttagctatggtgttcaattgacagctttttattaaatatatgtaaccctacatctctctgtgtgttacaggcaatggacgcgtttgaatcaagtccttagttatgtgctctgctcttgttctgtgattcttgttcacgcgaaggtcagttttaaatatatttaagttcgaaagatttagctctaggtccatgattgaatggaactgattttaaattgagaatatgtgatggtatttcagtttagtttgggcagnnnnnnnnnnnnnnnnnnnnnnnnnnnnnnnnnnnnnnnnnnnnnnnnnnnnnnnnnnn

SEQ ID NO: 24180 - DNA, 1761 bp, Oryza sativa
cagtcacattaccgttagtgtgctttgctcaccgcatttattttttttatttcgtagcaccgtcaatcctgctggtgctcagaggacaagagcttcctatatgaaatagaagctacaatttcacgccatcggtcttcactggtctgtgctctcttgcatttccttagctatggtgttcaattgacagctttttattaaatatatgtaaccctacatctctctgtgtgttacaggcaatggacgcgtttgaatcaagtccttagttatgtgctctgctcttgttctgtgattcttgttcacgcgaaggtcagttttaaatatatttaagttcgaaagatttagctctaggtccatgattgaatggaactgattttaaattgagaatatgtgatggtatttcagtttagtttgggcagtccttggggcaaactgggagcctgtccaaaaaaaaaaataggaaatctttaggatggtcatctaattcagaacattaatgctagatgtttcagtaaccatgatatgtgggttagtaaatatgtgtgggttattaccgggtagtgcatttacccacattctgattcagagggacaaaatatattgccattgattatttattctgctgtgatgtaaaggaggatttaggttgcaattaataaaattgtactgctgcgtttgtacctaacaagtcacaactctttctggtaaacattttagcatgctgttttacatcttctagatttatttgtttttcagtgcaggtcactgactttacggtattggagttggagtagaagatcagctgctccatcatcgacgatggcctgatccacaaagatgaattttggtgctgatacttccagggacgtaaattattgttctatttcacacatgctggtggggtgcgatgtcatatgtgccaaatggacctgaaaatattgttagctagcctgagtaacaatttcgaatgtaggccgtgccttatacccttcagaatatataagcgctatgaagaaacaccattcgtgtgttcatataaatatgctatgcatagagatgatacgctaaaggataatcaaggattaatttcaatgctaaagtttgttttccagataaataacctcctaccttacagatcactgtagctcaaactacatgtccatgcaaactccaacattctttgcgcatggctcatgccctggttaaacctaaccatatcagcccttaaatcattggtaacctgccattccttcaaatacaaaccgaaagaaaataatacttcggcaacaaataaaaatggtattagccatatagcagcccttaaaacagagcctttttcaacaataagaagactgctgtataattttactcatcccctatttgacccattatacatcacaatatacaactcatgtttagtatctgaataaatccaccgaagaacaaagatcagtgctcattaccactacactataacaagcacctaacactctcctctgcaatctcagctctgttatctgtccctttgtttatcactgtgtacattgcaacttccctaccactgttaaatttgcacttataaatttcttttaactacctttttttttttgcagatacagccatgaatccacctaggtttttcacggttagactaaccacagcaaaccagcgctatgtggtaaccttaccaacagatataacatatacagtctagcttaatacacgccagtcttaatacatcatttcaattctgcagcgcagacc

SEQ ID NO: 24181 - DNA, 10261 bp, Oryza sativa
ccccagttcatagaagccactggtttgcagcttaaagaatatgtggttttcaaagtcttatcacgctccaagatgcatgtcatcatataagccaagagtggttatcttagatgtccagtgccaagcaaaccaagcaactcacagctaaagaaaaacgcgcttcagaaaccaaaaccaccaggtaaatgatcttcaacccactttccgtctcctatcaagacaacaaatcattttcatctatggcaccatatctgaaactattacattactgattccactctctacttttgatttccgttaatgcttgcaacgccaattcacctgcagaaaaaaagaaccaagactaagccacacatgcaacaccccatgcaacagaaattaaaagccgatatagggtcagcttgtacaggtacagatacttctctttctattttcagttccattgatttgcgtctcttttaatgtgcattgatgtattcattcactcctctttcgaaaggcaacaccaaacgcactatcaatgaaatgtgcttctgcaccggggagggacatcaatctatcaactgaactcaaagactacttcaaagatattgcgcaatttctgcacccctcaaacgaattctatgtcacaaccataaatccaactttcatgaagcaggataaggtggtaagataactgcaccactacccctttatatacctcttaccttaaaaactaacatatacttatcatgcagcacttttcaaagcaattctctatgacatacattgcactaatcgtgcggaagaagacatcgcagatcgaagtacggattccagggcactcctcaaccaccatggttcttcaccactccacagaaaagcgctttaacctgaaatcaggatggacccattttccaacaagcaacggcatacaagttggaacaatctgcatctttcacttccaccagactaatcagctgcaagcaacaatagatgtgctgtgagcaagatgctcatgcaacacaagctgttatccttttaatatcgtaggctatattttcactctgctacttctatagctgttagtatcattctttgtatgctttgcatgggtactcaatttccatgtaaaaatcacgcccaaactattatgccagcgtgctgttacagaacaggagctgacggtaccttacgtactgtctttggttgttttgcttgtacttatatgcaaccaaagacaattcaccctgtcctgtatgaacaaccatgctatcatattctgtttcacctttatctttatgtgtatgcagcaccctaaaaaattcttgcatagcgagcacactgtgtgaacaggcggcgcgcaaaggcgcgccccaatctctagtatattctaatggtttgtcctttgttcgttaacaatgtaaccttaacaaaattttagccatttattttttaaaaaaaatgtgcgattttattagaattggtttgaaattttttggcaatactactttttgttcctcctacaaactagatgaaaccgtcttattggtagtgtcaaattttttttgtatggttggattggaagatgaaccccaagccataaaaagaaaacccttaggcttagggtcctctgccgtattccaaattgtttctgagaagcacaattggacaatcacatactacctcactatctctatattttaatgtatgacactgttgactttttatccaacgtttgaccattcgtcttattcaaaaaatttatacaattatcatttattttattgtgacttgattcatcatcaaatgttctttaagcatgatataaatattttcatatttgaacgaaaattttgaataaaacaatggtccaacgttgatcgaaaagtcaacggcgttatacattaagatacggagggagtagcaactagattgtccacctctttataccataatagctagttgctcggttaccgttcaaaaagcataaagagttagacaattcagtgtgataccagattttctttgaccctatacaacttttggtagactcaaggaacggtaccaaagatggaggagttggggctataaataggtagtgttattgataaaccttgagatccatttgatacgatcacggttttgattggctcgatctttcagtgagttgagataactatgatttggaagagaagttgacggtcggactataaccgtacaggccattattgtgttgcaccttagcgatcgatatacctctccgtgggttgttgatcaaatcggtgcagatcaatcttatttttacaagtaaatcaaagaaataagcaagaacaagataaaagtaatctaaattgtgaaaaggaattaaatctcacaataagttggggttctaaagacgagtaattaggtggtctagccgacacatgtaactacaaggtaaagtagcaatggctaaaacattaatctaatgaaatctaaggaaccttgaagtggtacctagctatttaaagagatgggaggacgaccaagaggtccctaagaccgtgctccaccagattagggtgcaccccacatagaccctacttgggctggggttagttacaagtcgaggacccacatgtttggagaagaagaggaggcagacatgctagagtcgaggctagagctcaccaatggaactcaacatcgattttagtacttccagggccccacggggacccgcgggtggagatctcaacctgtccccatccccactgtaacgccctgaaaatcgccctaaatttaaatcgtgctttaatgtatttctagaaattttaaaagcctaaaagagcctccaacaattaaaactcaccaagatttatataaaattggcttgtggacatttttaataaattccccatgcttaaaaatatttaaccaatttttacttgaattttaaataattttagggcaacaaaaacaattaaagaattttataaaaaggaaaagctaaaagaaatcatcttcctcctgttgggctgcttccagcccatctctccctctcttggcccagcccggccacccctctcttctctcggaaaaagtacacccaaggtccctcaacttgtcgtcgggataaaaaaagtccttcaactacaaaactagatatacggggtcctttatctatacaaaaccggtcactagaatctttcggtggttttgactccggttttgatctacgtggtggctgagtcagcgtaggacccgcgtgagccccacatgtcaggtgtccacgtcaccctcactctttcccctcttcactcccttcctaatctctctctcacttctctgcaagctggccggggtgaggcgggagggcggcgccgcgacggccgccggcggagggggcgtgcgagcgctgcggcttctccgcctcctcgtcccgctcggccgacgtgggcgcgctcgtgtcgtcgcgcgcgccggcgaacgcgtcggcactggcagcggcgccggcgacgcgtacgcgcggtgggacgcggtggtggggtgccgggtgctcgcggagatgtaccggccgtggtctcctaacacggcggcgttgcagcacgtacgtggttggttggttcgttggcttcttctcggtttgttcgaggtcgcgagagggagaggaatcgatggagagagagaggcggcggcagaaaaggttggagaaggggaggcattggagaagtcaagaaacaagaacccaatcaccgttgagattgggttagttttccaccctcctctgcgccaatgcgtgtttcttggtattcttctctatattgttcgtttcttttttgtgtggatggaatcatggaaatggaaataaagatttgcatctttaccatctgcatgcgtggggcatttgttcgtttcttttttgtgtgcatggaatcatggaaatggaaataaagatttgcatctttaccatctgcatgcgtggggatccaggttgcagggtatcaggatatatagcatctggctagcgtcgattttctttttcttttgtgtgtcttgaaatgataagaatcgtagtactgatcatttctcccttcgtcggcaataataattcctctctttatcttggcgcaagaatctaatttgcagttgaagaacagacatggtttgagtagtaatatcctgtattatgaatctggctgcataacgcctcgtcactgcagcaatgccatcatcagccatggccgtcgacaccactgctcctgagtattggctgaactggaggttcatgctctgcgcggtctgggtctactcctgcatggtcctggcatgcttcttgatctggaagtacgagggaccgagctcgcaggatggcaatggcgatggcggcggggacagtgaggatgcgcggctgccctggtctgcatccggggtcttgtaccttgaagattgctggaagccatgccttgagcagatccaccctggcggccatctccatgtgcgacaccgctccagctcgcccctcgcccgccgcctccaccggcggccgtcgcggcgccgccctcccgcctcgccccggctagcttgtagagaagtgagagagagataaggaagggagagaagaggggaaagagagagggtgatgtggacacctgacatgtggggcccacgtgggtctcacatttactcagccaccacgtagactaaaaccggggtcaaaatcacaaaggatttggggtgatcggttttgtatagttaagggatcttgcatgtctgcttttgtggttcgagtacgattttatatcccgacgacaagttgagggaccttcggtgtactttttcctcctctctccccaccccctccctctccttgggccagcccagctcattccccctcccacagaccgaagtctgttttgccttctctgcgcgcccagtcagagacaggtgtgctccttctcgatgataggtgggtcccactcgtcatccctaacctccagccatcctctctctcttcgtccgaattccaagcgacggcaacctccgattcgcctcctccactcgccgtttcatcaaattaattgaggggaattaattcccacctcatcctctccaattcccccataatttcccactcgatccagcattattcgcggtggatttcgatgatgttctttaatggtgagctccaccatggccggcatcgatctccctccccggcgtctctctccctcccctccggcctataaaagggaccccgactccctcctctctccccacacaccgccgccctctccctcctctctccatagccgccgcgccgctctcttcttgtgccgccgccgttgcaactccggccgcccctcgctggtggttgggacctcgtcggagcccggagtcgccaccatccgcttcgccgcttcctcctcttccccgtccacccctccgtcgagcacgaagacggcgggaatgacaacgacccctccgtttcttcctcaccgccggcaacaccgtcaacctctcgctgccgcgtctgctcggtgagaaccgtcgtctcctcctctttccgtttttcccttcccgtgctctgtcgcaccgccgccacgccattggccgtcgccggcgagccgcctggctcggttgctgccgtgcctgtgcgtcggtgtgctcggctcacagtggaccgagcggctggcaagtgggacccgctcgtggacccagtccgcgtgcgctctctctcaataattcaagttttcctttagaaaaataattcacaaaattacaaatttccgtttaaacaacacctaaacttcaaatggccatatcttgaccgtttgaactcggtatcgatccgttcaaatctctaatttctccttaaaatgagtagaacccatttatgtgctttattgcttctgttcatatggattttattagcctttttgtatttcttcgcaatggtcgtgtagatcgtgccgttccggaagatcagctcttcatcgtcattgacattgaagactttgtgagcgatcaaggcaagtcatatctaccttaaacatgttgaatcccatattgtgaaaattatgttgttttacttatattgcattgctttataaattataccgttcattattaatattgttttattatttattcctatgctcttggttatggccattatgttgatttgatatccataatctttgtgaaccctagtaaaattataacttgactagtctagtaccctacatgatggactgactagttgctttaggtaaatgcatagtcctgcttagttccaacctagaacttttggataaactagactatggtggttaacaactaaaacttgattagttatggactattgactggtttgtcaatggatgggtgataaaatgctttgtgcaactaaaatatatttttgggctgggctcagggtgcaagctagttactttggtagtcgcaccccggctaatataaggaccggtctttgtgcaaccacaagtctagtgggtaaggcccgactgaaagtttagatcttctcaaaacaaagaccattggttggaagggtgtggggccaggattaatgccgtttcttttacccggcgcaaggggagcctgtctcgtccagggggatccggcaacctttaccttgtcggggaccggcgggcggtgaaacctcagcgggttctcctgttttgggtagacctagatggatagtcttgtcacgacctctatccgagtaccgtggtggtacccggcgcgtggcaacatgtgttgacgttgtgtcttctgggtaaagttgtacacctctgatgagaattaaaaactatttgaatagtcgcgccctcggttatatgcaagctgagcaatgtacccaaagttagttttgttttataaaaccttgggagggtgaaatcatgatggtgtagtcatgtggagattagcctgggctaaggcaggttcgcaggctcatgcgaccttggtgatattaaaatattggcttagaacaggatcgtgttttaaaatgagctttaacctgattaaaatgtttaaactatgactttaggcaaaataaatcctattaggccatttccatgttttccctatgcattattgttgcatttccggtgtgacttgctgagtatggtggtggtactcactcttgctcacaaaaataatccagaggatggacctgaagaagatgaaggcttggatctctaatttactccaccgtcgagtgcctgtggctgctgttgttccgtagtcttccgctgttttatttgtttatctttgagtgtgagggcctagagtcgcccatgtaataaagttcttcctttacgtttccgctagtgtggcttgtaataatcaacaatgtctatgtgtacctcgcctcctgggacgaggattaatgcactgagcgtttggcaatggtgtatatttccgggcgtgacaagttggtatcagagccaccttgaccgtaggacgagccagtggtctaagccttaggatgatattttttttagaaactagttctttaattgtgaaaaccttcgttattctatcttcacctgtccactctttacaaaactggtcattgactcttatttcaaaatgttgtagatgcctgagttcgagactacccgctgcttcaacttggccggttttgtggagcaacttcgtgccttggccgctgaagtcggatactgtatcactatggagtaccgcgtggttctcaacttcgaagacgagggtgtacttgaaccactttggagtgccaaggtgatgatcatctccaaccggatgatgctagaaagttgctggttcacaggagaaggtgacagccgtgaatctgcctgccaagaagctgcattccatgccattggggccctttgccagagtcactccgaccagttgaagaccactctgttccactaccaccctgctcgcttgggtttcgcagaagatgctgacttccgcgatgcccgcaatgaaggggacaccaccattgtgcacatgtccaagatgatggccgcgatggacaagtaccgtatggtctactacaggatgacggagaggatgttcgaggcagtgcttcagaagaatcgtgacaaggagaatgagcttcgcgctctacgcaaggagctgaaggacttgaagagtgggatgcctggaaccgtcgtcaagaccctaccacctgttggatcaagcgcctgtcctcgccacggcatcagcaacgtggatgagccatttgtggaccgtagcccctctaggagtcgttctcaagagtagacgcgaagtcttagtgcgcgtatgtttttatcgtttatcttctgctggagtttgttgccttgtgtgctttttggtatggactatatcggcccgttgtgatatagctatacctttgtggtgcttaagcaacttgaactctatgtaaccaacatcacattaataaaatttaaataagttggtttaatagctcgtgttcttgtcctgatctctcccttcttcttttccctcttatcttggttactacagatggtgaacacaaggagtactgctgctaacaatgctcgtgctaggaattcagctcagaatcagaatcagaaccagaaccagaattaggaccaaggccacgcccctccaccaccaccgccgccacctccgccaatccatgatcaccccaacttagcacaagtgctcgccaaccaaaaccaattcatcgcagctttgctccaccaaatgcaaaacccgcaagcacccgctgctcaagctcacgtacacgctccaccgcagtcaaagctgtcggaattcctccgagtccgacctcctagtttttcaagcacaaccaaccctgtcgaagcaaatgactggttgcacgcggtcaataagaagttggacctcatccagtgtactgatgaggagaaagtcgctttcgccgctcaccaactgcatggacctgcttccgagtggtgggaccacttccaggccacccagccagttggacaagttattacttgggctcgtttctctactgcttttcgtagagctcacgtacctgttggagttgtagcacagaaaaagaaagaatttcgtgaactcaagcaagatggcaggaccgtaactgaatttttgcacgacttcaacatgttggctcgatatgctcctgaggacgttcgcaccaatgaagagtagcaggagaaatttcttgaagggttgaatgacgagttgttagtccagctcatctctggtgactgcgaagatttccaaatgctagtcgacaaggcgatccgccaggaggacaagcaccgaaagattgaaagcaagaagcgtaagttggccaatgctaggatgtttcaaggaccaagtcagaaaccacgttatgcgtttccccctcaagttggttcttcatcggtagcacagcgtgcaccccgtccacagatgaacaacaagctgcagaactcaggatggaacaacaatcagcgttctgcccctgcccaggttggatcgacacgcagagatagctctgggaagatacttgtgtgctacaacagctatgagcctggacacttcgccgacaagtgcccaaagccaaagcgtccgcaagctcctgcatctgcatgcaatgccaactagaacaacaatggcaactgcaacaacaacaacctggtgaggggacgtgtgaatcatgtctcggctgaggaggcacaggctgcgccagaagtcatacttggtacgttcctgattaattctgttcatgcatgtgtactttttaattcaggagctacgcattcctttatatcaagagattttgtggcaaaacaccaaataagggtagaagatcttagcaaacctatgatagtatcaaccccaggaagccaactacctgctaagctctttagcccattggtaaccattgagatccaaggagtcacttttctggctaatctcatccttctaagctctaagaatctggatgtcattcttggcatgaactggttgaccaagcacagtggtattatagattgtgccagctgatccacatctatgactaggggtactggccagcgagtcactttccatgccaagcctgtatttccttgtaagcaagttctgaaccacgtcagtatggatgaaatacccattgatgaggacataactagctcggatataaccatgactaccttatgtattaatcaaataaaggtgcttatgttctatattagatttacttgttatatatttcaacaaacgttgcgacacaatgagttttgtgtgtttttgtttgcagaggtacttg

SEQ ID NO: 24182 - DNA, 1594 bp, Oryza sativa
gacataactagctcggatataaccatgactaccttatgtattaatcaaataaaggtgcttatgttctatattagatttacttgttatatatttcaacaaacgttgcgacacaatgagttttgtgtgtttttgtttgcagaggtacttgcttgggcgaaagaaaagagaccgagcgtaaggaatacatggatgattgaagaagttgattggggaccaaaccaagaccttctttaagtcttctttcatatcaccacgtcacttttggtccatagaagacaagagataaagttctacacgttttggattcggattcgggcctcctgacagcatcaacttcaaacggacctactcactgatctagaaggaatttcggggcccataagtacttcttggaaagcttatgaagtctactttcagatggttttggtcccacgtcaaaactcctaccgagttgccgggaatctgcaaaacaagccacgcacctcatccagtccgaatctgattttgagttttgggccttgtaattgtgtcgtgggcttaggccaaaggggtgtgctccctagggcaaccctaggacgtctctaatcacatttattcagtagccatcatcgtcttagattattctgttgagaacagtttcgccgctagatcggtttgtggaatctcaaattcgtgtgcttaatcattcatatgcaatttggttgcaatctatcttgttcttgcttgtgttcttcgattcgcatgtaaggattagccttctcggcgaggtcaaccgggtttcggcacggttgataaccagaggagacgtggtgctgcgattttggggctcagtagcgtgttcgttcagaagccggatcgagttgtgtcgcgactccgcccaaatcgactgtttgtcaatatctatcggaagatcgggacctacatccctcatcagttggtatcatagcgcggttgcccattaggtaatttatcttcccataatcagaaaattgccacataaaaatatttattctttacctagacaatttgagccgttgcattgttctattagattttgctttgttgaattctagattgcatcgtcatgttgagtgctggtttagttttagatttaatttttagttttgagtattgcatctgttcatcactttgggtctaggatttatcacgtgtgagttgtacgtcaattttaggtccagttttgcatcttgtcggttcttgccgggaccttgaaaaattgaatcgtttcgtcgtcgggtttccgtttttgtattttggagaaatttttatccaacggtttgggagttactcgatttctagagctcctgtaccactgtgcgcgcgcgtgaggggagtactgtgcgcctgaggggagggatcagatcagatctatctgtgactatctatatttttctctgtctagaattgttaagtagtggatttgagatatttttataaaaacggaacctacatgatgtgagcattccatttttaagatgatctaattttagttttgcattttacatttgagtccctgtaatattgatatttatattttgagtccatgttcgaggtcagtggtcggttcttgttg

SEQ ID NO: 24183 - DNA, 2338 bp, Oryza sativa
  unsure (1)..(2338): unsure at all n locations
gtgcaaagaaaaaaaagaaagaaaaagccgcacaaaaaaaagaaaaaaaaggcagaaaggtgcttaaaaaagccacaccaagaaagaaaaaccattcatccttggagtatgttttcagagtgcagagttgtgcattgattcatatctagtccttagtgttgtcgggtgcttgcttgagctagagttgagtctagactaggccagcacattgactaatactttgaactattattcaactttgcattttctgattagtacaattacgttcctttgctactatatattgtgcctcccaagctccatatatattcttctgaaactgatgaggaatgtaggtcccgatcttccgataggtattgacaaacagtcgatttgggcggagtcgcgatacaactcgatccggcttctgaacgaacacgctactgagccctggtatctttcaaagatagtatctttcctggtatctctgaaaatctcatcgattctatttttcgtcctttcaatactatctttgaaattttcctcgattccattcttcatcctttcaagattatcttcgaaaatttcaataaaactcatgggtaccaatttcattttccgaccattatgtctaaatgtgtatgtattagcaacaaaattatgcgatccattattatcatatacccatggttgaccaaacaacaaagaacatgcttgcatagggacaagatcaaaattggcagtatcatggtaatttctaatcgaaaagtttagcttcacaattctatttaccttaaacttaccacaagagttgaaccatttgatgtaatatggatgaggatgcggttgtgtaggcaactcaagtttctcaaccaaatctgaactcaccatgttattgcaactctcactatcgattatagtacgacatgctctatccttaaccataaactttgtttcaaataattcgtggtactgccattgctctgctttctccatttgagagcttagcacttgttacaccaaagtactgtcattacgtgcatcttgttggtatcgctgatttcgagtgccactcatacctgtcattgcaaacacaaaaaaaacaaacaatgaaggttatccctaataatctgctacgcggtgtagtggtgcccctcaacaactcagcccaatggagcatcttaccaagctcttacaagtgtcttaccagcaatgctaaggacggtccaaccggtggctggttcgtgacaccttgaaggacgtgatgtggcgattgcaaggatcaaagcggtgctgaccagaagtatatgaaccctagtgcatggtcctgttacaacttaatccggcttctgaacgaacacgctactgagccccgcaatcgcagcaccacgtccctctggttatcaaccgtgtcgaaacctggttgacctcgccgagaaggctaatccctgcatgtgaatcgaagaacacaagcaagaacaagatagattgcaagcaaattgcatatgaatgattaagcacacgaatttagggttccacaaaccgatctagcagcgaaactgttctcaacagaataatctaagcaaaacccgactctaaacgatgacggctattgaataaaagtgattggggacatcctagggttgccctagggcgcacacccctttgggctaagcccacgacacaattacaaggcccaaaactcaaaatcagattcggactggatgaggtgacgtcatctaaccgttactcacaatttgaactggaaactagacaggaagttccagacctagaagacaggaacttctagactacacttaggaaaatctttttcaccaaactggaacttccggacctagaagacaggaagttccggacttgcatttttggacagatggagtatttgtaaaaataactcctagggaaacttgacacttggttcacactaagagtacttgacatatctcagagcatcacctggagcccctcttaatagtacggtttttcctaaaaactcgattgcaataaataaactatcccatgcacttctcgagttccggtccgctttgattttatacttttgggggggtctccaagcatccatcttccacaccttgggctaatgcacctgaaagtaactcaatgaactcattagtcccttaaccacatttgtcattaatcaccaaaacccactagggggatcaatgcactttcaatggttatatccgagctagttatgtcctcatcacccatcgtgaaagagtatctagatgtttttccggaggaactaccaggcatgccgcccaagagggacatcgagtnnnnnnnnnnnnnnnnnnnnnnnnnnnnnnnnnnnnnn

SEQ ID NO: 24184 - DNA, 721 bp, Oryza sativa
cactaagatacttgacatatctcagagcatcacctggagcccctcttaatagtacggtttttcctaaaaactcgattgcaataaataaactatcccatgcacttctcgagttccggtccgctttgattttatacttttgggggggtctccaagcatccatcttccacaccttgggctaatgcacctgaaagtaactcaatgaactcattagtcccttaaccacatttgtcattaatcaccaaaacccactagggggatcaatgcactttcaatggttatatccgagctagttatgtcctcatcacccatcgtgaaagagtatctagatgtttttccggaggaactaccaggcatgccgcccaagagggacatcgagtttcgaatgacttagtgcccgagacagcgccaatctccaagagaccgtaccacatggctgccaaagagctagctgaagttaaaaagcagttggaagaactcaaagaaaaaggccacatccgaccaagcacttcaccctggggagctccagttatcttcgtggaaaagaaggacaaaactaagagaatgtgtgtggattaccgtgcactcaacgaggtcaccatcaagaataaatatcctcttccgaggatagatgacctctttgatcaattgaaaggagcaaccgtgttctcgaagattgatcttcgatccggctaccatcagctaaggatccgagaggaagaca

SEQ ID NO: 24185 - DNA, 898 bp, Oryza sativa
ttcaacacgatggccagcactgcgatgtcgatttcattgtcgatgagtttgtttggttcaacacacaacactgtccagcctgctcttggctaccaatacatgggtgcaagtggtgcaaagttacaaattagtttgcggtttgcccgtgcactgtacggattttcgattgtacagatgaatttatcggtctttgttgtcttgttcttttggatggcagtttggtacgagttatctcattaagttctatcgttaactaaaatctgatgagttccattattcccgttcattaattgtatatgatgatgatgatgtattctgcttcacaggagatcacatcagcccttgtagcagatggtgtatcaccagataaaatcttgaccaactattagcaaggattggcgagcctcctgtaaagctcagtgcttcctttggcctcaagatgttcttttttctgttgtattttagctgttctcgtcctatagttttttatatttctcagcacatagatatgtatacattataatcattcttcagagtatggccaccttttcaggccatgtaagcattgagctccaggcttatttgcagttatgcggtcccttgcggaacttgcaaatagcagagtaacatttggcaactcttcggctcttgtattattggcaagagaacatggtggtgtttggttcaataatgttaacgtaaacgtaattgggaatgcttccgccggtaaccgattacgtgctttgtctggatagttgctgtaacggataccaattcattcgcgctgtttggttaggcagccaggtaacagactaacaggtgcaagcaaaacatgtgtcggttgagaaatcaaattctgaaactgatacacaacgagaaaatacataatatggagact

SEQ ID NO: 24186 - DNA, 419 bp, Oryza sativa
  unsure (1)..(419): unsure at all n locations
nnnnnnnnnnnnnnnnnnnnnnnnnnnnnnnnnnnnaataggttcacaccacccagtgacattcgaaaataaatgcacagttaaaataaatagagaatttaaatataggatcaacatgctcaaatgattgtgtttaggatctgtgtgacttgccttgcaataatcggtctcaattaatcttctgaacactcccgacgcactcacgaaccttcgcaatgacggaaacgacaagctaacacgcaaaacgaggaaaaagactaataaaaaccaaataaacagtacaaagatcatgattttagatgaatttagcaacttgaaccactcaaaaccgagttacgatgatttagttatgannnnnnnnnnnnnnnnnnnnnnnnnnnnnnnnnnnnnnnnnnnnnnnnnnnnnnnnnnnnnnnnnn

SEQ ID NO: 24187 - DNA, 1199 bp, Oryza sativa
ataaatatcctcttccgaggatagatgacctctttgatcaattgaaaggagcaaccgtgttctcgaagattgatcttcgatccggctaccatcagctaaggatccgagaggaagacatccctaaaacggcattcacgaccagatatgggttatatgaatgcaaggttatgtcgttcggactgacgaatgcaccagtcttctttatgaatctgatgaataaagtgttcatggaatatttagacaggtttgtcatggtcttcatcgatgacatcttgatctattccaagacagcagaagagcatgagcaacaccttcgcctagcgctagagaagcttagagaacatcaattgtatgcaagttcaataaatgtgaattttggctttcagaagtgaaatttcttggacacgtaatttcagctcaaggagtggcagtggatccaactaacgtcgaattagtgaccaattggaatcaacccaaatcagtgacccaagttcgcagtttccttggacttgcaggctattatcgcaggttcatcgaaaacttctcaagaataacaaggccaatgactcagctactaaagaaagaagtgaaattcatatagacctcgcagtgtgaagaggcatttcaattgctcaaaaagaagctagtatctgccccagtgctggtattgcgaaatatccacaaggatttccaggtgtattgtgatgcctctaaacaaggactagggtgtgtcttaatgcaagacggacaagtggtagcctatgcttcccgccaacttcatcctcatgagagtaactacccaacgcacgacttggaactagctgccgtggtgcatgctttaaagatctggcggcactatcttatcggtaaccgttgtgagatatatacgggccataaaagtttgaagtatatattcactcaaccagatctaaatctccgtcagagaagatggttagagctcattaaagactacgatgtgggaatccactatcatccggggaaagttaacgttgtggttgatgctttgagtcggaagagttactgcaatgctatcatctatgaacagtgtcctcctggattgtgctgagagcttgaggccttgaatttgggaatagttagttatggctaaatagtgaccttaggggcgaaacctctactcctttaccaaattcgagaagcccaaaaaggtgattatggta

SEQ ID NO: 24188 - DNA, 2163 bp, Oryza sativa
tccaagtgcgagtagtgcaattgccattgtcatcttcaattaacacctttaagcctgcgcgagaagtgactccggaaagagcaacgtataactggccatgacaaaaaacagggtttttcaagtaaataccaactgaacgtaacctttgtccttgacttttatttatagtcatagcgtagcagacacggacagggaactgccgacgttctaatgtgaagggccattttttgctggtcgcagataaggttattcttgggatataaacagtttcccccgcattagaaccagttataatacgcgcttcgatcaccctatcacccaagtttgtaacaatcatccttgtcccattgcaaagcccagcggtctgatctaaatttctcaaaagcattatgggaacacctatttttaggcacaattgatgttcaggataattgttaactttgatgctattcaaaaattcaattgggtataaaacatctaaatcatcagacttttcatttgtttttgcaagacgatcaaagctcaagtactctcttgcttcaccaggaaaaagttgtaaaacccaagagttaatagcagcacacacatcattcgtaggagaaacaatagcacggtcttgcagatatactggatcattgtactgttcagcaaagttggtgtaaactgcagctacaatagctccaatcttttcatcattattcatgaccaaaagatcatgagggatttcaatccaagttggttcaacatcgctgccgtaactacacgctgctgctgtgccatcaccgatagaaaggatccaatcactgaattcagcgacttcgcgttgcatatcagaatctagagaggaacaacgtaaacgcatgttgatcgatagctctaaaacacatacatatgaccaaagaggagattttgatattgtagcatcaattgttttcgatctaacgcctccttcaacaacaggcaagatctggcgaaaatccccacccagcacaactaccataccaccaaaaggaattgatgcagctgaatgatcatcttcagaaagaatatcacgcaatgttctatctaaagcctcaaaacatcgccggtgcgtcattagagcctcatcccatataataagagaagtggatttaataaggtctgctaacattgtaccacgctttatatggcaaattgttgtttcatcaatttctatcgggattttgaatcgtgaatgagcagtcctaccacccggcaaaagcaaagaggcaactccagatgatgcaacagcaagaacaagctttttttcagacctaaggtaggtaacaatacaattccagagaaatgttttcccagtaccaccaaagccagacacaaagtagaaagcaggtgattttgtcatgacactctgcacaatgcgttcatatgcatttcgctggtcagtattaagcttgctacataataacggagcattagcacacaaatcatctatatcataagacatttcatcatcgatcaatctatttgctgatccaaaggaaccatcgcaattcacagtaggtaaattaaaagatgacatagcaacaccattgcgaagaaaagcatgtgtaattcttgcagaaccatatttctaagttcattatcagggacagaatatgcagcattatttaagctttgttgcaaatcaaagagaatatcatcagacatcgcatgccaatgtttattgaaaaatgcagctccatcagcaataccacaatgaacaaccatgagcacaaagagcgatctgagttgcggcccggtcccccagctcacagcctcatcaaatgcaaatgaccactctctgtcatcaccaagcaaccctctagcagcacaagcctccttaaatgtatcgtatacgacatcattgtatgttctaatatctgcatagctcctagcgcctctcacatacataagcagcattctcatgaaatacccttcacctgcagaaggatggacatagtacattcgaccgattttataaccatgccggctttctttccagctccttgaattttcttcccaagtaaatcgagtaggatactcgcagtatgttaagtcacgtccttttgggaacaaatcattagcaacaaaccattcagttaatgttgttttttttgtaagaatgcatttgaaaccaccgatgcc

SEQ ID NO: 24189 - DNA, 695 bp, Oryza sativa
  unsure (1)..(695): unsure at all n locations
tcccccatatgtttcaaagaagtgacgaggtcgaacgtgtttccctcgtcgcaattactttttagttttcgagctcgaatttgggtatatgctttcgagcttctttttatgtcgtgttttcgagctaaggtaaaaccttgttcgaaaaccgccgtcccccttacgtttcaaaggagtgacgaggtcgaacgtgtttccctcgtcgcaattactttttagttttcgagctcgaatttgggtaaatgcttttgagcttttttttatgtcatgttttcgagctaaggcaaaaccttgttcgaaaaccgccgtcccccttacgtttcaaaggagtgacgaggtcgaacatgtttccctcgtcgcaattactttttagttttcgagctcgaatttgggtaaatgctttcgagcttctttttatgtcgtgttttcgagctaaggcaaaaccttgttcgaaaaccgccgtcccccttacgtttcaaaggagtgacgaggtcgaacgtgtttccctcatcgcaactactttttagttttcgagctcgaatttgggtaaatgctttcgagcttctttttatgtcgtgttttcgagctaaggcaaaaccttgttcgaaaaccgccgtcccccttacgtttcaaaggagnnnnnnnnnnnnnnnnnnnnnnnnnnnnnnnnnnnnnnnnnnnnnnnnnnnnnnnnn

SEQ ID NO: 24190 - DNA, 744 bp, Oryza sativa
  unsure (1)..(744): unsure at all n locations
nnnnnnnnnnnnnnnnnnnnnnnnnnnnnnnnnnnnnnnnnnnnnnnnnnnnnnnctcgtgagggtgtggtgtgtatttgggagaagattgcgaaggttgacaccttacctcaagaagagaaaaggtaaatagtggaaatcgagcttcgccttgtcgaacgaaagttgtgtgacattcgagcttggaccggtgggggtcgcttggagcatgagcttgctcttggtggttgctttaagagaccaatgcatgattggttgcagttggttaagagagacttggcctttcggggccctcaacggagacgtaggatcgactgacttgaactgcaatgtctcctatctctcattactctgcacttaccgctttcttgttgagctatttggtgatcatattggtgcatgcttatctcttggtgatgcctcttggtcttgctcatatctagtgtgcaaagtgctccatctccctactgttttcactctctttattaagacaaggttgtccactcttagttggattgtacgggtctatattgtgcataggcgaattcctatattctctgtgtttggtagcactgtctagttgtgattagattttctgacactgtgtattgttagattatccgcaatgatacctgattaaccgggcaatactaattttcgctgcagtgtttgtaattgcaggaaacacctattcatctccatctaggcgagatctatgatccttaaaatatgctcccctttcaa

SEQ ID NO: 24191 - DNA, 1149 bp, Oryza sativa
tgaattttcttcccaagtaaatcgagtaggatactcgcagtatgttaagtcacgtccttttgggaacaaatcattagcaacaaaccattcagttaatgttgttttttttgtaagaatgcatttgaaaccaccgatgccaggtttgcgtctgatctaaagctaaccgtgttcatgtttggtaaatggcatgctaaacgctcaacaggagggttcctaaagtgaataacatactcaaacaatctccaaatacattggttggcacataaatatcgacactcaatgaagtcagctatttcatctatcggtgctggcacagtaaaatcagaaccacgcatcttttttctagaacctgatgaaccagtatcatcaatcgcaacgactcagctttctttttttgatcctagaaaattttatattggcatgatcgggtccttttgttacatacttaaatagatacttgatcatctttgatttggtgcaccattcaacatttatatgagcctcaaatttacgcagcaatgacacattgtatggcacgaccgaacgattatcaagcttgataccatttttaagcacatgcgaaccattgtcacgccgcctataaacaacaaatcccttgtcatctactgttgtttcagagttaaaatcctttgggtattttttagaacaggatccatttctcatgcaagggcattttctattgctatcaccgcatgggccatgcatcataaattctttgaccaacaaataatcaagttcgttttcgttaggatcagggagttcagcactgatgtatgtgtcgacgatagatggtgttgcatcggtgcttggcgcatcacgccacaccagtatatggacgtgcgggaggcctctcttctgaaactccacgctgtaaagcactacaccatatggtaggaaaaccaaccgaacaaaattaataacacaacaaaaaatgcaaaccaaagaaatagcaaaaaagggaactaaccagcacgcacacgcccaaagggaacaccagacataatgtcagaaaccatttcatcaagtttcattttaaaaaccctggcctggttcgaactgcaacgcatcttcaatttcttgccactttggattgcaggtaaaagttgtaaaaatatcaggtgcgccata

SEQ ID NO: 24192 - DNA, 1466 bp, Oryza sativa
  unsure (1)..(1466): unsure at all n locations
gtacatgtatcgcctaccaccagtgaagcttgcaggaagtattcgttgcttacctacgctcgcaccatctaaggaacccttagcaactgcatctgtaattccttgcatgtgttcgcatctaagttcacgttgctggtcagctatgaatgttaatctaccctcttcaacacaagcataaccatctacttggccttgagaggataaacgaccgcaacataaataaggattaaattgatctcgacgataatggcagcagtaacagtaatgctcttgcatagaagcctttgttcgtatatcggtacgattcaagtctacccctcttaaatttataaccaagctgaaagccacgctcaccataaggaaacagaagtggatactgcaaggccatataagcaggatgtaagctagaaacatggagtgggccaggaatgctttggacaattatatcgcgctttgcattctccaacgaaaaatcacctacaattaacccagcaagttcatcggctgttggcaattcgtactgaacaggcccattctcatctgaaccgactattctaattgcgaactgctcatcaccattatcagctaaacgatctctagcaatcctgaattgcttaaccaaaggattacaattgtccagcatatctagcaattcagcagcaatctgaggatctaaatcacagtcttcgacttcttcattaagaagagcacgcatcctattctcgatctcgttttgagtgtcataataaatatatagttgagcaaactttagtggggtttcttcgctaggtaaaagtgagcctatacgatgatgtacttgaccatttattttaaagacataaggaccgccaccgcgatttaagctatcgtcaatatttgcacccattgaagtgaaagcaaacagcgaattgtactgccttatgtgctgcaaacaatgcctgcttcgagcatccccatcgaacttcaaaagcgaatttaaaggttctggtggttgtgcaaatggaggaacaaaaattttgccgcctttgcaacaaagactataagacatacggcgctgagttatagctgaatctctcttgcatcgttcttggtaccagaactgagcaccacacatgcggcactgagttatatccttcgacgtctctatatgcacatgcaggtcaaaaacatatctatatttagatataatgtcggtgcacgataaactaaggcatggaaaggggtaaaataaagtggaaataactttttaaaaatttgccgtaatcactatcaaacctattggaagacagggacgatatacgagaaagccttttacctacaggaaaaatcaacagacaacctgcaaataagagaggctgacagggacatatgaagggaagtaaaaaaaataccaagcataaagannnnnnnnnnnnnnnnnnnnnnnnnnnnnnnnnnnnnnnnnnnnnnnnnnnnnnnnnnnnnnn

SEQ ID NO: 24193 - DNA, 10125 bp, Oryza sativa
caacaaagactataagacatacggcgctgagttatagctgaatctctcttgcatcgttcttggtaccagaactgagcaccacacatgcggcactgagttatatccttcgacgtctctatatgcacatgcaggtcaaaaacatatctatatttagatataatgtcggtgcacgataaactaaggcatggaaaggggtaaaataaagtggaaataactttttaaaaatttgccgtaatcactatcaaacctattggaagacagggacgatatacgagaaagccttttacctacaggaaaaatcaacagacaacctgcaaataagagaggctgacagggacatatgaagggaagtaaaaaaaataccaagcataaagacctgcagccaccagtcgtttgagagccaatttttttgatcgtatctgtcgtctcttcgaagagtaccaagcaggataaatagggaaaaacccatcatctagtggagggggggaaatcacataaacaaacagaggggtgagcagcgatggggcacaacagcagcacaataggaacaaacaacgcacatacttttacgctgcgtagcaactgtttcccaggcatattcaccaccagccgaaacaggagagcacgctaaacaggaaacaaacaatttaacgatgacacacaacaagctgtggcagatcacaaaccagctacaaaggaacaaatgatgataaagcatacatctaagagaagcactatggcgttctagcaatcggcggtcccgtcgacgaagaggtgcaatcacatgacccccctccatagagcgactaaacgcaaagagagtaacaatgcaacgaatattaaaacaacacatagccaacaaaataaacataatggatgaacaattgattaacacacaaaataacagagagtaatgtatatacctccgttgatcaaataggatagcagagagtaatgtatatacaaaagaatgctgggagatataattaatatgctaataatcagacattttcaaggctagctttttacctgtactcttgccacgtgaacttgctgtgcaagctggcttagcctaatcctacttgacttcaactgttgaatgtaagcctgaacaataaagcagtgtatatatatactcatcaatacaaatagtatataaagccacattaaattttagcagaacttatcaacttgtgctcgtatgtgtccataaaacaaacatatgaaatgaaataatatataattcatgtttcaaatagccagcaccctaataatataagactcaccgcataatacataagacccatgtttcaaatagccagtaccatcataagataagactcatgtttcaaatagccaggaccatcataatatataattcacacctgagaccataaagaaattggaaatgcacatatgaaaagtgataatgtttcttgcattggtaggccggtcaaattcacaataaagccagtaaaaataactatgtccttcagcacataagtcccaaagaaagagccaaaaacaaccgcatcacaaagtcggtcagcacatttaatcgcgagctagcactccatgcatgcatgtagcaaaacaaataaagttgataacaaaagcacatatgacagcacttgcgtgaacaacatgtacatgtcatatacactaacattattgttaggatatatgtttgtacttttcgtaaagtattgtacgtttctgcaagcacatatatatacaaaaacacacacacacagtacatgcaggagagattcctttctgctagcttgaattaataagctgttgagtttcttggttgaccgactaaccttcttactaaggctacttttccttggtgcctctctattctgtgcaagcctcctcagtgtctgcagaatgtgcatatatatacacacacatattcacacaatcaagctgtcagtctcaaaaaaaaagtcataaaatatgcaggttatttcctgcagacagggatcgttcaacctcctaattacttttttatgcacttttgtgtgctgttgaagtgctgcggagggagatcatcaaatgtatcaaaggtatggctggatggatgattgactcactaaccttagggtctagtgtcctccttccttctctttctagatcattagatgttgctgcacccttcccactgttgcttccttccttctgcaaggcacattttttttggccccttcagaagacacacagaggaaaaaatatatatacatatatacagcatatatagccggatttctatccactgtctaaaaaatataatatgagagagagagagagagagagagatgaataccttaatgaggctattattcttgttatccttgacagagttaggcaagggaacaatcgatcaaataggatccgccatacaacctgcaggcaatataaacgtgatctagatgctatagcatatagaacaaaaaagcacaccaaattgtagcgcacaggtaagcaaaaaagacaacaaagatgctggctcgaagaagataaatgggaaaggacctaacccgaacaacacacaatgacaaggatcgaacagaggttcttcaattactttgatagctcaaacaaagactctaccataggtagaacacaaattccctagctcaagaaaagctaaactgttattgtgtcctattttgcagcatatgcatcttggtaacctagcagtgcactcaactaaattctgttgggcctaatgtatgtgatacttataggcatcaacacaatgcactgaatttagtatgcaagtgaattatgatgaattttgtgcatataatctccagtaaaaaggactccaggatacacctaacatatactgcctcagaaagagcccgccgatcttcatgtaacacaagtttcttgaaatctccccatcgggaacacttgccttcaacaaaggctttgatctacctatctagatatttgctttaatctggaagcagtgtgccaaacaaatagtggaacccttacgcaaaggtgccatagcctttaaattgtaaactacattgactgtatagatgatgttacaaggcataaactttatattttcactgcactatatagaacaaccaaatccatacaagctgtagaaaatccaggccatgaattactgtatggtggaaggatatgggctgaataaaggtaattagccagagaatcacatgcaaaaaggaacagaacacatttaatttgtctaggacagtaaactatacgaaggattgaattagacagtttcatttatataaactcgcatgtaacaggaataagggccaccataaatcaactcaagtggtggttttcaacatgaaacagtgggagaattaactatcaaatctgtagttcagtgacctaatgatcaggaatacccacctcttgatgcatgaaaagcccaatagtacaaccttatacttccctttggcttcttgcatttaccatcctgctgtaatgatagaaggggaaacattcagaacaacagtaaagcatatataccgtctttcatagtagtcatcatgtaacaatctacctctaataaatcaatttcctggtgaatacattcagataacaagtgcatcccctaaatcaaaagaaggattggaggataagatagttaagcaaaacaaatctgcaatcacaaggatttttttcacacctacataactattctaatctaatagttaattaaaataaataagcaagctgatgaggaaaccaagataattaactgtagaattcccagaggataatctagcatgttatggcaactctatgctgtacatgtgaccacactgaagcactacatgcactgatgatcttgcataatgcagtatcattttattaagtatgcacctgccctcagcgacctgatcactaacccaaaaaaataaaaagtaaggtggtaacaatattcaatatatcactgcttatttttcttgtcaaatatctgataactgctcagtaacatgacataggaatagctcaaatgttttagtgatcatattcctcatgcagagcgcccaaaatagatattttgagctgtgtactgaccctgaagctatataatctgcagatataactgtgcctcaatgccacttgttgcaactaaatgggcacccacatgattggaagtaatcagtgcctatcaacaaagataatgcaggtatgaggtgaatttacagttgtggttggcgagggcacccattgcggaagacaaagggaaaaaaattagactatctagggtagcaaaaatctagctaatgagaatctgattttcctaacctctgacttttaatttattttattgatttaacaactacaacttcttgaaatctgaataaaaaaactaaattatttaagagaacttcaaattctaggaaaagttgtagctgacaaaaatttccccaagcatgacaacctcatgaatctactccaaaatctctatgtagaattgtcatttaatatcagaagtttcaaaatagaaaataatatgtaatcttatgtttcaaagtgatctatagaatattcttttctaatgggttggaatcatataaaactcctataatttccataaaaatcggaatgggcataaatttttactcgctctgatctaaaatgtagttaatcttatcaaatttatggtactacgcatcaatattctacgacgaaggcagcatagttttacttctgtataaatattcaggagtatcgtgcccgcactctacttttcaatgtaatatcttcgataagctgacccatttcaactaccacctttattaaaacctaataaaataaacatttcacacaatgtggtgcatacttgcttcatacattgacttgtacttgtactgtctacaatatagttcatattagcccttaaaatgtaaccaatgaatccgaaaaccagaagttccagaagggtatacaagcgcacaatatcagactatcaactggaaaatagcaacgccatatttaaatataatcaaatataattgccctgaatccacaagatgctgtcagaaatcacaaataggataatatgacatgaatatgccaacatggcaacaactaaaaaagaaatggtagtttagtgctaccagccctctggacaaacgcattgtgtttagtgtttactcataagtccggaagataaacgaaagaacgagggcaacctgctcatcaccgggaatgtccgtgccaccatctcgtccctgcctcccttgacctccacatctcgcacaccgccgtcaccttgacaccgcaaagccacacgagtcaacaagccaaaacgtgattcgaacaccaaggaaaacgaccaatggggttgcagggagatgcgcttacggattcgaagaggctgggatcggaggcggggttggcggcggcggcggagtccctggatgcggcggagagggcgctgaggtagaagtcggacggagacctacctcgaacggcctcggaacttagggcggcgaagcggatcggatcggcggcgcacgccctcgccctcccccgggacgcccccgcggcgctcgctcgcacgcacgcactgctaggctaggatagggttcccctcgagctccagcagcaagcaagggcgagatgggagggagagagagcagctagcgcaagcgaggagagagaaggaggtggacgcggcggcggcggagctggacggggccgccggggcggaggccaacgcggccgccgcaacggtggtggacgcggcggaacaagggcgagatgggagggagagagagcagcgagcgcggccgcgccggagcgagaaggaggcggccgccgcggcgggggagctggatgcggccgccgcggcggaggtgaacgcggcggcggacgcggcggcgcgagggggaggcggcggcaacggcggcgtgagagggagagtgacggcgcaggacgagagggaggagtcgaggagaggcgggggaggtggctagggctggggttagtgcgcggaactttttcgaaaaagaccctcgactttctatttttacagaacgctcctatttcgcgtttgtcccctcctgcgcatgtaatatccggattttagaagggcccttacgcacaatatcgcctcaggggcaccgttcggcagggacctactcggaattacgaacaaaccgaagggctttctcgcaaaaaaaccaacccgggcactgtaggactagcttttcgctgacgtggcacgccccctcgctcgccactcatgccccgcataatatttcccgatatggaaaaatgatagcaaaatgttggttgtgccgtgcgcttcctcgtgcaggaaaatatcatatatccatttcggccgagattaaggagtttagcagatcgtttgtcttttgatattaattttgttagtcaccatcattttttttcttttgatattaattttgttagtcaccattgtatacttaggctcatccttgtgcaaagcaggtttcacaaggtttgattgagtgcgcgcgccaagaaacaccgtagttgagattttgctcaaagacctactttaattaagttagtaaaatctccttttgctctaaatcccaatgaacaaggaactcaacaacttgtaatttggtgcaaagaattctttatgtggaaacccatactcactcaggccacgcagcatcacacggtgagagggatgaactggacctgatgcattggagtgcaatcagggcagcagccatgttcgagtgacctatcacaaaggaggctggatcgtacgaggatgcaatggtgctagtaacaggatactgggatagaactgattgcggcgtaaccgtaaatccatgagtattttggatacgtgattacacgaacatgtggccctgcttgtgattggagggctcgtagcatcgactactccaaaaatcatacaattgttgtaaaatatatacccgaaccattatgtcgaggggattcctccggatcgatctcacattgataacgcgcccttttccacctatcggtagtttgagagaagtttcctagctacattctcatcagccaaatagtaattagtagctacaaatcaaatactccccaaacaagcaaagtctacatatgtcccaaaatataaaggattttaatccattatagaagggaggtagtaaaaactgaaacaaacacagttgtccttgtccatgaggctatgtgaaccactcattttgatgcggacatcactccttcgggaattgaccgaacaatttgacgtttagaatctgttccggcgctacgacgtcgtatttgggcttgtgggccgtgtatcatgttggaacccattagggttgcatcaagggttgtttgcacaaccctaaactctatatatcaatacccgtcgtcatctctagggtttgggtttagcaatttgattgtaattcaattcatgatgatcataagtagaaagttcatgttcttcagtcattgataaacaggacagtactcaacacaattaccacaaaatatacaaactccgaaatcaatactataattaagcaattgtttccttttaatatccttttcaaatctccaatccacaagaggtagatctatagggcatacgcgaacacatacttcacaagcaatacatttatcaaattcaaagtggattcgcccccagaaacgctccgatgtaattgatttttcataggggtagtgaatcgttataggtaaacgatttgtgtgggataaggtaattatgaaactttgaccaatgtaccttgctgtgcgtattgtttgttgaccataactcatgaacccagttaccatagggaacatattcgaaatatctatgaaaaaggtatgtttctttctcttgtttgagagaacttttgtgttgaaaatattcttactgttattgtattatcttattttatagtgaaacaagttgggaagaagttgttaataagagattgcccagggaaataggtaaaagaaatttccatccaagatttaataactaatccattctcatcctgggtaaagtccatcttattgtgatagaaatgaagagaaataaataagctttagttaatgtaataaagatactcattgtcatttctaaaattccaaccattttattcatttggaaaaatccaaaaaaggatatatagggaatagacaaattccacccgcctaagcagagaactgttacaaataaagaggaaactaataaatttaggtaagaaacaagataaaataaaccatatttgatagcagaatattcggtttgataacctgctactaattcttcctccgattctggtaaatcaaagggtaatctttcacattccgccaaagaagaaattagaaaaatcagaaaacctataggctgacgccaaagattccatcaaaaaaaccatattttgactgtgcttcaactatatcaactgtacttgaactgttggataatcatagtcgacgataacatcccagttcccaccgctattccaaaaccgtacatgaaaccttagtttcatacagctcctctatgatcaggaaaaaaggaaagtattgtttcatttcgttattatcttcttgggcgtagttagaattatctaagataaaatcgatttcaacgtcctaaattagaccaaaggaattctatctgctagaataataaaaaacgcttcggaattcatctcatcctttataatataatggtactttttctttgttcaacaataacttaatcttggaataaaacactcgttataacaattaataaacgaaaagagttgggtattagttcatgaagaattctgtatgaatatggataaacgatggaaagaataaataaagatcttttttttattgcattccatatcttttgtcctattcttctttccccgaggagtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcaggaatctcttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaacatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtactattctattgtgattcccagtaagagggtcaaaatgggtagaatccatatcagtccatagacttcttttaataattccaagttcgaaaaagaattgatagcttctacatgtaccctgtctattatcatttcaacgatcaacttctcccataatgatatctatactacctaatatcgtcatgatatcagccaatttcattttttttactagctgaggaagaatttgcaaataaataaaaccgggtggacga

SEQ ID NO: 24194 - DNA, 3085 bp, Oryza sativa
  unsure (1)..(3085): unsure at all n locations
nnnnnnnnnnnnnnnnnnnnnnnnnnnnnnnnnnnnnnnnnnnnnnnnnnnnnatcaagtttttatttaggtttaattagacctaaagtgtatatatacttatacatgtttatgtattacttaaacaacactgtgtttaaattcttatttcactagattaaggttttgatctatgttctctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtactattcgattgggtaccccagtaagagggtcaaaatgggtagaatccatatcagtccatagacttcttttaataattccaagttcgaaaaagaattgatagcttctacatgtaccctgtctattatcatttcaacgatcaacttctcccataatgatatctatactacctaatatcgtcatgatatcagccaatttcattttttttactagctgaggaagaatttgcaaattaataaaaccgggtggacgaattttccatctccaggggaaaagactatcatctcctaccagataaattcctaattcaccttttagattaatctatcaagaatagtttcgccgctagatcggtttgtaagaccccaacttgtgagcttaatcattcatctgcaattttggttgtattctttcttgttcttgtttttgttcttcaattcataagcagggattagccttctcggcgaggtcaaccgggtttcggcactgttgataaccagaggagacgtggtgctgcgattgcggggctcaagaacgtgctcgttcaagaagccggatcgatttgtgtcatgactccaccaaatcgttgattatccgaacctttcgaaaaatcgggaacccttgtccacatcacatttcctcgtgaaaatcctgccaatctaagtacatatttatcgtgtagctacaaaagttgacatatcatctgttctagtaatataaacataaattgtaaggtatagatgccacactattaatatctagcacaccactctcccacaacttgttagggctcgtgttaagttgggctacaatttcactgttttaccatgccatctgaggtagggagacaaatctatactcaactctcctccctttgctagctgagcacaaatctaatgcgatattaatggtccgcttacatcgtcttactgtattcgctctaatacaactaagaatgatccgatagttgtatttttatatcggtaactggcaatggctattaccctgttgaagtcgctcaatgaggttagtcatgttctcttgccaataatacaagagccgaaatttagggcttagaaatatgatgattgctgtcatatttatgtaatattatgttgctgtactgtttttgatttcatataagagaaaatgttggaaaatagagaggaggatcaaaattagagaacttaggagtgaaagactattccagcttattcgtgagagtgatattgcttgtataagcgagctccgaatggacaggaggacatttcacattctatgtgacatgcttagagacgtcggagggatcggtagcttcattcttatatatactatctcaccatttaaagaatagaacaataggaaagttttttttaccgaaatggagagactgtaagtaggcatttcaatttatgactgctagctgttctgaagcttcatcaacttctacttaggccttgtttagttcgctaaaagaaaatttttggatgtcatatcggacgtttgaccgaatattggaaggggttttcggacacgaatgaaaaaactaatttcataactcgcctggaaaccgcgagacaaatttattaagcctaattaatccatcattagcacatgtaaattattgtggcactaatggctaataatggactaattaggctcaaaagatttgtctcgcgattttcatgcaaactatgcaattagtttttcattttatctatatttaatgctccatgcatatgtccaaagattcgatgtgacgtgtttgggaaaaaaaattggaaactaaacaaggccttaagaagccagaacctatacctgaggacaccaccgacgatagatggaagtatttcaatgcaacccattctaaaaaataaatcacatttcctttcaaaaaaaatcacatctcaccactattaattgtaccatattttattgatgtggtgttctagattgtagaattgcctaggtgcattggatggtacacacataaaagtaactgtcccaaccaggataaaaggaagatataggtcaagaaaaggagacattgttgcaaatgtattaggtgtttgtgcacccgatatgcagttcatttacttactacccagttgggagggttctgaacatgatggctgtgtccttcatgatgcaattcacaggtcggatgggcttcgtgtccctcaaggcgagttttttttccaataaatttattttgaagtgtgacactccacagcctgaattatactgatatttctttttttttaattttaaaggttgctatttttttagggaaacactgtaggggaagcccccatagtaaaattaattaaaatataaagaaatatttacaacaagttcaaccaacccaagagcagatgtctctctattacattcaatctatgaactaacaaagagagatcacttttaaaggttgctattactttgttgatgctggttatataaatgcaaatggttttttagccccttacggaggccaaagatatcatttaggtcgtttcacagcacttgaccgaccatgtagtgcagaggagtactttaacatgaggcacacaagtgctagaaatattatagagaggtcttttggaagactaaagggtcgttgagcgattttgaggtctccatcctattttcctatcaaaactcagtgttnnnnnnnnnnnnnnnnnnnnnnnnnnnnnnnnnnnnnnnnnnnnnnnnnnnnnnn

SEQ ID NO: 24195 - DNA, 1438 bp, Oryza sativa
taattaaatataagaaatatttcaaaaggttcaacaaccaaagagcagatgtctctctattacattcaatctatgaactaccaaagagagatcacttttaaaggttgctattactttgttgatgctggttatataaatgcaaatggttttttagccccttacggaggccaaagatatcatttaggtcgtttcacagcacttgaccgaccatgtagtgcagaggagtactttaacatgaggcacacaagtgctagaaatattatagagaggtcttttggaagactaaagggtcgttgagcgattttgaggtctccatcctattttcctatcaaaactcagtgttgaattataatggcatgtgctttattgcacaacttaattttgcaaaagatgtctagtgatccatttgaggatgaggatgagatactgtcggatatacttaagggagaactcgctgaacctgagtttatctcagctatttcgacatctgatgattggacgaattttcgcaacactcttgctcaagggatgtataatagctatagggctcattgaggtttgtgttttaaatggaatttctaattgattgcaaatcagaactaaaaacaaatgttggtacaactatggacgctcactgatgttagttttctgttgaatttctaatattgcagttatggagcatcttggaagctcaagcattgtgcgtgggagaggcaataacaagaggatttggacgtacttcgaggatgaggaactgatcaaggcactgttcgagattgctttagatccaagctggaaatcagaagggggtttcaaaaatggatactgccaagttctagagaacgtgcttgctaagaagttgccaaattctggccttactgctgttccgcacatcgagtcgagagtaagacactttaggaccaagtttggggcaattgaagtgatgctaaccaaaagtggcttttcttgggatgacaacagaaagatgatacaatgtgagaaacaacaatacgatgatcattgcagggtaagtcatcaaactaactatataattatatggaatacaaaatttatttattgattcattagtgcattgaattgaaatatgtgaaactaactgtaagatattttctgaaattttgttccaaataagaggctatgtaaaattcctttgaaatgtttgcgaagacaacattatggttttcttgtagtatgctctctcataaatatgttctcttgtgtttttcatgtaattgttgcatttttgatatgtcacagtagctgcataggtctctcttctgcttgctaaaccatgaccttaattttgtgtcattctttgtattttacagaaaaacaatgaggcaaagggtctgtatggtgtagcattccctcactatgatacactagctgcaaggagatcctctagagtcgacctgca

SEQ ID NO: 24196 - DNA, 446 bp, Oryza sativa
  unsure (1)..(446): unsure at all n locations
nnnnnnnnnnnnnnnnnnnnnnnnnnnnnnnnnnnnnnnnnnnnnnnnnnnnnnnnnnnnnnnaaataacggcattagacgatgccgttgatgtgcttgatatgctaattctggacattatccgcgaagcaaagaaaaccgggcaaaaaaaaagactcaggacactgaaagatcttgatcaggccgcattgttactggcgcgggcatgtgcattgttgctggatgataatacagatgtcccagatctcaggcaggttatcttcaagtgcgtacccaaaaacagactggcagaatctgtaagcaaggttaatgaacttgctcgtccacagaacaataatttccatgacgaaatggttgagcagtacggtcgggttaaacgttttcttccggcggggttgcgggacctgcatttccgtgcggcaccggcaggtgaacatgtactggct

SEQ ID NO: 24197 - DNA, 1360 bp, Oryza sativa
  unsure (1)..(1360): unsure at all n locations
nnnnnnnnnnnnnnnnnnnnnnnnnnnnnnnnnnnnnnnnnnnnnnnnnnnnnnnnnnnnnnnatcattgcagggtaagtcatcaaactaactatataattatatggaatacaaaatttatttattgattcattagtgcattgaattgaaatatgtgaaactaactgtaagatattttctgaaattttgttccaaataagaggctatgtaaaattcctttgaaatgtttgcgaagacaacattatggttttcttgtagtatgctctctcataaatatgttctcttgtgtttttcatgtaattgttgcatttttgatatgtcacagtagctgcataggtctctcttctgcttgctaaaccatgaccttaattttgtgtcattctttgtattttacagaaaaacaatgaggcaaagggtctgtatggtgtagcattccctcactatgatacactagctgcaatttatggtaaagacattgctactggagaaggtgcagagggttttggtgaggctgttgctaatatggagaaagaaattgttcgagatattcaagatgaagaggatgaggaggatgaagagagagtgtctagagaaacgcctcgacggagcgttgattcatcagcacctcgacggagcatcgattcagctgcacctcggcggatcatcgattcagctgcacctcggcggagcatcgattcaactgcttcaagctctaagaagcggaagaaagacagcaacaaactgaaacataccttgtcaagtgacccttttatggatgtctttgccaatgttcaaggtgatctgagggatgttacaaagcatgtgggagcaatggtggcatctatgcaacatgaagctgagatccaagagaaggcaatggttgaggaggacccactacaaaaaattcagaatgaagctattcttgagtgtcaaaagcttggattgactggtactgaagttgtcaatgatgcagctgcttttgtaaaagtgccggctcaaatgagtatgcttcttgctcttccagaatctctcaggagggagtacgtcctgaaaatacttgctggtaattccctatacacatttgcatgttgtattacatactttattttgaggtcattaattgtaagcatattgcattttactactttagcatttcatatatgcattcactgtgaacaaattcgcatcaaataccttttattgccttatatactatttgtctgaaaccatgaacaattataatgcatgtatgggtccagctgtccagctcaatgccataggaattaacctaaggaggcataattcannnnnnnnnnnnnnnnnnnnnnnnnnnnnnnnnnnnnnnnnnnnnnnnnnnnnn

SEQ ID NO: 24198 - DNA, 1165 bp, Oryza sativa
taatgcatgtgtgagtcttcccttcccgggtgcgccagaactcctctcactgctagaaaccgtgtacgcctagagtgcatgaggatgtaaagttcatggagcgggtactgccaatgcaaggttatcgaaaagctttgccatgacgcgtctcatgtgttgggatgaggctcatgtgttgggcagtcgcggagtgcgggtaaagtgtacattcactgcagtgtgagtaaaccaaatctattcgaatagccgtgctcgcggttattgagcaccgagacatgtattacacttggctagactctaaattcttaacttgtgtgggatgggatattgcatgatgatttctatactgatggagccacttcctgagaggcgggaatgtggacgtcctcagaaaaccatgatgactcaatggcgggaagctatccttgggatcacaatggatggtggtcagaaccgtcattgtttaatatgaacactggtactaaaatttgatcagtgtgtgctaggtcttaggtttgtgaaaagaattataaaacttgctttgcgcaaaagaaccatagccatcctttgaatacccctgtcatgtgcattgttgttgtggtggcttgttgagtacggttggtactcacccttgcaatatacaaacttaatcagaggtcggagatgaagcttcggaggatccctactcttactactaggagggtgatgaagacgatggcgctcagtaggtcttagttatggtcgttgcctgtggcaatggcgtgccactgccttaactccgctgccttatctacttctgtttttggaatgtattccggaccgctcggtccgaggatttaagactatgcctgcgggcttttgatgtaataattcatactagactttcgtgtatgtgcatttggtatttcagctattaactcgtgtgtaccagactacttgatccaggaaaatggtactgtttacacgattgattcctgttataaaaacgggggtccacacatctctagaatcaaccttctttaatggaattgcttcaacccacttggtaagtaatctgtagccaccaaaataaatttatgtcctttgcttgatggtggatttatctggacgatcatatcaattccccatcctctgagcggccatggcttgattattgagttcatag

SEQ ID NO: 24199 - DNA, 1156 bp, Oryza sativa
  unsure (1)..(1156): unsure at all n locations
nnnnnnnnnnnnnnnnnnnnnnnnnnnnnnnnnnnnnnnnnnnnnnnnnnnttacgtgctttgtctggatagttgctgtaacggataccaattcattcgcgctgtttggttaggcagccaggtaacagactaacaggtgcaagcaaaacatgtgtcggttgagaaatcaaattctgaaactgatacacaacgagaaaatacataatatggagacttctgtttggatgcaaatgcagtgaacaagcacaacactgtcacttctatttggatgcaaattttgacagcaagaattcaagacaagagataatattttgcaaaatataatcaatggcacaccttcaaaattcaatcgataaaggattggatgaacaattgacatgagtgaaactaccagattagttaacaaataagctagggtagtacttttgtcttaaaaataggacagtactttgatcacagaatatgtacaaggaattggtagaaaagctttgttttcttgaaccacttttttataggtgcaagcaagcaagaaaggcataggcacatactccagctaggagtagtttggagtgaattatgcctccttaggttaattcctatggcattgagctggacagctggacccatacatgcattataattgttcatggtttcagacaaatagtatataaggcaataaaaggtatttgatgcgaatttgttcacagtgaatgcatatatgaaatgctaaagtagtaaaatgcaatatgcttacaattaatgacctcaaaataaagtatgtaatacaacatgcaaatgtgtatagggaattaccagcaagtattttcaggacgtactccctcctgagagattctggaagagcaagaagcatactcatttgagccggcacttttacaaaagcagctgcatcattgacaacttcagtaccagtcaatccaagcttttgacactcaagaatagcttcattctgaattttttgtagtgggtcctcctcaaccattgccttctcttggatctcagcttcatgttgcatagatgccaccattgctcccacatgctttgtaacatccctcagatcaccttgaacattggcaaagacatccataaaagggtcacttgacaaggtatgtttcagtttgttgctgtctttcttccg

SEQ ID NO: 24200 - DNA, 3040 bp, Oryza sativa
  unsure (1)..(3040): unsure at all n locations
cccacgtggcacaataccgttgtattggacagacttagtcacctaaactaccacgtcggcgcaaataggaagttcctctgaatcatcgactaattcctcagaattatcgactaactcatacataccggcctaacaagaatgcaaggctagtcctaaatagattaatcagcttaggccatcccatactagcacatgtggatgtacgaataactttaaatgggtgacacaagttcggtccttatggacttgggcaaacactcccccctatcggtatgcaactaacaccatatgcacaccacttgccgcccaagtataaaatcacattttacacattttaattcgcaaatacccatcatattcattttattccagcaaaggttcaagtatcaaaaccacattttaattatagatggaatgagcatttgcatatttctaagcatggctaagcaagtagttgcacatagagcatatataaacccatttgagcacaaagagtgtactctaaccatttctaggggttcaaacagcaagaggatcaattattcaaggtggggtatgcagcaaatatgtcacaactaccttaacccaattttaaataccgatatagtctaagttcacatgcaactttacaaacaaatattttcattcctcaaatcatgggattcaatgtgttcaaaggatgggaggagaaaacttgccttgatcagagaaatgttagcacctaatccactccttcaccgattatgcaatcctatatacctataggagtcatccccactagctaatttgctgctttgtgagtaaaccacgtcatctcttttagtcctaaccatccgatatcagatgtgcgctctccatgttgatctccgacttcaatagccagagttgatctattcaccttctgatcggctgttgagctacccatcatctccctctaggagcaagagcatttatcaccaggaacggtcaccaacaatgagtggtccattagttgcgattaattccatttatttccctctttcagttcctctaaaaaccacactccgtcgtaaactttcaggactctcgattcatccccaatgccagcagggtgatcatccgcactggacaccaatggagaagcgccagagcctattggttataccaaccaagcggggcggaagctggtggaatcactatggtccgatcctccctacaggtatgatgcactatgttcttgacctccgtaacctcatccagaaaccacgctaatattgctgctgctgctacaactactccagtaagaggagacgatgctactactgatcttactgttgccattgcagtataggagctgtatactactgttcaaacactacgcagcgtaggttctccctgctcttaagcatcatgggttaatctaattcattatccatttttatttttagtcctgatgataagtggttttctttgactaaaattgttttacagggctattgctttatttttaacactacgcgctactttattcacatccaatttgatgacagtgtcaagaaatccatttagttcccattcatccacatgacaatattgaaaattgagttaatttctgaactctactaggcgtcattcaagcgtattgaaaaactgaggtatgtataccaaaaaatttcagcatttctgcaataatttttagcttctgcattcgccctgtgttgtttactgcttggtcgctggattgttgcaactgccctgttcgtgctgatctggatatgggtttgcctctccttatactccagaatttgtgtttactccaattctttatagagttagtacagaatagtggttatcttttttgttattatctctatcagatttatgttacacaggatttaaacaagttaagtttacgagcctacagatatctgacgacgttgttacaaaagttatcatcatgcatatattttcacttatgcttataatcaggttaatatgggtattatatatgtcctgatacattccattcttttgattgctatttgatatactttttgcccaagttctgttatagaacctgtcataaatcaaaaaagatattaaaaggttttcgtaggctttaacttttataaaccggacgcacatgcatttacttattgtcagtgcaaatacacccttagaaatcttggatgatcccatggtgttttagggaggaaattttatccactcattcctctatcccatggatccagtcagtgcccgctcaaatttgttcattgtacatacattggcccattctttgcatgaattgacaaaatactatattgattgtgggatatatctttgcttgctatttctatggattatccttagttttccgcagcaatacgctgggtttcgtctagttatctagataaaggacacgttatgcaattaaacaccgaaagagctgaaaatctaaaatgctctaaaatgcatgatttatgcacagtgattaggtactggtctaaaatgaatttaggtgaaagaatttttattttatcttgttccattagggagttataaattttagaagttttatcggtttatagtagtatagtcttaggtagtgttataaaatacttttgtaaagtgatttttattatattagacttcacagggtgtagaggtgtgttttataagaataactcatttggtttcacaatttttggagttataatgattttcttatagattttacaagttacaacgtgttttaggcatatagtgtttcatatgttcatgactttttagttgtaggttcagaatatgctacaatatgctacagtatgtttaagttgagcaaaagaagtagtttggttaactaaaacatttttagttcacatgtttatggtctttactactatggttcatattttataaactagagatgctctaatctaaactaacaatatattatattaacctagaaattgttatatgaactaagttcttctaagttttagtggatgaggnnnnnnnnnnnnnnnnnnnnnnnnnnnnnnnnnnnnnnnnnnnnnnn

SEQ ID NO: 24201 - DNA, 5869 bp, Oryza sativa
  unsure (1)..(5869): unsure at all n locations
ttttagaggcatttgatgcaaagtaagtaattacttttatttcacctaatcagagagtgcatgatgatgaatctgtagaatttgattttgtttcaaaatgagttgagatgaattttctatgtattttataagtttgtacatgttttatgtatgacctatcttagataaattttagagacattatttgtagttttgtacagtgagtgtcaagttttatatttctaaaatagagttcataactttaagaatctacagcaactggaatcatctcaaaatgagttacatttgattttatatggattttacaagtttgggtgttttcctgttaaacatttaatgttttagttatttttcctttgcattttcagatttttatacacatgggtccactgatcggtggctgaaccaatatacaaaaagatccctaggctttatatgaactgcatttaggtccgtgggtccacatgtaaatctctgaagttttatagtttgaaccctatttttttgatcatttacaggacaaagtcctcatcttcaacctccagcagcccgatggactgggagcttggccatggctttggcgagctcgtcggcgacgattggtggctcgattgggaatgaggtcaaaagataaaatgaagagaatgctctcacgattccattcctctagttttcgtggctaggagacatcggagtagcgccgatggtgagggtgagcggaaggtatacatgagctgttactgcatgttgcctaggggctttgattttgctagatgcatccatgcatgtgtttcctaagaggtcaggaggctcaccaagctgtaggaagaaatcgccgaagcttggatagcagcggcttcggttggaacggttcaacggcggtgctcctcctcgggtgaacggcgacggctcgaacgggacgacgagctgctaaaggaaggcatgcacgagggttgtgaggtcaaggagatggtgtatgcgcgagaaatcgaacaatggctcactgaggcagtggtaatcgacgatgactgcggaggcgagttcggatcggcgtcgaggaagaaaaggatgtgttctccgtgttcttgatgtttcttgaggcgtcttgaagaggtggtcgacgcgagattcttggcacaacggcttgcttcgggatggacgagaatggccggacgacaacgatgtcgaagcggcggcgctccggtgcgtgctctagggcatcgttggcgtggtcacattccggtggctgtgatgcacaaaatgggaggtggtcaacagagaagaggttcggcattgtgtgaagagatggaaacgcgaaagagatagatgtgaccttgactcaaacggagatggcgatggtcgtcacctccatggccagtggtgaggtcgctggtgacggagaggcagaggacctgctcccctcggcttcttcggctctgagtgatgagtgaggaatggcgactcagactggaggagaagagagcgagaaaaggaaagcccgaggtcgtcgacacgttgtggccacgcgtcggttcgctcgatctctccctctctgtgttcttggtcggctgagggtgaggcacagagaaagggcgagctggagaggctgccaagtgggcccaggacgaagtgctctacgtggaagagagaggcgtgggtaagattctaggtgaacacggtcttagaccgaattttagattattttctttcccctaactttgtagattcataacttaatgtgtggaacaaattaattagtgttgatttttctggaggtaaatgattaacctagattccattttctttggtttcactcaaaaataatgggtagactgctcacagaaattaaacaaagatgggctattagaaaggtagattgaatttttaggaagcctaaacagaggaggaaaattctagaaaaattatatttaggcatgataaataatctagtatttgaataaattattttccatgttcacttatgtgcagttaaatgtactttttggatgaagtatggctttagccgattaaaatttaatttgatttcttttagttttctgctttgactgattaatttgtggtattaaacttagttattaacttgtaccaatattatagtgaattgcttatgctaaacatagtttacataaatttttccatgatttcatcttgcatagattattttaaagaattagaataacctttctttgtatatgtgttcctacttcataattgcacctaatattattataggaattacattaaacttcttttgggctgaaaaaatatatattagaatttaatatatattagaattcccgtagacaagttggtacggtgacataccgatgggtgtcttacaagcagtcctatatgcccaaagtgcatcaggtaacttgttcttccatgccttccccatctcgttgaccgtcttctacagaatattcttgatttgtttgttgctcgtttctgtctgtccacttgtttgggaatgataatggagtggcaatgatgtattgagccccaagctcttgcaaaaagctttagaaggtcttatcgatgaaatgagaccctccgtcacttatcaccatccgcggagttccaaaatgagggaaggtaatctcgtggaacatccagcgggcgtgcttggcgtcagcggccttgcatggtattgcctctacccacttggacacatagtcaacggccaccaggttatattcgcactcaaaggactttgggaaaggtcgcatgaagtcgatgcccaatacatcaaatagctcgacttgaaggttatatgttagtggcatcgcatcccgagcagtgatccctccatgcttctggcaccttgtgcatctccgaatgaattcctttgcatcatacattgttggccaaaagaatccactctgccagatctttgcgtgtgtcttgaatgctccatagtgatctccatatggggcaacatgacacttctcagtgatctttatgccttcggctactggaacgcatctccgtagtagaacgtctgaacagactctgtaaaggtaaggtaaatcccacaagtgcatgcggctctcgtagatcaccctcttcttattttctcctggtggtacatggcacgcgaccatgaagttgacgatggttgcataccacgggtcagagtctgtgactttcaacagcatgccgtcacgcagatagtcatttatcggtagctcctaatttttggagtagaagcatatttttttagtgagcaggtattttagtgcagcatggtcaatgtaaactattaccttagctcccactaaatatgacatgaacttatcaatggcaaacactacggctaggagctctttttaagttgtggcataattaagctgagctccagtcaaagttttactagcatatgcgatagctttgtgtttcctatccttagtttgcccaaggacagtacccactgcaaaatcactaggatcgcacatgatttcaaatggcggcgaccaatcagggggtcagatgattagtgctgagatgagtgattccttaaagattttaaatgattttagacactcatcatcaaagtcaaacggggcatctgttgacggtcgttatcgatcagtttcgaccatcaatattaccaaaataggggagaattagtgatgctagcaatacatatatttgttagaataataatattccactagtattaggtatactaaccttttgcagagaatgatcataaaatagaggagaatcgacatcaattcagacgataaatcaatcggacgatgtcgagaaccagacttgtgtgtgaataggccaagaacttagaattggtctgcggaggggagcaatagaggaggccaccagctgaaattgggctggattgggccatccccaggttcggctgaaccaatcctagcgccattggatccaggttttggcatggacgtccaggattgcatcccaatgacggttgaagggcacttcggacaattccccttccacaaccgtcataactacctctatataaggagctcactctcttcacttcaacacacctcaagcaagagatctctcatttctctcaagtttagtttagtagtatctagctggtggaatagaattagaataggaatcaggagtccagaagtcttcggaagagttcgggtatggctctagcagctttcctttcctcttttgtaagccttgtacttttattagaatactcttctatatacatttatggtattgaaatactttccgagtatataagtacctactttatattatgttcatgttatactgaatatacggctagcttatctgggagatgctttggtgcgggtatagtgtttgcttatgcaattactctatgtcatgacgatgatattagagtagtatctggtagtttagacgtggtgtctagattacgtgatatcattatttggggttatatattgcggtcgagaggtgggccgctgatggtgacagctcagtatgggtattcctccgcgcctatatataatcctaagttaatttcctagggagggtattcctccgtatttagccccggttgtatggtcatgacgggctgtcgtaaggaactcggcagtcagggtggcttctcgaagtaccaggagggcatcggatagagggtattagctagtatatcagttagctagaatgtatgtatactatgtatactagaaatataggaatagatttcctttctcttttctttccacttagcttagatgatatattatgaggatgagtagttaatgcttatgtgtcactctacccttggattatcttaacccatgcttagaatatgattgtcacaagtaatatataaattattagttgagttctctctacatgatctttccacgggataaaataaatacgatacccttggaatactctcgggtgaaatgctataatggtatatccgtgcgcttgcggatgaactctgtaaccataatataccataagtatttctgcgccattgctgggaattatatttctagtaatgtcgttaagaaataccaacaacatccttagctagcaaggcaattaggggtctagcaattttggagaaatcctttatgaaatgcctctagaatcccactgttggtaattcttacggtcgcagataaaatccgcaagcgcacagatataccgatgtagcacttccctacggagtattccaaagggtatcgaatccaagggaacgtgtgtggtcagattttcctccggttcatccaaggacaccaagcaaaggatagcctaggatatagatgatttactggtgagaaatagtgtctagtgaaagcttaagtttaatcctaacgcaatacttcaggcattgacaacctgttgttcccagatattgctctactacgtactcggacagggaggacttaagtgatctcgatggctgtcaccacctctacacctaccttaaacgtactgtgggatacgcagcaattactggataacaattacctaaacaccacgtctaagtaattaatatctactttagtgtttataactcaccaaagcaatcactatattttagttgattatagtgaacaataatcccgtatgctatttaggaactaaccaagagataattctcacaagataaatctaaattactcaggaagaatattatattgaaattagagtaataaacaaaataaaagaaatgagagaagattaccgacaactccggaattcattcgacttcttctactctactctcttcctattctagtatacaatatagtacgatagagcctcttataattcagctnnnnnnnnnnnnnnnnnnnnnnnnnnnnnnnnnnnnnnnnnnnnnnnnnnnnnn

SEQ ID NO: 24202 - DNA, 476 bp, Oryza sativa
  unsure (1)..(476): unsure at all n locations
gctcggtacccgattcccttatgattacaactttctgtatcaggaatctcttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaacatcctattttaacgaatcgcacgtagagatattgctagtacacaaaaagttaatgggatttcataactaatagattgagcggcagctcgtagaccacctgaaaaagaatatttattatttgagnnnnnnnnnnnnnnnnnnnnnnnnnnnnnnnnnnnnnnnnnnnnnnnnnnnnnnnnnnnnnn

SEQ ID NO: 24203 - DNA, 1454 bp, Oryza sativa
  unsure (1)..(1454): unsure at all n locations
ttccctcgtcgcaatacttttttagttttcgagctcgaattggggtaaaggcttttgagcttttttttatgtcatgttttcgagttaaggcaaaaccttgttcgaaaaccgccgtcccccttacgtttcaaagaagtgacgaggtcgaacatgtttccctcgtcgcaattactttttagttttcgagctcgaatttgggtaaatgctttcgagcttctttttatgtcgtgttttcgagctaaggcaaaaccttgttcgaaaaccgccgtcccccttacgtttcaaaggagtgacgaggtcgaacgtgtttccctcatcgcaactactttttagttttcgagctcgaatttgggtaaatgctttcgagcttttttttatgtcgtgttttcgagctaaggcaaaaccttggtcgaaaaccgccgtcccccttacgtttcaaaggagtgacgaggtcgaacgtgtttccctcgtcgcaattactatttagttttcgagctcgaatttgggtaaatactttcgagcttttttttatgtcgtgttttcgagctaaggcaaaaccttgttcgaaaaacgccgtcccccttacgtttcaaaggagtgacgaggtcgaacgtgtttccctcgtcacaattactttttagttttcgagctcgaatttgggtaaatgctttcgagcttccttttatgtcgtgttttgtcacgcccggaaattcactaataatttccaaactaatttgtgcataaaatcctcgtccagaaatcagccgaggtacacaaactgacaatttaatatacaaatccatcataataataacgttacatacttacaaaagaaaagaaaaacagcagcggaattaacggtctagcgatggcttcagctccactcccacaggcaactcaactggggtataagccaaacgtcttctccttctggatcccttttcttcaactgaggttgattgattattgcaagaatgagcatatgatatactcaacaagccacacagcaaatatgcaagtgcacaaggataccaaaggatggcataatatagtctcatttgcgaaagcagcatttagcaaagagttaagagtagtaaaacagtagagtaattaatcagaaattttaatcaacactgaacaacacacccatgctgcacaggcccaaccatcctgaacaaccatacccggctgtacagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24204 - DNA, 790 bp, Oryza sativa
  unsure (1)..(790): unsure at all n locations
tgccattccttcaaaaacaaacggaaagaaaataatcttcggcaacaaattaaaagtggtattagccatatagcagcccttaaacagagcctttttcaacaataagaagactgctgtataattttactcatcccctatttgacccattatacatcacaatatacaactcatgtttagtatctgaataaatccaccgaagaacaaagatcagtgctcattaccactacactataacaagcacctaacactctcctctgcaatctcagctctgttatctgtccctttgtttatcactgtgtacattgcaacttccctaccactgttaaatttgcacttataaatttcttttaactacctttttttttttgcagatacagccatgaatccacctaggtttttcacggttagactaaccacagcaaaccagcgctatgtggtaaccttaccaacagatataacatatacagtctagcttaatacacgccagtcttaatacatcatttcaattctgcagcgcagaccagctgcaatcgcacaaggatatcagctggaggatggccagagactcaaattagtaacaacccataacctaatggtctacattgaactaaagagagcatctggcaaaatatacatcactacaggatggccccagttcatagaagccactggtttgcagcttaaagaatatgtggttttcaaagtcttatcacaatccaagatgcatgtcatcatataagccaagagtgnnnnnnnnnnnnnnnnnnnnnnnnnnnnnnnnnnnnnnnnn

SEQ ID NO: 24205 - DNA, 2203 bp, Oryza sativa
  unsure (1)..(2203): unsure at all n locations
nnnnnnnnnnnnnnnnnnnnnnnnnnnnnnnnnnnnnnnnnnnnnnnnnnnnnnnnnnnnnnnnnnnnnnnnnnnnnnnncactacaaccactcaagatcccaaaatggaagtgggaagagattgggatggatttcatcaccggtcttccaaggacccaatctggatatgactctatttgggttgttatcgaccgcctaaccaaagttgcacatttcatagtagtcaaaaccacttatcctggtagtaagttggccgaattatactttgccaggatagtttgtcttcatggggtaccaaagagaatcgtttccgatcggggcagccaattcacttctaagttctggtagaaattgcaggaagaaatgggaactcgtttgaacttcagcactgcttatcaccctcaaacggacggccagacagagcgagttaatcagattcttgaggatatgctcagggcatgtgccctggactttggcaaaagttgggataagagtctcccatatgctgaattttcgtacaacaatagctaccaagccagtcttcaaatggcaccttttgaagctctctatggccgaaaatgtcgaactccactcctttgggaccagaccggagaacgtcaagtttttgggactgacattctaaaagaagcagaggagaaggtcaaggttatccaagcgaacctgaaagttgcccagtcccgacagaaaagctacgcagatacgcgtcgaagggagttagcctttgaagaaggagactttgtgtatctcagagttacaccgcttcatggagttcgtcgtttccacaccaagggaaagttggcaccatgttttgtgggaccttacaaagttcttggtagaagagggaaagttgcttatcaattggaactactggcatctctgggaggagttcatgaagtattccacgtgtcacaactcaagaaatgcctccgagtcccgatagagcaagcagatccagaacagattgagattcaggaagacctgacttatgtggagaagcctataaggatcttagaaacatctgaaagacatacccgaagccgagtgatccgtttttgtaaggttcaatggagcaattatttagaagaggaagcaacatgggaaagagaagacgaactgaagtccacccatcctcacctcatcggaagcgtcttcgaatctcgagaacaagattctctgtaaggggggtggacattgttgattctctgtaagatccggcaacctttaccttgtcagggaccagcgggcggtgaaacctcagcgggttctcatgttttgggtagacctagatggatagtcttgtcacgacctttatccgagtaccgtggtggtacccggcgcgtggcaacgcgtgttgaggttgtgtcttgtgggtaaagttgtacacctctgattagagttaaaaactattcgaatagccgcgccctcggttatgggcaagctgagtaatgtaccaaaagttagttttgttttataaaaccttgggagggtgaaatcatgatggtgtagtcatgtggagattagcctgggctaaggcaggttcgcaggctcatgcgaccttggtgattaaaatattggcttagaacaggatcgtgttttaaaatgagctttaacctgattaaaatgtttaaactatggttttatgcaaaataaaccctattaggccatttccttgatttccctatgcattattgttgcatttccggtgtgacttgctaagtacggtggtggtactcactcttgctcacaaaaataatccagaggatggacctgaagaagatgaaggcttggatctctagttcgctccgttgtcgagtgcttgtggctgctgctgttccgtagtcttctgctgttttatttgtttatctttgagtgtgagggcctagagtcgcccatgtaataaagtactccctccatctacttttgataggcatatttccaaatctaaaaaatttatttttgataggcatattttaatccaacaacctaccctcttaatgactttctcggatttaatacgtgactttccattcttccacataagattggctgcatgggcatcgagaaatgtaaatattaatgaattgcttgtttacgaggaataactagtagcatgtttaaatggataannnnnnnnnnnnnnnnnnnnnnnnnnnnnnnnnnnnnnnnnnnnnnnnnnnnnnn

SEQ ID NO: 24206 - DNA, 1750 bp, Oryza sativa
acataagattggctgcatgggcatcgagaaatgtaaatattaatgaattgcttgtttacgaggaataactagtagcatgtttaaatggataataagtagaattatttatccttggtctgtgtgtcaagatgaaatataactatcaaaagtagatagatggagtatttcctttacgtttctgcaagtgtggcttgtaataatcaaaaatgtctatgtgtacctcgcctcctgggacgaggattaatgcactgagcgtttggaaatggtgtatatttccgggcgtgacccccgcccatgtctaaagtcagggccccgcccgacagacccgtgggagaaaatctgcatccgtccacaccctcgttgtggcagccccctgcggggacccagatccaacggggaaattgccactcttaattgtaagaggagaaagagaatctcgtgagggtgtggtgtgtatttgggagaagattgcgaaggttgacaccttacctcaagaagagaaaaggtaaatagtggaaatcgagcttcgccttgtcgaacgaaagttgtgtgacattcgagcttggaccggtgggggtcgcttggagcatgagcttgctcttggtggttgctttaagagaccaatgcatgattggttgcagttggttaagagagacttggcctttcggggccctcaacggagacgtaggatcgactgacttgaactgcaatgtctcctatctctcattactctgcacttaccgctttcttgttgagctatttggtgatcatattgttgcatgcttatctcttgttgatgcctcttggtcttgctcatatctagtgtgcaaagtgctccatctccctacggttttcactctctttataaggccaaggttgtccactcttagttggattgtacgggtctatattgtgcataggcgaattcctatattctctgtgtttggttgcactgtctagttgtgattagattttctgacactgtgtattgttagattatccgcaatgatacctgattaaccggtcaatactaattttcgctgcaagtgtttgtaattgcaggaaacacctattcatctccatctaggcgagatctatgatcctcaaattatgctccctttcaatttggatagcaaatatcacttgtaaccatatcaagaagcgacaacacttcatatggccataggaggtgttgtctattgataagatgtcatttaacattttttaaggtgtggaggaaaagaaagaacagagatgatattgttatccgtcaactaacaaacggtacaataaacatcttaattccaatgataccacaatacaattgaccattaagtttgcttgtaaggaccatttatgccctagcatatgttttgtaatgaaataacactttttttaacaaatgccacataatatgaaggaagcaattttcatttaaagatattaacttttcctgggaacataaaataagtgaattatgtgtggtttttctaaattgcatcgtgggaatgatttaatccttaaatgtttcacaaaataatttatgtcgagtcaatatacacaaggatattttgtattttttttctaattttgtgagtcataaaatattttttttcatttcaatatttcatttgagctacatgtagaaacattctaaaacatgtttagggaaggttctaatagctacagtttctcctagaattgaaagctcccctaaaatatccacctttttgtagattctataaagttg

SEQ ID NO: 24207 - DNA, 1581 bp, Oryza sativa
  unsure (1)..(1581): unsure at all n locations
nnnnnnnnnnnnnnnnnnnnnnnnnnnnnnnnnnnnnnnnnnnnnnnnnnnnnnnnntttcctgggaacataaaataagtgaattatgtgtggtttttctaaattgcatcgtgggaatgatttaatccttaaatgtttcacaaaataatttatgtcgagtcaatatacacaaggatattttgtattttttttctaattttgggagtcataaaatattttttttcatttcaatatttcatttgagctacatgtagaaacattctaaaacatgtttagggaaggttctaatagctacagtttctcctagaattgaaagctcccctaaaatatccacctttttgtagattctataaagttgtagttgcggaatcttgaaaatgaactagaagacagaaagtggttttcccagcttttctagattttcactagttggattccaaccagctcttctcgaaatctaaacctcctctaaatatgccccctcgactaattgaaaagtttcgagaacattcttttacaacctttaaaagtttgattttatgaatttcttataccattttagttgtacaagtgcataatggtctttcggccggcaaatacggtcgtcaatgataggcacattacaagaatgaaatgaaataaaaataagctaaacaacctagacctaagtgcacctattagaacctagacctaagataacaagagggggacctaaggactcagggcattgaaaactaacggatcaggggggcctaaggactccgggtagaagctagaagcgactaaattcactacgtctaacacgatcaacttctaacggatcaagaaaaactttttaatgatagccatttatcttaaagatattacttttattgtatgacggctccatgtgatgaagtgtcgacggcgatatatgggcccatccatttatttcgaagttttccatgtccgaatagcttcacccgtgagttgaacagcagcaccttatcccctgctttgaactccttgtgcttgatctgtctatcatgccatcttttggttctgtccatacagatcttggcattgtgataggccttgtccctccattcctccagctcagagagctgcatcttcctgtgatgtccgtctccctttaggtccatgttccaagtccggatagcctagtgcgttgtcgtaggcacttcggaccttccattatatttgagagatgaagtgaataatttaagtcatcaaacaagcataatgaaacatccgacgcctcgagagaggaatattggagacattgctgagcccttagcctgccagtcaacttcagcctgagatgtgcccatcaaaccactcgaaggtggtgaccagatgtgttacacattcaggagacttgacaaaaatggctaaagatctacaacctctcaaatattcctaactcatactcatgtgaatctagttcccaggatgtgcactagatccacactttcatcttaagcatgattatacatagcaaacacaactaagattaagaaaattaagacttacaacacttaataactacataggccgaccggccaatagacatattagaga

SEQ ID NO: 24208 - DNA, 8552 bp, Oryza sativa
tcatgtgtcaggttggaaaataaaatggccacaaatgataggataaaaaaaggtgaaatgataaaattgccagaggagacaagataacacaaggaaactacttgcagggtgcttattgatccaaaacaagatatgaggagtatgtgggactccctgaatgaaagtgacttgttgggtggttacgattctcctctctcctttcgcattatttttctctgcaagtaccaatttaatttcttctatttggtcttgcatccaagcataagaagctgagaacgtaggcatgactcatggatacgtcaagactctttgcctatcgggtaagctgataagaacacgtactatatactttgatcaactttgcccaccgaattacatttcattttcgtctccaggaaagctagtttctttgccaatttgccaattgtccactccatttcgtcatggtccggcagatggcgtcacatcgaggcatgtttgcgatcaccttccaagctgtttttttattttgagttcaaaaaatggggcaatctgcagtcaaaatattgattttgtgtacagcacaagattgtgggctcttgcctcttgacggtgtggcgatatttttacacgttccaatcaaaatcctccgagatatctcctaatcggtgtcttttcatggctgcttttttctctgcccgtagattaagttcaccaggatgttgtaaaggaagtagacatgactaattaatctgtgggcggggccgtttggtggccagaaaagaagggttctaccggctactaattatagtttctgttccccactttaaggctcaattaggtcataagctttataaaaaaaaagatgtaatggaccctgcacaattcagttagatatttcaccggccggcctgcgcattagtactacagaacttggcgtttagaacctgctcattaatgggatttttaatgatttgatcaggacggtatccacgaggtcaacgcttggctttgtggatgatacgtatcataggcacatggtgattaggcgaaagcaccacgaaggcgaagagaggtgagaggtcagagggagagggagtgagctcacattgacgtcatgttatcaccagcctgcagccaagtgaaaaatcttacctttcgacgtcagagccatgaactgaattgaggatcatggagccgtcgcttggaaggtaaaaatacctcagggccatgatcttgtcttctctgccccgtttcctcccaaatactaaaaattaattaacctcacgcccgcaaaatgaaaactcctttttggcccatttgaatcgtaagaatgaaaaaacggaggaatagaaaaaacatagaattatgatagaaatgcaagtataaaatagaggattgcaaaacataggaaaaacacaacaatgtttgtttgattggatcacatgaaaaacacatgaatcggataagagagatatactcaaaggatttttaccaagaggttggacctcttgctaagtttcttctaaaacctatatgcaataagccattccataggaattttgtaggatttgggaaacttcaattctttaaatcaaagagctacataggaaaatttcttataggatttcaatcctatgaaaattcttcataattcctttgattcaaaggggcccttaatttttaccatgtggtaatttatagtccctattcctttattaagatagtagattttatgatctaggggcgaatcagtccgaaacgaggatatggtatgcacttttagaaatccagcgaatgtggattatccgacatttctatcggattatccgataggccgtttgtcagataatccaaaattatcaacaaatgtaaccactctatatattgcatataatataagttggttcatccaatgacctaatttatcaattaacctagatttattagcctaaggctttcattgtctcgtgtcacacttgcgtagctatatttttatattatagacataatgtatttatgttgttcagcacttaagtacataattattacaatgggtcatttattaactattgtattattgttccttgtattgctaactcgatgttgtattgattgcatatacatgtaacacccgataaatttaatccgtttccgaaccgattccacaccagctccgcaccatttccgacatccgaaacaatccgctccgcattcgcatccgcatccgtacactatccgcacccgctccgaatccgcttaaaaaatatggtttaggatatggtatgaaggccatccgtccgaatccgctccattttcacccattttttctcaatttttagcacgttttttaaactgctaaatgatatttcttacaaaactttctactttaaaatatcaaaatgactttctcgtcttatgctgacttcatcttcattttaatatatctcaaacaccacgatagagttactactaaataaaagactcctttgacttaaattactgggcggattaggattattacggcggatgattgacttggttgtagatacaaattgaatattataaaattaatttagtataaataacttaaatcaaacagtctaaataatgcaacagaaaaacaatttgtttcaataatgagttatatctgttttaataattcggtaaataagatgaaaagcagctgaaccatcacggcagtaagccagtaaacgtggcgttttgatagcgaggcgttagttcgctgatcacccaatcaccattcggtcttccattcactcacctgtcaccacccgtccacccccgcgtgctgatgcgacgctgtcacaaggcacacgtatgcagagcccgagcgcgacgggggcgctagggctagcggcttgcgtgcgcatggcgtcagcgtgaccgccgccggccgcaacagctgcagcagctggcacagcgtttcgaaaggaaacactttttctgttgagagcgcgagctatgcggcgagcttttatatatatttccccgtagcggagagaggaaaaaacgccaagaaaccatctgtcgcttttgaccccgggaagcagcagcagcagcagcggcggcggcgtatcggggcgtaacggaatcgaggtgtgttgccgctatataaagaggaagaaaataggccccaaaccaaaccaccataccctactacaaaccataggcatcgccggcaagggaggtcggaggaagaagaaagggtcgtcgaggtgttcttgaattctgaatttctgatcaagtcgatcgttcgccggcgacggcaaaggtggtaactggtagtactatatatgacgacgtcgatggagaagccccggcaggtggtgcggaagttcctggcgcggccgcagcacgagggcgtcggcgccgtcgttcgccggagcatcgggaggtttgagctgaggtacttcgatccgttcctcgtcctggacgagttctcaggtgagtgaattgcttctggctcggttttgatcatctggtttagagtgatagagatttgcattttttgatcgtcttcttgatcgaatcctgtgcagtgtctgctccggctgggttccctgaccatccacacagaggtttcgagaccgtcacttacatgctcgaggtaggcagagtcttttaccacagttcacattctgttcgtcggtagtagaacatccaactgcatatagagcggccatgaaaattccttgcttaatccccagtgatacgtacagacagcagcgtcttttgacaaccacatcacacggatcagcagaaacgaattaaacgcgtttcatttgtcaacaacgcaaacctgataggctgatacggagtagtagtttttagcaaattcagaacgtttctttccgtcaaattgaagaatctaacccatccaaacgggccctgttgccttgctctgcctttggttggtagccttcctacgtcaaccacctcgcgtcgcatatacttttccgcgctcaaaactctgcttcacaccttgaactcatcattggcagatcgattagtaatatatatcttcgcctaaacccaacatcagtcaagccaagccgtgtaaaatgaaatagaaagaaacaatttctacaggaagacgtacgatggccttgatagtttggttttgcattgaccgtgttcttttttttttaaaaaaaaagagaggagtatttttaatccggtctttacatccaacagaaaatatgaaaccatttaaattgggaacttagcctaaacaacttaatctgaaattcactcctataaaaatttaaactcagaatctacgtgctacttaggccagtgcattgaccgtgttcttattggaactgacgtgaatggtgggtgtttttcagggagccgtgacgcacgaggacttcgagggccaccgtggcacgatcaaggccggcgacgtgcagtggatgacggccggacgcggcatcgtgcactcggagatgccggcggggcccggcacctccaggggcctccagctctgggtcaacctctcctcccacaacaagatgtgcgtcacgacccgtccttgtcatctccttcgttttttttccccactctcggatgtcgtgtcgctgcattggcatggtggtttgacacgcgtgtggtgcgtgcaggatcgagccggggtaccaggagatacagagcaaggacatcgcgagcacgacgtcggacggcgtgacggtgcgggtgatcgccgggcagtcgatgggcgcccggtcgccggtgcgcacgcggacgccgaccatgtacctggacttcacggtccgcccccacgcggcggcgcggcagccggtgtgcgcgacgtggaacgcgttcgcgtacgtgctggagggggagggcgtgttcggcggcggcggcggcgacaaggccggggcgcaccacctgctgctgctcggccagggcgacggcgtcgaggtgtggaacaggtcggacaagccgctccggttcctgctcatcgccggcgagcccatcggcgagcccgtggcgcagctggggcccttcgtcatgaacaccgaggaggagatcgacatgaccatcaacgacttcgagttcagcatcaatggcttcgagaaggccaagcactggaagtctcaggcgctggtggcgctgggcttagagtagtagggtgcaaccatgggacgacacgacatgtcgacatatgctctgaacgaagggaaaaaaaatggaatagttctttctctcatgatacgaggttgttttatttatttgttttttttctcttccaaacaaatagcgatcactttgtgtacatatccggcataaggttgctgcttgcttttcaattaggcaggtgcttcaaatcttcggcccaatgactaaaaatcatgtacttactccacaagttcataaacaagtccttttggactttcactgtgtctaatgcaagatttgtttttatagaactctaatgcacgacttcgattaaaatttttatcatgttatgttgacgaaatttttaaatgtgtccattttagaagtagtactggtaataattttttagtattaacggtcaaagtgtcaagaagttggcatatcgtggtatttttaaaagcagacaaagatatgatttgatttggaaccattcacttgacacctgtgaaatttatcttcaaagttggccgtcggagtggcgattctccggtagcggggaagtgcagaccccttccaaaaaataagatttgatcagggggttagttgcgcacaacgatcaagaagatggccaaccagaggtgcagtaccctaccctgttctttttgttggtatccggatatggagaaacacaaactttatcttttctaaaccagaaacaagcaaccctttctacgtagcatgtcccaccgagccccatgaaatttttcaatgtgtctgatttataagtactgcaataatttcttagtattaaccttagttttagatagtttgtatatgtagcatttttaaaagcaggcaaatatatgatttgatttggaaccattcacttcacaccagtgaaatttatcttgaaagttggcatatcatggtattttgcttgtttgccgtatgggactatatttatgatgtcacatttttttatgtttacaacgtcatattttataaaaagaaaaattgtacattttttacattatagattacgtacagtaatattgtaattacatagtaaattttgcaacataactttcaaaatttatactgtatgtttttctactataacctagattatacaagataattagaaaaaaaaacatcgccaggcgcgcaagatggggaaaaataacccatgttttccggcggtgcaacctccctagaggtgtttttttgaaggtccattagccaccttagatggattctcctcttgtcgcaacgcccttgccatcacaagatgaccacatttttgcacgcctcgcgagagatagcagattcattcttctgtctcgtcctcttcccgataaacccaaaggcatagatgaagttgagtgtattgggatgtcatgctcctgattattgtttaacaatgtgtgcttgagttgagtgtgttgggatgtcatgctcctgattattgtttgtgtgcttgtgtcggataagtggaaacaaggcttcccactccatcagctgcttggggcactacggggcacacgatggtcaaggcaaggactaatgtagggacccaagtgccaaagaaggtgactcgatgtcaacattagctcggggccaagctagcttccgttcacgaaaccactgcaagtaggatagggacccgaggttggcatcgaggcctgatgtctctctagatgaatctacatcatcaaggagatttgattcggtcatgtgtgtagccttgccctatcataattgcatcccctcgcttgcccacgttgccctggagaaaaggtgggcgacgcgacgcatgctccttgctcacccgatgtggcccaccctttatcagccttagtggctaacgagagggcccattggcagttgggacgaagacttcatctaccctgctccacttgttaggttgtaacaacactctctctagaaccgcgtaaccagcccatctgacgtgtgggcccacttacactttcatactcgattcgtgtaaaagggttaacccgagagttgtatggttggagggaagaagccttataagttggttccacccttgctaaaccagtaaggtggtactaaacatgcgcacacagctctcatgggtcacacaagataaattctaattggaccaggatgttacatagatgataggtgaacatgttacatccggttagcttgcttggagggacagcgacaagactaagcttaccatctcctgcggagttggggtccgttttttattgtatgcatggacgatgtaaaatccccttgatgtatgaaaggaggatccatgccattgagaatttttttttctaattccggttcaatcagtttgattcattctgattaagttagattctagccacattatagtgaagaagggttgatactctcccacttaaaacaacaccaataactcattgtaaactccatcatatagtcctagaaccataggagtagagtattatgcttcccagcgatccgaacctgtataaatcatgtgtccatgtactctcgcacgacctaagcatgagcacggatgcttgcactctggccgaactctcaaggaagggtgtctagccttcccactagaggagttccttgctccgacagtttgcgatgtaggcgcgtagagtgtagttcgtttgggctatggttttataattttttcttactctatcaatatatataaaatatcgtactctcttatgcggctcgtttggaaaattattataacgcccgaaacttccctatgcggttcgtttggaaaaaaaaaattacgacgtccaagactgtcctttgttgggcctgagaaacagaatacatcatcgacgtgtaatatgggccttatatgggttgtttattttggtccatgtaaaggatgtttgacgggactcacctcatttgccgctgctgccttgcatgccggccgccgtcgccgcacactcacttggaatttggaagcaaagggaggaggaggggatggagaggagagaggggcaaggtggaggaagtgggacccaccgacatctgggtcccattataaattttgttttatttgactggcttttgggcccatatattttattttaattttttaatctcaattgtagtgccacgtcaacgtcaagtgggacaatgaacaagttaaaccattcacataggcgccacgtcagccaaaatcactgtccaaatttcaaacttgtgtgacaaattgagagacttaaagtaaactttttcctttgaactgagtctaattggtccttttcggcttcaggtatggaaaacctcacaaatccaacctggtgacggattgggcctttactgattcggcctaacacaatccaatgaaatgaagacgctccgataagatgttctgaacttctgatcttcctctctctctctctctcggt

SEQ ID NO: 24209 - DNA, 15213 bp, Oryza sativa
aacctcgccttagctagtcacgtcacgtggcagccgcgatttcgcccgaaatttggttggaatctcgagctatcgctcccgtagcaaacctgctcatctcctgctcgattgctcgcaggcagcgatcatcaaacggtttacgcgcgcgtgtgcacggcgcgcggcgcgaccccgggcaggccgcatccggggcgcgcgcacagaaatgcgattcggactcgtcgtccaccgatcgcggctgccctggatgatgattgtcgccgccgaccgatcaatcgagacctacgtacgtcgtactcctatatacgtatactcggtactcgtgtcctgtcctcgcgtaatcggactaacgatgattgtgtctacgtgtggcgtcccgtctacttacgtgtaatgcgaggcaggcgcgcctttcgtgtaaatcttcgcgtgttccactctgtgtcgtcatcgatcccaagctaagctagcggctacgcggccacgagacgttattttcgaagtgttggtttcgacacgattgcaagccagaggcagatcgacattcaatcattgaggccgaatattcatttagcagacaggtcgtgttgttaaaaggaagatttggtaccttctgtccctgtttcgactcggttggaaccaacttttggatcgaatcgcctgcgaaattgcgaacagagagaagcaatagacggcgccggacccggctgctataggtttgacgtcatgcgctacggaagcagctaggaatgcgacagaagaatgtgagctagccgtgtgcatgcatgtgcctgaatttatgtgtgcgaatagagtagtactgaacaagtcaagcttataacgtgtacggctagctacatgactcgagctcgatatgacgatatgaatcagcaggagtcaatattcccggttctccctctcagccagtaattagaccttttttttcgcttaaactgctttagccagtaagcagtgaccatttgcctctcgcttgtaggagcgtaactcgagatccctcacgcaacaacaggatccgtatctcatccccagccagagtaagttgttcgatggcagacacgtacgtacctgatgacattatccatctactacgaccaggggaagtaacggaacgaagcaatggacccaaaacaaattatagcgagacagcctgcaccgatcgggaaagagatacgtcccctgctgcttcggtgggcttccgggccacgacacgccgcgatcccccctccctcctcatgtgcaggtgcatcttgccgcgaatgcatccaccagccgcccaacaaataatgctcgatcgatcgtagtagcggaggagatcgatcgatcgctttcgagccccccgaaccgtggaaattatttgtaaccgccgcgcgagcacgcgagaaacacaaaacgattaaacgccgccgcaagcgcgcgcgggtgcatctcagggaggcgccaccccctcgcgaccgcgaccgcgacgcgtgcacatgccgctgccaaccaaaccaacgctgttccgttgctcgcgctcgtacactcggtgccgccgatgcagatcgcccgcgcgccaccgcgcggcgtgggcggccgtgtgcccacgtcaagacgtgcgtggatagcagcagctagagatgattccgcgagagcgagtgcaaggaagcgtccgtgtcgtctgagccgatggatcgtgtcgacatgtccggataagacccgggcgccgtagtagtacgtgatcaattgcagctgctcgacgccgtgagacggccgtgcgtgcgtcggcgggtcgccccgtctccgtccgaccaaccaaccgcggtcggccagctcttcgtccactcaagggctggttcaagatgggggcacgagcatggcggaggacacatcagcagtcgatggctggagtcttatccgcgggtttgtactgctgaccgtgcttatctggatgctgacttgttaattaaaaaaggtcattaatgctccctactggtcgttggatagccatgaaaaatttccatgttactaatttggcttttcctggttaaataatatctgacgtggcgccttgattcgacgcgccacgaatgatcgatgatcatttgatcacaacctgataaccgcaagttcgcaacaagtacttttcagttttacaaacagtttctctgtttctgttcccgcgccggctataaaagcgccaagctttttgggacgctgcagctggagaagacgagaacgcaaaaccaatcagtcgtcgtcgaacgcggcgggcggaagaggcgaatcgcgtaacgatttttgttaaatttgtaaccggccatggatccgaggcgcagccactgggagagctcgtcggaggacgtgacgaggccgctgctcccgctgcacgacgacgacggcgcggcgggccggcgctcctgcgccgcgctgaggtcgctgctcgccaacaagtacctggcggtcgcgtcgggccccgtggcgtgcgcgctgatctgcggcctcgtcgacctcggcggccaccgcgccgcgcgcaacatgctcggggtgctcgcctgggtgttcctgtggtggattaccgacgccgtgccgctcgccgtcgcgtccatggcgccgctgttcctcttccccgtgttcggcatctcctcctccgacgccgtcgccaaggcctacatggacgacgtcatctccctcgtcctcggcagcttcatcctcgcgctcgccatcgagcactacaacatccaccgccgcctcgctctcaacgtacgtgatccgcgccgcgagcccgtctttaccaagcccgttcgtccgaaccgtgcaactaacaatccaaggaaaacccgcgaactttgttgcagatcacgtcgctgttctgcggcgacccggtgaagccgccgctgctgctgctgggaatctgcggcaccaccatgttcatcagcatgtggatccacaacacaccgtgcaccgtgatgatgatgccggtggcgacggggatcctgcagcggttcccgcgcgtcgacggggcgtcgtcctcggcgagcagcgccgcggacgcgcgggaggtgcagcggttctccaaggcggtggtgctcggcgtcgtgtacgcgtcggcgatcggcgggatggcgacgctgacgggcaccggcgtgaacatcatcctggtggggatgtggtccacctacttcccggagcagccgcccatcaccttcagctcgtggatgtcgttcgggctcccattggcgctcgtcctcttcgtcgcgctctgggccacgctctgcgtcctgtactgctccaagaacaccgggagggcgctctcagcttacctggacaggagccatctcaggagggagctcagcttgcttggtaggttctcgttcttgctctgtttgtttgttacttcacggcaatggccagtgctcatcaatggcgtggtcaatgttattctggggttatctctgaaactctgacagcttctcggccaatatttcctgaaacctgggtaactctgaaatggacctcgttttggtctttttctccataacagtggcactcattgaaatatcagtgccatgataattattgccataatggattctgattcggttgtccatcttgatttgtgacaggtcctatggcttttgcagagaagatggttctagccgtttttggggtaagttccgtttccatttctggggttatagcaattatctcaacctggaaacagtgttcggttagagcatctccaacaaagggctaaaattaaagccccaaaaatcctatattggggacagccaaaaactaatttggcctataaaacacccccttctccaagagatgcctgaaattttagttcccaaaattttaaaatttgccacatcatcactggtgggcccttctcaactaattttgtgcaggttcgttattatgacgcgatcatggaggggttcgttatagtgtgacaaaattttaatgtatccataattgattcttgcagggtttgattgtcctatggatgacgaggagcctgacagatgatattcctgggtggggatcactcttccacggcgaagttggggatggaactgtcactgtaagcgcaccaaggatcgaacaaattctgatttgttttctcagagacgatttgtcacatgatctcacgggacaacaacttggctcgcaatgcagatcatgatggcgacgctgctgttcataatcccgagcggcaagaacgacggcgagaagctcatggactggggcaagtgccggaggctgcagtggaacatcatcctcctcctcggcgccggcttcgccatcgccgacggcttcagggcgagcggcctgaccgacatcctctccgaggggctcggcttcctccgcggcgcgccggcgctggccatcgcgcccgtggcgtgcgtcttcagcggcgccatcaccgagttcacctccgacgacgcgaccgccacgctggtgctcccgctgctcgccgagctgggcaagtccatcggcgtgcacccgctcctcctcatggtccccggcgccgtcggcgcgcagctgtcctacctgctgcccaccggctcgccgggcaacgtcgtcggcttcagcacgggctacatcagcatcaaggacatggtgatcgccggaacgcccctgaaaattgtcggggttgcagctctcaccatcctactgccaacgttaggtaaattaactgacaagtgacaactctctagtctctacacaaccgagaattcagacagtgaaaatacttgccgtatcatacttttaacttactgattgacgtacaatccttttgcgttttcgcgaaggaaaaaacttactgatttgttttcttgatgtcatgcaggatccgtcgtttttggcatggatcagaagctatagaaactttagtcaaagttcaattggatgttttttgaatatttcaatttgtaggctgtaggttattacgtggataatatagtagtaagttgcataggttgtattgttgtacagcgtgtagtcaatcccattgtcttgcctcatgaaaaacatggggtcatattctttgagtcaatataggttgtatttgtattgagttgttccatgttaatatatctttcgacatcgtagccccatgttgacattttgatctacacgtgagtcgtctgaagaataacttaaataacaagggaaaattggtttcggttacaaaagtaggagagcagaacagggaaattgggatagagcttagcagacagtataattgctcattctataaacaactgcataatgaggggcaagttgcagaaagtcctaaactatccctttataattgaccagttgcctagtcatttcaacattgccacaattggaatgatgcaatggaccttatcatccagctagctactcctataaaaaatttgtgatattttctctgtatcatattccaagtaggacagtatattagagcctctacttacaaattctcaattgttagaatatttgtactttacccacctacatgtgcttttgcctttctaggatcaagtacttctctgcccattataaagaaaaaaaaaggtacttctttgtcatcacgctattgaggatgtcattttgaacgcatgaataagtgatttatcatctcccacaagaatcatgctccagacttcagagtcataagttatgtgtcattgtgtcgtagtggagacgaaccttcatctcttagctgcagaatctccaagaggatctagacaatgctaagtgcctggataaaatatgacctgcacatatggccgggcaaaaattcgtgtttggttagtttgctcgactcaagtcgactcatttccatcttgtaatgagccaagatagcattttagctcgttattaagataagctaactcaggctagtccacaagctagcgagccagctgaaccgcgcaggtaccacgagttattccgtggttttaaaaactgaaaaggttatcgcaaatgataaccgcacgtacggttttgtaaactctacccgtgagcccttgccccaatcagcccatcacccacaacaacgctatcctacacgcctagatggccatgactacccccacactccttataaaaaaaacgaaaactaatttcattatgaccaggtcgaaaatctttatgttgaaaggaaaaaattatagatctaatgtcacattccgtaaaaatttatgatacatgtataggatgcactcaatgtgcacgagcttgtccaataaatgtattacaaatgataccttgggatggatgtaaagccaagcaaattgcttccgcaccaagaaccgaagattgtgtgggttgtaagagatgcgaatccgcctacccaacagattttttaagtgtccgcgtttatttaggacctgagacaacccgcagcatagctctatcttattgatacgttacaaaaaaattccacttgaatcgtctgattcctctttactgaagaagcatgtgctcaaaataatcaagcacgggcttttctggtcgttgctcctgttactcgcgctgctgtctaagtccatcccctatgcctcttgtccccctcttgtcccggttctgatcggggaacttgtggttgtgagtcggaggttggagtcacaggtcattgacaagcatcgatgggcccagtgacggagtcagcggcgtcgtcaagttcaggtgactattagtgtttccgtgattgattaatttttatatgtagcgtcgtcaagttcaggcgactgttagtgtttcccgtgatcgattaatttttatatgttttggcagctattgacaatgaagacgatgacgatagagtccgagcggtcacccaacctgcccgtaaagtggctccgccactgcctctctattctcagtctacatggaatgccacaagcaaacgagctgatccacgaatccacttaatgatttatccacttaggtcctgtctgtttcagcttaagattattgtaatctagattattaaatcagattactctaagctgtattataataagctgacataaaaataagctacgagttgtttgtttatttggattattagaggcatctaagggtaatgggtctttagccactcaataatctggaaaaagctcctctaaaggagattattggattatagtaatctgacttatatattataataatctagcataataatctacttgtttgttccagcttactcctaataatttagattataataatcttaagctgaatcaaaccgagccttatttaatggtttcgtggatcgatccacttacactcttcgctgcaaggtggaagcgcctccgtaggtggcgtcgcagctggcggaggtcaattgcgagaggcagcccacgtgcatcccgcgtccactcagcccaagccaaacaaaagtccaagactccaaaaacgtggggttggtgccacgggcaagcccgtttagttacacctccctttcagcccagaggtcctacctaagcacaaccagcttaaaaggcccaaaccatgtcaagcaatctggccactcaagtacaacgtgattcctcctcttcccatggataccaccgtgctctaccgaaaacacagatcaacggcacggactcaaccgcgaatctcgacttgatcgaccggcgcccgctgcacgccgtaacgatcaggaagcagacacgacgggtacacggacaattggacatgttgcgccgaagcatacgcgtgaggtcgagcgggcgagcggccaacttgacatggtgggcggcgttgccgtgttgccgcttgcgcgcgccgcgcgcgcggcccatgccgaccgatgcgcgcgcggatcgtggcaaaaatgaaccgagtaattgcccgcgcggcgcggatggttcggggcgaggagatatgccggcccgcgcggccccatgccccatgatgccccggctgcatatgcctgccgcgcaccgccgcgatgcccgcggcggaatgtcacgaacgtttttggtggtctggctatgtgttttccggtgtttcttggggcggcaatgctgcatgcggcaggccggcagctaagctagcaggcgttgtacagtatcatgcatggcttctgccctctggtgatcgagcagatcataagagcaacggcatgcagagcagcgatccgctcttctcgccgagacgacggacgaccggctgattcctgcatgcctgcgatgcgagcccaaacgcgcagacatggaattagtacttttttcccctcccaataagagggcgtgaggactgcctctttctattgactacaaaaatattgagccttcaaaaatacctagcccaaggcatatatatatatatatatatgtaaaaaaaaaccccttgtgaatatcacatcaatctctgtgctagacaaccaaaccatagtgtggagattatgggtaccccatacccacacggcatggttatccgactagttatagtggataacttatatatatggaatatgtaacagattatgacttgggtattacgtttccttgtatattacggaacggcctaaagccctggtttgataagattgtaaagtagatttaggaaaccaataccgtattgaataaggtttctatcttgtaatcctgccacccatcctatataaggtgggcaggaggccctctagggggcatgagacaactagatcgtcagatctataattcacctggcggattcaaatccccaaacaggagtagggtattacctctcattgagagggcctgaacctgtctaaatcctttgtctctgcatccatccacttttaggtctcgtgcgctacccccttttattattgccgaattcatgtttcgacagttggcgcgccaggtaggggttcgtcgagtttcctatcacaagtgtgatggaaccaatctccgacatcgccggattcatcaagcatgtctttttcgtctcggattcaatccagtcgaagggatcaatctcggcaatttcatcgattcgatctccaattaatatcattggctttgtcgttttcactagttagatcattctctaactgcagactaatcttctattacttttctttttcttgttttcacgcaccggctgagatcgagacgaagtcccggtgtgtctgctcgtcgcctggtacgatctgtacaggtgccggcgtaaccttcatacgacacggggacaattcatgtccatgggatcaacagcgactgagtgcttcacgtgcatgtgttgatcaactgatatgcacgggttaatatcaaaccctagcttgatatatgcattacacaattaagcgtgtaatattttaaggctaatcaaactatatctgtttgttttgcatgtatactggagcgatggttggtcgcatgcacaggatggcaatcgagatcaaaaaatcgttccttaatgagtgatgggatttggctgtgctgccggttcctaacctccttgtaatttatatatttagattaattactaacgtatactaatcttctcatgattttttattgcatgtacggccgtcggtgcaatgcttcccactgctaccatgttgccgagaggggtacaccaggacatagtgcgtggctcgactaccgatgtagcgtttgctcatgccacacgcaacctctaaggccggttagctgcaccaagcccataatgtcaacaaaatcagagagacgaatctacatgcaaatcagcctcgcctatacggttggttggtcacgccgtcgttgttgggcgtctacgtcttcaccgaccggcttgccttcgttgccgccgactggtgtcaccgcctgcacggctggcctattatgccgccgctgttgggcatctacgacttcaccgccggcctgccttcgccgccgctgactggtgtctccgcctacacggctggcctattatgccgccgttgttgggcatccacgtcttcaccgaccggcttgccttcgtcgccgccgactagtgtctccgcctgcacggctggcctattatgccgccgctgttgggcatctacgacttcaccgccggcctgccttcgccgccgccgactggtgtctccgcctacacggttggcctactatgccgccgttgttgggcatccacatcttcaccaaccggcttgccttcgtcgccgctgactggtgtttccgcctgcacggctggcctattatatgctgccgttgttgggtgtccgtcgactggtgtcctcgcctatacggttggttggtcacaccaccgtacatgggcgtctacgtcttcaccgaccggctggccttcaccgctgccgactagtgtttccgcctgcacagctagcctattataccgccggcctgcctctgccgccacttactggtgttttcgcctatacggttggcggacttcgccgccattaatgggctccatcatctacaccactggcttggttccactggcgccgactggtgtttttgtcaccattgatggactgcttcgttcccacatcggctacttttgctgtcaccgaggaaatacgacaaagctaagtcatcatttatttttattctttatatgatattttgccttttcctttgcctcactacatcaactggttcgccgttgactagtgagtcgggggctacagatgttatatcatattttttaaacaattttcataatatttatcttgattgcttgcgacatattctgagtacaaaagtgcctatcgagttatggagttccatcttcctatgctttccgtttggtttgccaatggatagttgcctttgggccgattcctagcacccgggggcttgttggatggaccgaataatgcaaggtgctaagtattattcggaataaatcaaaagtatagagataagataatttattttctgctcttaataattgcaaaagtacccgagtagtaaactccgacccgtgaaactttgttccattaatgacgaactcatgtcactcatatgcatgtttgggaagtgcttaggccgactcccggtgcttggtggctatgactagtcgggcagagtgtttaaacgtaatgagtcatttgctcggggaaatcaaaattgacaagagaagaaatacatatttataaatattttaaaatacttgaatttttctcgagtattatatttatatcagatactactcatcctatatgtttgttctgcaggatccagatccagatatgtataaaagggattcatggctttaagcttatctcttacgctccaggaatggatcagtcagaacatcaccaccggcttgtgccaactggtgtttccgcctgcacggctggcctattatgtcaccgttgttgggcgtctacgtcttcaccgatcggccgcctcatccgccgccagctggtgtttccgcctgcacggcaggcctattatgtcaccgttgttgcgcgtctacgtcttcaccgaccggccgcctcgtccaccgccgactggtgtttccgcctgcatggctggcttattatgccgctgttgttgggcgtctacgtctttaccgaccggccgcctccttcgccgccgactggtgttttcgcctgcacggctggccttttatgccaccgttgttgggcgtctacgtcttcaccgaccggccgcctcgtccaccgccgactggtgtttccgcttgcacggctagcctattatgtcatcgttgttgggcgtctacgtcttcaccgaccggccgcctcgtccgccgccgactggtgtttccgccgtgcaccaccaactggtgtttccgcctgcacggctggcctattatgccgccgctattgggcgtctacgtcttcaccgatcggccgcgtcgtccgccgccgactggtgttttcgcctacacggctggcttattaccgccgttgttgggcgtctacgtcttcaccgaccggtcgcctcgtccgccgccgactggtgtttccgcctgcacggctggcctattatgccgcctttgttgggcatctacgtcttcaccgaccggccgcttcaccgaccggctgcctcatccgtcgccgactggtgtcaccgcctgcacggctggcctgttatgacgctaactgatgctatcttcttcacggctggctacatcgccgtcaccgctaataggcatcagcatcttcaacacaagctgcctacgtctgctgccgactggtttcttcacttccatggctgcatgattctgctagtgttgattggccttatcgtcttcatcgccggtcgtctcgtctgctgctgactagtgccctcgcttctacgtctggtttatacagctaccactactgatggacatcatcgtcttccgtcgtcgactggttatgtcgccgccgactggtgcttttatcttcacaattgcgcgtcttcactaccggtttgcttctgttgccgccaactcatgttcacttcatcacggctatgcaactttgtcactatggtggagcaacttcatttttattatcttcggcatcggcaaactctattgcctctacttcgcaagctttgctacttcaccaaccatgacgactacaagagtttcaacaccttggcatacgtcaccaaatatgatgccgtgttattttattacaacaagtggtgttccaatcttcaatatttatcttcactcaagcaatgactactcgacgacaagaagttacagttctcgactctatgttcagttgtttcccaactaaccaaagagtcgggggctacacaaatacaagactctcaaaattcgacaagctgaagcaatcaattaatcagccaacaagtcaattccaggagtcattatcttcgtctttgctttagagcagagttatcaaccaatcagctcagtttcgacgagttggacaacatcatctactttccttcaagtgaagcatctgcaacagctataacatcaatttgatggattattgtcactgacatcatcaccaacacctctgcttcatcggccctgacatcaactctgttgctaatggataactatgtcttcgccgacttattatttcactttcacggttgctatcgactggatcaccgacatcgttatcttcatcaacatcctgtcaagcctcttcaacatagcccactctactgctattgatgggcaacttcgtcattatatttgatcatctatgattgctacttatcatcattactatcggttgcatttgtcgtcgccgactattttcttcatcttcatgattggtggatttcgtcatcgcctttgatgcgtgtctacatcttcaccatcggcttgctttcgtcaccaccgaccggtatcctcgccttcatggatggcttattatgtcgccactaatgggcatcttcatcttcttcaccagctgcatcgtctgtcaccgactgattatttcgctgccatggctacacaactttatcgctgggcgccttcatattcattgctggctgacctgactgttgccgactggtttcttcgcctccacggctatgcaacttcatcacttttgattggtatcactatcttcactactaccaatatttttgccacctctggtgggcaatattatctctatattggtcgtcttgtctctatgccaaccgcgtcagctaccatcaatggacaattgtgactacgacagaaggacaagctatatactcaggggcttactacctcaaacacaagtatcataccttcaatttggacttgttccggatacatgcaacatgaatttgatgatcatgggtctattttctatgctcaaagactggactatttattattccccgtaagggttatcaaccgaatacttgcgctagtcggaattcaattgttatatctattttggagtatcccataaaggataatcactcagatcagaagctattcatatgagttacacttggtctatatcacccgaaagatttattactcaggagcatgttacatgcgtcatcctttaaagggtgtcgaaggcatattttttggcctagacctaatatgtctgcagcccatattttcaggtgtggcctgtcacgttcttttagggacttaggcatctttttgcttaggcaaaagtgcgcgtgattatgtgcccaataccttaaaatccttttataccgcagttactcaattttttaggagttggtacaatgcattttaaaaggtgccaaacagtaatgctttatatagctccccactgacttttttatataagtcaaggtgttgtttgggttcataaagcaattgattggatacaatatcattgctttttgccacgtaagtgtgcacttttattgaccaatattatggcttaggctgattatatattttggtcattttccaggcggttggtaaatcctttatgagtttatttactcggattttataccacatatgccatatatttccaggtgtggtggaaccatgtgtcttctagggacttaagcacatctgttaaagcagtgtgcacatggcgtatgcccaatactttggaaatttctttattcacaacatataagcttctttatagctgttttgctatgtgaattttcaatgatgtagccaactttaggttacactcatcatattttacaaaacagtcggtatatcactcggatcatgttattcagggattcacaccgcatatgctacatattaatatcaagtcgcttggttgactataattatcgaagccactcggttggttggattatttattacttgactatatgcttggtttgttcaattaaccacatagtcgagggctacacctattaggtgcatctagtcgatgcacctgactttatttttcagcccttaacagtcttcagatttggtaaaagtactcgggagaccatggcaaagatgattgaagcactcggctttggagtaatctagttcgagagaagattatcttttcgattgtgaaggtctcaggggctactgtggagattatgggtaccccatacccacacggcatggttatccgactagttataggggataacttatatatatggaatatgtaacagattatgacttgggtattacgtttccttgtatattacggaacggcctaaagtcctggtttgataagattgtaaagtagatttaggaaaccgataccgtattggataaggtttctatcttgtaatcctgccccccatcctatataaggtgagcaggaggccctctagggggcatgagacaactagatcg

SEQ ID NO: 24210 - DNA, 656 bp, Oryza sativa
cagagtatccctgttaccagtgaaatgcaaatagaagggcagacctaaccagaatgacaaatttttagctgcagcgctgaccgtgaatatatgttccaacttaagagttggagtgactaagcatgaatactgacctccttcatgatggacttttcaagaagcatgtcctttgggagcatcagaagatcacttaactcgttgagcagcttgaaagaataaaaatcagcagcaccacttctggtcatcactctcatctcctgcttgaccatgcttctcaggggcagcagcaaccatgccaaacttatcttgcaaccatcgggacataataggccagccgtgcaggcggaaacaccagttggcacaagccggtggtgatgttctgactgatccattcctggagcgtaagagataagcttaaagccatgaatcccttttatacatatctggatctggatcctgcagaacaaacatataggatgagtagtatctgatataaatataatactcgagaaaaattcaagtattttaaaatatttataaatatgtatttcttctcttgtcaattttgatttccccgagcaaatgactcattacgtttaaacactctgccggggatcctctagagtcgacctgcagggggatcctctagagtcgac

SEQ ID NO: 24211 - DNA, 849 bp, Oryza sativa
  unsure (1)..(849): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggggctccgctagaagccgctactgtagaaccaggagcacatgatcttgagctccagctccgacgccgcctcagccgcgtcagttttgccgcgcccccacgctgtcgtcgacgccacctcgtcgtccatcatatcgaacattgatgcggccgcgataatcgccttggcgctccccgacagcgactcttccggggcggccctcctcttgccccctcatgtagccacaccgccccctgcggcggcctcgactcttgcgccgccgcttcatgactcactgcatgacgccagcagggagcctgacggtgacgaggagcaggatcgctgctcccttcctcctcctctctccctcttgtctggggagggcggccagtagcggtcgacttcgtcctcgaactcgccggcggcggcgagctgttctccctgccggcggagaaggatggagaaggcagtggagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24212 - DNA, 704 bp, Oryza sativa
tgcaccgttgcactacagatttcatttatatatagcctaattacctctgcccaattgtctgtaagatccagaatcatatatgattggccttttctggccacaactatgcatacatttaacacctgaaaagaagaataaatttaaaggccattattaattacacgtggaataggatatattcaaaccagcattcaaggagcgaacagtattactatagatataggcggccttaccagcaagttactgttcaattagctagtggcccgtgcaattcctgtagatgatcgatgtgagattgcgagtgagtgctaatcccaagccagtcaataaatcggggagcatggacagatccagtaccattcatgttcaataattatacatgcattgattggaaattagaggaattaatcttaattattgttcaggctaacctgaactcaattaattagcatagctaactattgagcagtacaataatactaataacaaaagatgctcacttggaaacttgccagtatatagaacaaacagaaacttgatagaactaatatagttaattaatgaaataatttcaaattaatcgggaaaaatcattagctcaagagtcaaaacctagttgttgctgaggaccaccactgattatattgactagtcaacccattccgtgttagtcttcctctagaaatagctccattaatatatta

SEQ ID NO: 24213 - DNA, 1234 bp, Oryza sativa
cctagtttgtttggtttgaatatagatgaatgggtgatagattttctaattttgtgatgatgttcgataaaaaatcaatctagatgagatgtgacgtttcctagtacaatgaatatggataggaacatgtccaaattcaatatactacttcctccgtttcacaatgtaagtcatttctagcattttctatattcatatatatgttaatgaatctagatagatattcattaacatcaatatgaatatggaaaatgctagaatgacttacattgtgaaacgaagggagtagaaaacatcacatcttattctaaattgattttttatgggacggaggggatacaagcgaatggattaccattattacaaagttggagttgtttcaaaataatattttaagaaaattatatatagaattctttatatatatatatatatatatatatatatatatatatatatatatatatatggtgttcttttctcctgaaaatgaagatgaagattaagttttttacgcaaaactaggtggtattaacgtatgattgattgagttttaattattacaaattttaaaaatagattaatatgatattttagagcaactttcatatagaaagttttctcacaaaacatactgtttaacagtttgaaaagcgtgccacgaaaatcttaattttcatccaactcttgttgaagaaaagaacatgactatatatatcggttaggagcttgggaagcatatgccatggtaatttgttacaagagaactcaactggcctaggtaaaaccgtgccacaaacagtgtcggtagagcatgaaatgccctcgcggtgagccggtgagtagtcgcaacgtctgcatcgctgcatgtcatcttatctttctctgcctccggccattcttttggcctaaaatttctttgtttggcagctgtaatgggcgaagcaatgcttttaatccgataaagctgtaatgcgagacaaatcttcctttagcatcatagttctttgtctccaagaacattccatttccaccgtccaagtgtcatgtaacgtcatcacatcaccctcatactgtcatacagaaaaacttatataatcacattatttttactgacatgtggggccggctccaaaaggtcccgcacaatggcagctggactatagtgaagtcctttccgcttaattatgccttggcctcttgtgtgagcagctaaccatgcaagcgaagcgtc

SEQ ID NO: 24214 - DNA, 1929 bp, Oryza sativa
taaaaaataattgattaaacataattgaaactaatttcgtaagaaattcatatatactaacaaagttttctgtgaaaatattactatttagaagttcgggaagcgtgccgttaaatagaatggtttcattccttataaaagaacatcaccttagtgggattgaatcggatgtaatttactctgaaaagtttcatgggcattattttgttgtttgtgtgaatttcacacaaactctaccactccatggtgacatcgacaacaaataacaatagatctatttttgcggggttgtcggtgaggtcaagggggcgtcgggggtgatctcgccgcgcctcttcgacgccgtcctccgcccactgcggcgtcgcctccgtgcgcacgctccccgtcgctgccggcgccggggccgctcccctcctccctcgtgctcctcgccaaggtctccatcgcctacttctcgtgagccacgggtgccgctgtccttgcccgctgctcctgccgcctccttgccggtgagcgtagatggatcctccgctgccaccgtagaagcagaagaagctggcggtcccggtgcctcgactgccgcaacgccgacgacaacctgctctggaacctctacctcctctccatcctgatacctggtaccctggtatcaactgatacctgttaccctgggtatcgagctgatactaggtatcaagccttggtacctgggtatcaggccttgctacctgggtatcgactgatacctggtaccctgggtatcgagctgatacctaggcatggtataccatatgcatggtatcaggtaccagatgcctagtacctaggtaccatccatgggtaccatgtgcatggtatcagataccagatacctatagttatcaagtacaacctggtacctgatacctattgtacctagtaccacaggtaccaggtcaaaggtgtgggaatggggagcacgtcgtgtcgccgtcgccgcctggctgaccggtggccacacgttcgttgcctcctcttctattctcccttccttagttcctctcctcaacgtttctcttctccttctgttgttgttgctgtcggtgggggcaaagaggaggatttagcgggggagttgtctgctgctcccgctgctctggggcgccgacgccgacgaggaggtgtgtgcttctccagctgcaaaggcaacacaacaccggcaagggaagcgtgcgataccatgaggagccggctaggtatcatgcctcttcacgttgacaacagggacgcaggacgctatatttttattttgtcgtgtgttttaattatcccgtgacatcacttttccacggtatcccgtgggctagctgccctcaaaatgaaaggcacaatgagacaaagacaaataaaaaaaaggttcacgattataccataattaaacagagaccacaaatatagatcagagggaccgcataaaacaaagaggagacctactgaatttattctagcgcatgatagtgtttttaagcaaggaattcagttgatattttttgtttagtaagataaagaaataaatattccgaccactagatctacattctacggtgtattatgaccattttagtagcaataacactgccaggtggttagtggttaacctgggctttctgccgatttttttttcaagtagtcctgattttcacattttgtttgtactgtttgaccactcgtcttattcaaaaaacttgtgcaaatatataaaaaaggaaaagttgtgcctaaagtgttttggataataaagtaagtaaaaaaaataattccaaatttttttttgaataagacgaattttcaaacagcgtaaataaaatgttaaaatctcttatattagaggacggagggagtatagacgtgttaatttggagtgttcaggggcgtacaatgtggagc

SEQ ID NO: 24215 - DNA, 7775 bp, Oryza sativa
aaaaaggaaaagttgtgcctaaagtgttttggataataaagtaagtaaaaaaaataattccaaatttttttttgaataagacgaattttcaaacagcgtaaataaaatgttaaaatctcttatattagaggacggagggagtatagacgtgttaatttggagtgttcaggggcgtacaatgtggagcccagtgagcagcgattgctgcgacggtgagctggagtggtcacgttgccgccggcggccagccggccggccaccgtgtgtcctgtttggttctcgccgttgcacggctatcacaccggcggcgcatgacaagtgagaaccgcgtgtagttttgtttaatcaccggctaaagagagccgcctaatccgattctgtgacgctggtggtgacctactaggctaccaccaccgacagcctctgcctggaatgaccagggtcggggattcccagagaccactgaccagtacgttcacctcatgatccaagtgaataatttcgaattcttcgtttcctactccctccgtccattttaatgcaattataagttttttattcaactttaattattcatcttattttaaaaaaattataattagtatttttttattagatgataaaacataaacaatactttactttacatatgacttatacttttaaattttttaaaataatttttaaataagttgaacgattaaagttggacacgaaaactatatctatatttaaaatgggatggagggaatatcttttccattatcactgctttttattaacggtcattatcactgctttaattgttgccttgcaagggaatgttttgctttcttatttatcgttagcacgttttctaatctcataaacaatactccctccgtttcatattataagacttgttagcattgactacatttatataaatgttaatgaatctactatgggtacgctggtacaaggatctacgtaatacgacatcaagtaggcagaaaacaaatattataccggttcaggccccttgataggtaatagccctaatccaattgatatgagattatatgatggaaaccacagattacaagggggatagtggaactcgacgataccgacgagatcgtagtcgagttgattcgactagatcacccggcgacttggctcctgtaggctccggcttcgtaggctgtggtggttgccttgattatgagattcgatgccttaggtcctcccggggggtcccttttatatcgcaggtcaactggtctccaagtaggactcggagacatcggacccagcacgatacaatgacgacccagttctgtccgagtaggactccttccatttgtgaactccatgatgaatttccttaacgtatgccaaaaatgtccgtatacgcatatgtataccatatcgatatgtgacgtatatcgaaaggtagagggtataccttacccgtaaccctgacagtagcccccgacttctgcttaaatgaactcgtgtaaccgatcgtgacttctgatgtcgaggttgttgttgttctcggtgtgaggaccgagggataaggagtgatcgacaacgccctgtgaagctcaatggtcatgagtgaatttaaattgaagtccaaaaaactactgcgcgtaatggacccagaaatttccggcggtaatctctctcctttccttggaattcgcaccatcggaagtgcgactatttaagggagttttgcggatccaatttgaagtccgccggttgtgaaaaaactctccagcctccaagcgtccctcgtcttctccgcttccgcaaaaaccctagctagctcgtctcggtcctttctccggcgaaccccggcggcaatggacctcgacaagtctacctccaccagtgcgtcgctgaagaagctataggaggatggcgctcttcccggtcgcgggaccatggagagagaagcaggaggtactgaaccccagcctgtcctgggtcgcatggttgcgatcgaggactatattctttatggttttcttcctccgccttctgaatttcttctcttggtcttgaatttctacagccttttcttgctccatttgaaccccaattccatcgccttcctcagtatcttttcgcatctttgtgaggcctacattggggtagagccgtttcttgacctcttccgtttttactatgagttgcgctggatggaaccaaaaaaggtgtccggatgtgtcggtttccgacttcgggatggcctgaagtcgcgatacatccccttccagtgcccttcatctcgcagcaaatggcgggggaggtggttctatcttcagatagaagattcggatccggtcttcattgtttctaaggagcaaccagccaagatttcatcttggactgccaaacccgccttgaccccatccctcaaatctttcgtcgatatcattgatgacctccgagaacgggggttgtcggggtatgaagtcactaccgacttcattggtaggcggatccagctgctctaggcttgagcccacccagcctttgactattctaggccggaggacgcgacccgggtttctcctcggggtattttttttgtagttgaattgactcccttatgtgcgtgttcctcctgacttatcgaattctggtctcgatctataggcttgaacagcgcaaccgtgaagcgtcgcgtcggccaattgatgatcagcggcccgacaacgacgagcaacgtccccgtccccctttgcgagaagggggcagtcgaacgcgaagctgccatcaatgtaagtgtactcagcggcccttttgcattttacttccgggatcacattgtgacttcatgaagcgtaggctctccctctgactgatatcatcgggccgctcgtggatcatcaggcggcggcgtcgctgaagggaggacgtcgccaagggaggcgctccgatgcttgctgtccgctggctggccatcaacgaggtgggtgaggcaacgcctcacctggatagggcgctctggtgcaggggaacgcttctcacgcacaaggggtgctccagggcgtttcgcaaggtggggcataccttcgctccctgcggggaccgacccaaccggtgccccgcgtgggcctttacgcgaattccccaaaatttcccgggcttccgatgattgtgccttgcggtacacgtgtcgaacctcgatcccatcgaaccttttttccagtttcctgacttctgcgagatacgtagataactcggggctagagcacttgtaatctttatgcacctggttcgtgactagttcggaatcccctttcacgactagtcgcttgactccgagtgcagctgcagctcttatcccggtgagtagtccttcgtattcggctgtgttattggtcgccctgaagttgaggtgaattgcatgcttgaattgatctcccgaaggtgacgtcaagatgaatcatgtccctgctccttggctgttgagtgcgccgtcgaacaccattgtccacgtttcgttgttgatttggttgtctgacctattatcaggcatagtccaatcggctacgaagtcggcgagtacctgggacttgatggttgttcgtggcacaaagtggacatcaaactggcttagctcgactacccattttgcaatgcggccgacaacgtctttgtttctcacgacttcaccgagagggaaggaggatacaactgtgaccttgtgggcttggaagtagtggcgtagctttcttgatgtcatgattaccgcgtagagcagttttcggatctgtgtatatcttgtctttgcgtcgtggagagcttcgctgacgtagtagactggtcgttgcaccttctctctctcgacaacaatgacagtgctaacggaatatggcgtggcggcgatatagagaaataattcttcattaggttggggggcaacaagtacaggtggatttgataggtagcgcttgagtgcaatgaatgcctcttcggcttcctgtgtccatacaaatttgtcttgcttcttcagcagagcgaagaaaggttgtcctcactctctcacctagcgatgaacttgcttagtgccgccatgcatccggttagcttctgtacttcctttagtcttgtaggcgacttcatgttttcgattgccttgatcttttcgggatttgcttctattcctctgccagagacgaggaaaccgagcagcttgcccaatggtactccgaacgtgcacttctctggattgagcatgaggcgatatcgtcggaggttgccgaaaacatctgtatacgcgtatgtataccatatcgatatgtgacgtatatcgaagggtagagggtataccttacccgtaaccctgacaatatgaaacgaaggaagtacatattttagaatatatatatatatatatatatatatatatatatatatatatatatgaaggttttttggaaaataaataaatatatttttcaagtgtataacatttattactcaattaatcatatcctaattacttccatccgaaaggctaaagcaatttgcagcctaagtcaaagctaaaatttaaaattttaaacttaattttaaattattataggtgctttttaattttaatttctgaacttaatttgaaatcactaattgtagaaatacaaaagtcgtatccaaaattatgtttcgttgccgctattaggcgaatccaataaacgtaaccctatatattctgaaaatatctttaaatatactacctctgtttcaaattgcaagttattttaacttttttaagtcaattaaatttatagaaaatttacctctgttttaaattacaagttattttaacttttttaagtcaatcctctttagatttgattaaatttatagaaaattatagcaatgttttcaaccaaaaaaaaaactatcagaagctagacgtaatgaaataaatttagtgctatacgtattgttatatattttacaatcttgataaaaaataaatgacctagcacttcccaactcacttatttctattgtgcgcgcatgctttttaaattgctaaacgatactttttttttgcaaaataaatccttataagaaagttgctttaaaaatatattgatatttttttaaaaaataactaatatataattaattatgtgctaattaaccgttccattttccgtggtgcacagcccttataatataaaagagggagtacataataaaaatttaaaaaagactcgttatttggagaaaaaaaatggttgagatgccgtggaaagcggcaggtaggctgaccgcgtgcggtgaaccgactcgagtcgagagagggtgcctcgaaatgcacgttgatataaacagcccgcagcgaaaccaccccaaaaaaccaaaaacccaccacccccacgcggtgccactgccaccgcccctcgccgctgacgaccgccgccgccgccgccgcacggacattccgcacacgcccgcggggggcgggcggcgccgcgtcgctgatccaacgcgagcacgttcgtcgtccatccatcctcccgctcggatttggagtcggcaaccgctcgggctcgcgtcgcggcaactgaagcggcgaaattgcaacaggcacaggcaggtgaggtgaggagcattctgatatattattatttttttttgcccccaccacctccgccgttccgcttccccggcccgaatcatcatcccccaatctagttcgtgtgcgctgttgtgcggtgtgggatttcgcggtgtcgtattggattcgatattgggttggttggttggcctcgtttgctgttttgattgttgattttcttctcctctaataactgcacgcgctgatcgtttctgtacctgcgacatggatgagatgtccgcatttttttttgttcgtaattggggaggggaagctagccgtatagccgattgttagtatgttttgatccgcatttgcgcattgatcggagatgatagttttctcatgtcacctttctgtttttttttcctttacttctttcgcgcatatgattggcttgaattctcctgcactagcggttacctgataaaaaaaaattctgcgcgtacggagcatcggaatgtgaatttggggaccatcggtggcatccgaaatttgtcaatatatatacactagtatgtgttaatcttgaacttttacatggtgaattgctctagccatttgctccatccatccaaagtagtatcactgcacttgcctagtatttagctgcttcgtgtggtgattggtgaatgtgggcaatgactaggaggacttggggttatttggtatggaatccagtactggatagctcactgtcactggtggccagtatgcatattcatcatggattgtggttagctttttccaaatctgcggcttgtcagatctgcctgtattatagttattgtacagctttatgtctggggctctttcgcgccgttgggacctcaaattctccaatgcaatccaagtcgcatgatggtccaagaccagcgtgccccactgccatgtgcttaacaaccaccttcttcctgagatcgactggacaaggaagcataattgtactgaattctcgtgttattacgtcggtttaaggtgaaaaatcttgcttgagatgcttctttaaggtggagattctgcttagctgtacagctgttgagacaagctggagatcagttattcatttgatgtcctatcacttgttcaatgttatgaagttatgaacatgggcttcttagcgttttactctgggtgcagtgtaagttatttatcttctctgaacttgtactgcacttgtagtacattttcttgatctcttcagttaaagcaatttatgtacaagctgttttgtgcgtgactttttcctgtcataatcattatgttgcagggtcggaccacccttgaaagctcttttgctatcttgctcattgacctgatcaagttgctagacctttgctcttgttactaactttcttggtgttatatacaggtatcaagtttctagtgcactaaacaacctttgagatgggtactgtagagaatatggaagggagagaagagcgttcgactgatgtggaacgggatggtaaacaaggaaaagaagttgaatcggactatgaaccagctagagactctgtttcatctcagggtgaggctaacagcaatgaagataccagagccaaaagagtctcaagggttccaaagaagctagtgaagaaagattcaaaggaaaacagcccacgctcaggcagaattaattccaatcgccaagtgcagactaagctgcaatatatatcgtcaaacaatttgcagagcaaatctccaaagccaaacaaaacatctgatggtgctaaaaccattgagataacaaagccagatacagtgacagttccttcttgtccttcatctgaggtgtctgaggagatggatgataaacccattgagaatatagtgacggatgataaatccattgaggatgtagctgatgataaggccactgagggcacggcctcttatgataaggccactgaaggaaaagctgctgatgatacgaccgttgaggacaacaccactgatgaaaggagcattgagagtggcactgatgataggaccattgcgggtatagcagctgatgttaaatctagtgaagaggcaaaggagattgatatattggatgaagccccaaattgtgatcagagtactgctactgacgaggaaatagctgatactgaagaaagcatagcttatgatggtaaat

SEQ ID NO: 24216 - DNA, 1882 bp, Oryza sativa
cattacacgccaaccaagtcttgctatgaaggctttcagcacaaatgttaagtgcaaagatgctcggtaagaactcttcaccaacgcggcggaaaaacaactacagtggcaagcatgctagacctgctatctggccattacctgatgattggcgggaaactggtacactcgtggctgcactggagaagattgaatcatggatcttttctcggattgttgagtcagtgtggtggcaggtaaaacctttcttatgctttctcggcactttttaggaaattgagtacattttattctctgtaaaactaggatagcagacagctttttcgattcattttgttgtcaattttctgaaggatgtttccttttcaggcattgacaccccacatgcaaacactggtgaaagatatatcaagtccaaaggctgggagtttgttgggacctgctttgggtgatcagcaacaagggaacttctccattcatctttggaaaactgctttccaagatgccttcagcagaatatgtcctcttcgtgctggtggacatgagtgtggatgcttaccagtgttggcaaaactggtatgtttaatcattgatatttaatttgagaagaataatcatttttgtgaagtttatgcatgagttgttttattattgtcaggtgatggagcactgtgtagctcgtttagacgttgctatgtttaatgcagtcctgcgtgaatctgcaaatgaagtaccatctgatcctatatctgacccgattgtcgactcaagagttctaccgattccagctggtgacttcagctttggatcaggtgcacagctgaagaactcggtatgtgcccaaattgcaaaacaactacgttcttagtttaaaaccacttacgttggaacgtttcctgtaactgcatgaagaacaaaccagaacatgtgttttaaatcatctcttccttgcaaacaaaaccaaatgttaatggaccaaatgcttcttcagatcggaaattggtcccgatggttgcaagataagtttggcatggttgctgctgcccctgagaagcatggtcaagcaggagatgagagtgatgacagaagtggtgctgctgatttttattctttcaagctgctcaacgagttaagtgatcttctgatgctcccaaaggacatgcttcttgaaaagtccatcaggaaggaggtcagtattcatgcttagtcactccaactcttaagttggaacatatattcaggttcagtgctgcagttaaaattttgtcattctgtttaggtctgcccttctattggcattccactggtaacaaggatactctgcaacttcactcctgacgagttctgtcctgaacctgttcctggaatggttttagaggagctgaatgccgaggtacgacgtctatttgctaaatgatattattgcattgtagcattacaaagtccaaatacaatcttgctcaccatatgtaatgactaaccaagatacttctatagtttcactctacaccttctcaatcagtgttggttgctaaattttcacacagagcttgctggagcgcttcacggagaaagatgtgatcaccacattcccctgcgtcgcggctcctgttgtctactgccccccttcaccggaggatgtcgcggagaaagtagcagacgcaggcgggaacgcggagccggacctgagggcctccatggtgcagaggagagggtacaccagcgacgacgacctggacgacctgggcaaccccctggcgtccctgtacgacaggagctctccaccctcaccctgcaacggggcctctcgttcgactacacggcaaggtggctctatgtcgaacgcgagatacgagctcctgagagaagtatatggtcggag

SEQ ID NO: 24217 - DNA, 2547 bp, Oryza sativa
acccacacccctacccctacccccacaccacaccacaccacactagcacatccctgtccccctcaattcccgtaatggtgttactaacggtactatcaatttctactgagtaattgttttactggtagtagtgtttgaatcgtcgtatacatacatgtgttggtcccacaccgtaactaaccactaatcaatttcccccccttttttttttggatctacagaggcaggaagccggctcggcagctgtggcatcaggaagcggaggcggcggcgacggcgatggcgtgctacagggaggaggcggcgtgctggatctaatgggttaggcggcaagaacgggcatgtccatgtctggcgaggaggcgaggacggtttcgctctcgtttccgcggttgtcgtcggctccctccctcaagcgagaaaagcaagaagcgcgctgcctccgccaaggctgccgacgaggcctccaccaaccgcacccgcgctacctcccgacgccaacccctccgctggatccccattgctgtatcgttctcctcggtgaggtggggacttctctagggtttggggattaggggatttatagggttcctctgccctccctgcgtataggaacgaatcagaatttggtttttctttatttttttctttacttcatgcgatgggattttgcatggtggttctgctccagatctggaagcttcaatggcatgggtatcatgtgagaagctccttgctggtggatgccccttgttcttctgttccagatgtacaagctacagggcgacacgagctcctgctccctgcactccataggttagcctgcatcgacgaggaatacttgaggacgccaggggtgaagaagggtgtagcctttgggagccttgccgccagatccgccgtatccagcggccccgcgcgtccccgacatccctcttgccgtggtctagggtgctgcgatgtcgtcttgccgtggtctccattcggtttgttctccatactattttaattggacatagtttttttgagtaattggacatagtttttttgagtgctcagactgttgtgggatctattcaataagctgtaatgacttgttgtctttccaattgctgaaatcttggaggttttttttcggttaatttggctgaataacaatgttatgcgatgctgtttgtgctttgattcttcaggtactaattagagatattggagccattgtttaattactttacgagcagttcaggtactttactagcaattcaagtgacaaatttggttcactaatctagttctagcagtacaaacaatttcagcttttcctagttttagagttttgattctggcatgaattgtatggggaatatgattaattcctgcacactttaggatgaaggtctggtctcatttcacttgagcagttcttgcacttcttttctttcaattgcgggaatgttcagatcattttttgcttaaagtacctgattcgttcttagtttgtgtgtttgttggcctaaatctttcttccaattgcacagctctggaactcttgctgaacagaatagcatgaatgattctagtgtagggaagttcttatttttattttttgttggatcatggaattcagcactaattatagactaacagtgttcttgagttttcaggcatatctctgataggctagtgtttatatggttattatggggctcatgagttttgaattttggtcacgattttcaggactgcaaaatatgcagtgagatgtgtaaactctgagatatgtcatatttttacagcatgtgtacagtattcgtcgtagttttctgaaattagtactgcatgtcctgtgagatgtgtaaactctgagatatgtgatatttttacagcatgtgtacagtattcgtcgtatttttctgaaattagtactgcatgtcctgattctgaattttcggatagatgaaaactcaaaaagctcgatcgaatagcagttttctaaatttttgttgttcaaaggagcacatcaattgaattctttttttctgaacttctgactagatatgttcgctgttgaacatacccttttttctctgtatatttttgacagaacagacatcttcagactaagactaaggtctaaattttactgaaatgattaacttctaatttttgcaggcatcagcatctacagtgtgcactcttgcaggtggatgcacatcttgatggtatggtggttggtatttgctctgctgaagatgtacatgttctaatttttttggttgctcatctatatctgaattttctttttaattgtgaattcatttgtgttcaggaaactagaaaagaacatgagaagattatgccagtggtgatggtgccactggaatggcatcctcgacatgtccttcgtcaacgttcgtcgccggcagccaacacaaagggtcagcccaggacgaccacaccacaattgatgacaggcttcggtggcaggcgatgcgatgccctctggatttggctttttttttgggtaccgggtgtatatgtgtttgt

SEQ ID NO: 24218 - DNA, 1575 bp, Oryza sativa
ttagtaatgcatttactcatgggccaataagggaagtgccaaacaaatgttactcttatctgttagtaactcatttactaatgggctttgtctctgatagtaactcatttactcgagaatagtaactcgattacttatcaaaaacatactaatagtaaatgaattactaaagtcacacatattattgttggtggctgggctagcaaaaggtgcgggattgatacatcattcaatttttacgtatagtaaatatgttacttatcgtatattgcgccacaaacaatcatttagtaattaatttactatacgttatttctaaaaggtgcagggtgagggatgtggggtgggtgcagctgggggggtaggagggagggtgggggttgggggttgtgaggggagtagtttagttataacgcaccctaggtgccgtttagcacatccctatatatatatagacatcggccgctgggacaagcatccaccagagcttgtccgccgggtgaggtagcccaggttgttgatggtggcatcactccgccactccatgccatgacaaaaatcgtcagggctccagcggcagctcagggctcaggtagcggcgcgaggagcgcaaacaacggtgtgaatcctgctggagcgctgccgcaacgagctctgccgcctcatgcttccgcggccatgccgctctcctccgaacagaagtgggagagagagaggaggaaggttagagaagaggggaaatagagagagaggatgatatgggtctcactgcatatttttatttttatccgaacacacgctgatatgtgggtcccatgttttttctgactttatcaatgtcacgtagacgccgccacgtcaaccaaactgtcttggactttctttgcaccggttttaagaattaagggactcgtcatattgcggttcagggacgaatttcggatttggcgacaaattgagggacgtacaatgaacttattccttgtggcggagtcccttcctccgatccggccggcccgacctgtgatccgacgcagctgaagcacgcgggcgcgctgcccgccaaaccggtccacgggccacaacgtcacgcgcgagtactctccgtgcagcccgcgcgtcgtccatcccgcgatacgatcctctcgcgtggcgcgcgcgatatccccccgaatcaccgccaaacctgcactggttctctcgcgtggcacgcgcgcgttgatccaaacccgttgttgtacgtggtttgcggccggcagcttgcggccgccctgcgcaagcgcacacacattatgcatgcgacgcgcgcgatcggtgacgagtcgacgacgactccgcgggagttgacgataagagatcgccgcccgcaggtaggcatgcgcgtcaccatcgggggcggtcgtaactttgtccatcctcgcgtaggcaaacaacatggcaagcaagcaggacgtgtttgtgaattggctggcacaaataaaagcaagccactttacgtactcctccagctgttacgtaaaggacggacgccgcggtatctccgtgtactgtgttgtaaggccctctttgattttg

SEQ ID NO: 24219 - DNA, 4905 bp, Oryza sativa
ttttctcaattttcattggccagggatgcgtcaaggcggcgtacgtacaaagcgtaagtcgttacactgaaaatttacgctagtgctgtagctgctagttgaggccaagttaatcttgcatatgcaagggtacgtagctagccgtgctggagaacgtgcgcgcgcgtacgatcgaattaacagcagcaaggggcctcgctctccggtgtcttttcttgccggacaaagtaggtcgccacacctctcgcgacgtgcgtgcattccatgcatacgcatgtcgtgagctagctagctccatctatatattgtccttgacgtgcatcgcggcatctagtacgtaccgttgccttgccttgcctggacgaacggaagcaacagcaacgcatatgagatctctccggccatgcatgaatgcggcccatccttgtgccaattgtcggccaatggtgtacctagaaacccaaacggcgtgtgggagaagcatcaccggatttaccattgttgtcagtctcctttaagcatctgctctctgatctcactgttaaaaaataataattctaatttttaagatgagtctgaacatatatgtcaggctctaaacacttcaagcagtagtagtacgagtttgtaagctagtactctctatgtctcattttaaatgtaaccatgattttccgtgtccaacttttaccgtccgtcttatttaaaaaaaattgaaaaaaatttgaaacataagtcacgtataaagtactattcatactttatcatcttataacaataaagatactaattataaaaaaaatcaaataaaacggacgatcaaagttaggcacgaaaactcatggttgcgcttaaaatgggacgaatggaatagttgtgttgtgcctgcgcatatgcacgttgattattactccctccatcccaaaatatagcaaacctttgagggagtaatgattataaaggattgatgactgatcttgaagataatatatatgcacacacatatatatggcgtgtttagctaggccctgtttggaagattagcccagggctaattttaagagctaatgtttagtcatgaattggtaggctaaacattagcatagggtggcatgtttggatccatgggctaattcaaggctaaaagatggagagagagagagagtagaaagagaggagagagaaggagagagagagctatttttttatggttcccacacaaaattagcctcattagcaccccttggaggggctaatgttttgaggagggctaattcatattagctcaaaattagcccacctgtttggattattgagggctaatttaaggctaaaaggtgagggctaaacattagcccatggaaccaaacagggccctgcatggtacaaccgctgtgtagcgcagcacagcgtatcggttattacagccacacaaatcactgttgaggttgttggttgcgttgtggaacatgcccatagccatttaattacgggtagtggttttgtataaagctatatacagctatattatcatgctaagaatggtttctttatgtggttttcgtaaatggcaaactattggcttacataatagttgtgaaaatgcagtaggtacagtggcaaagctaggtgtgatgcacttgatagggcagcaacaagagatgtatgattttaaccataagatctcatatttaatccgtaacacactcgtattttttttcttaaaatatgttggagggacgtctcttccttcaaatcttgaaaaatgccatagttagttataggctgttctcggctttcactggtttattcaaatgtcatagtccagattttaaaatacatgtggacagcaatggaggtagcatacacagtagtatttcgtttttttttttcagaatagtaagcactacgagcctgcaaatgactgaagctgtgtgtatactgtatagtgcatagctatgtgtaacctagctaaagcctgaatgtttcagctctttcatagtctgaaggtttatagaaaagcagagagtactgcacagatttgaaatttaatctcagccccgtcgtaaatagaactttgcatgcattggaaaatattgacgtagttcttcagatcaacagccagccttcagccacagctcaaagcaagtacagataaactgaacagtcaagctgtacgaaccatggattatatatgaattagtgcacgtacatggtcaaacattgagacggggtttaatgattaatctaataaatcaacactgcttaattcatgggacatcttttccgaatatcgaatcctgacagatcgggaaaatggcatatttcctctgctggtatagtaactcctctgtcagatgtcaatatgtcatagatcagcagcaacattgtgccattttgtgccatttattgtcgactcaattattcagtaattagattctgtattttgttggcacaatgttattactgaaagatgtaattcaaaaataggaattacatcccacgaaaattttggaatcgtccttgtgtcatcatgcagagagaatcaataactacaattatctgaattttttttatcgaaacacatacaactatctgatcgaaaatgcttccgctcgggcgtctgagaccaacaaatcgaacactgtaccgtagtcaattagactgcagggattaacccttgtgaagtacagtattttcagtcaccctagcctctagtgagcagaaaaggattcggattttacagtcccctaccgaaatagttacccttatttcacaaacctacccttaccatgtcacaattttacagtacaatctcttctactcaattttagtttacccctttcaccacaggatcacataattaatgattttttttgaggtgaaagtgaaaaaaagagagaaatactgtagttcgagtggaacaccggagaccggacgtcagaactccggcaagaactccgtcaactcctcctcctccggctccggcgaaggctcgtgaagcttgttgaaatactctaccacgctgaacccctcgcacgcggcaatgtcgtcggccggcggcgggatgtacggcggccgggagagctcgccgagcaagtcccacgcgactccggcgaagaacgggtgggcacggacctcgtcggcgccgccggcgaagccgagcctcttcgtgggctccttgtcgagcagcctcgcgatgaggtcggtgagctccggccaccgccgccgcgagtcggcggagaactccggctcccggaggagcacgttgcggaacgtctccttccggctccgcccccggaacggcgtcctcccgtacgccatctcgtagacgagcacgccgagcgcccaccagtcgacggcgaactcgtgcccctcgccccgcaccacctccggcgccacgtactcctccgtgcccacgaacgagaatgacctctcgcacgcggcggcggcgccgccgctcgcgctcgcggccgagcagaagctcgcctgcttcttgccgcggcttaccggcgacaccctcgccgacttcgccttcttgaggtggtcggcggggccgccagctgcgtcgtttttgttgaggaaccaggccaggttgtgggtgtactgcccgggcgacgacgtcgatgtcgtcgcggccaccgacgactcacttctcgcgaagattcgcctcagctggctccggccatgtccctgcagctgcggcggcggcgacgacgtggccgagcacgacgacgacgaggtggaggtggacgcggagggggagacgggcgggagcagccgggagaggtcgaagtcggtcagcgtgacgtggccgtcggcgcggaggaggacgttctcgggcttgaggtcgcggtacgcaatcccggcggcgtggagctcggcgagcgcggagacgagctcggcgacgtagaacctgatggccgcgggggagaagacgcggtcgggctgcgcgtggcggagctcgttgaggtccccgccatggcagtacggcacggcccacgccacgaggtcgcccgtctcggcgcgcccgagcagcgacgggaggtgcgggtgcgcgagcccggacagcaccgacacctcccacctcgcccgccgcgccgcgtccccctgcctcgccgccgacgcgacgacggacctcttgtcgaagaccttgagcgcgtagtagcacgccccgccgccggcggcgtcgtccgccgccgcggcgacgaggaacacggtgcccatggcgccgcggccgagcacgcggacggcgcgcacggcgtcgaggtcaatgtccgccatgcgcggctgctgctgctgctgcatgggcgcgcgcgcgcgcgctctgtgtgtgtgcttgggagtgtgtcgcgttgtgagcgacgaggacgtggaggcgagatataataagctggtagtagggggccgggctaaacccgcgagacggttgcctaattaatttgttgtttttgtcttgtttaacctgcagagattaatgaaacaaagtggcaacgccacttcaagatttatactattgttatctccggcacagctttggcgttttctcaattctcatcggttctgtcaaagagacgatcttcggagcatatactggcctagggtttcaaaaccggctcagtcatcgaataccgcacggccttttttttctgtctatatatcatatgacataaaatctcacctcctatcatttgaattttgaaccattggatgtgctttaagattcgcgcagccccttaaaccctaactcctattcctccttccccggttccagatcatgctgccaccctcctcctcccgtcccacacgcgatccgccgccaccaccgccaccgccacccccaccgcgctgccgcccgcctcgccggctggccggaaaaagtcaacggccctgcaagccccctcc

SEQ ID NO: 24220 - DNA, 3463 bp, Oryza sativa
ccccaacccccctcctaccctcaccccaaccccaaaccctaacccgccggagttggaggagagaagccgatgcacgaatcttggcatggatccaatggtccaaaatctgtaagatttcatcctcaaatttcattcgaatgccatatagcaatcccctttttttcgataaacgcgattactgtatagtgtccgacaaaatttgaacaaaggtaggagtatttgaaagttattcccagtgaaatatactatttttatatttccatcttttatatttccaaaggtgccatataagcaacgagtcatgtaattgatgattgaaaaacacatggttttatttttgttgtttcataggtaatacatgcaagaaactatatattataaacaatttggacatggttttatcctctgacctcttggcacgtcggaacaatttggacatggttttatttagatgaaactcatcgatctcatctctcactttattatatttcttaccacatcattaaaaaaatactaacataacaccctatttaaatagaatgaaactactatattaggatgggccttatcttaacctcggtcgtctccttcgatctaatggctagaaaattgtctccaagattcagccaaaaagagagcagggagatatggagaagaccgactccccggcaatgacagtgttgccgctagagccgcgaggtcggaggagggtagtggataagtcggcgatagaggaattagatcagagtggtaggggagctaatgggggcaccttgccgtctcccatattgggtaggaggagaggcggggagggaaggggaaggtcgattggcgggtcttgttggcatgctgagggcagggatcgatgtggtgacacgagtagggtcaaccaataagtcaccaacgagataaaggttggctggagctgaagggcaccctgaaagaccttccagggagaccagtgaccctataacgatataagtctaccctatgaagaccaaataacctgaatatgttgaagaaggggaaaaaaccctcgtaaatgtttctatcaaggggttatgcatgtaagagtttgtgtaagcaaatcctaaggttagttagcaaggctaaaaacctacaaataaatcctaaggatatgatgcaagggcatgttgtgaaaaattaataccgtacactttactgtttttgtctatatttttaagataagtgtttatcttttaacagccatatagttatttaatggtcccttcaacaaactatactgaacttttgaattctcttgaactataccagtttactgactcaatacttaattcctacgcgctcaataagactgatgataactacaataactgaagtactgaaaatttaccgtcgcattttcaaccatacctctggcttgggttttagcatttctaagatattgtatccgaggaaaaaatgtgtaattgtttctctctaactctagtcaagaaaatacattgtttgaagatatcttaaaataaatctgtcatgatttacatgaaaatcatatggtggatttaaataaaaagcagtttaatatagtactatcatgtagagctgtttatttgtggaagatttgaaaactagctttatcacttcagcatggagtaagtgggtggtggatgccgttggtccactcactaatacgtgtgcatgataagctaaattatgtcaattttgtgctgcttatgcctcctccaataaaggtgagtcagctagctaataaatctccatatcagcttttgtatgatgtggaagagagagaagataaggagagagaatgcactatctcttcttcaagagctaagcttctaaagaaaatatgagaggaattgtgaaacccaaagcattttaaataatatgctataaaataatttattggagagttaatttttttctcttgtataaggtgaacaagcatatccattaaaggaggcgttacaagagagatcatttggcgtggagctcaaggtgagaaaggtgagctttacacgtgtgcacagtatcagcaaccgaagattttttttttttttacagtgactctacaaacaggcacttcacatagtagtattcaaaacaaaatttaaactgctggtcatcaatcatatgatgcaacggaacgggcatattccaaatcggacatcgtacgggattatcgagagactttgtgttgcgattgtacatgacaaaagattatgataccgataggacgaaccgtaccattatattgtgcttgggatgctgctcatgagtcgtagcttgtgttaattttgcatatttgtacgatgtacctaacgaattttgaatgcaaatttacgagctaaattaactggccagagcagaacccgtccttcagcgacttctgcacgtcgccaatattgacttcgagtcaaaatttgatagtacgaattcggtttgattaatgagacaaaatagagtgcgattgatgcttccctcctaacatgataatattttgtttaatgctgaaatcaagaaagtgaaggtcaaaacatatcttttcgtgaatcagccttgtctgttggtgcttgtttagttcgcgaaaagaaaatttttaagcgtcatatcggatgtttaaccggaatttcggatacgaataaaaaaactaatttcataactcgcctgaaaaccgcgagacgaatcttttgagcctaattaatctgtcattagaacatataggttactgtagcacttatggctaatcatatgtactaattaggattaaaagattcgtctcgtgatttctcccataactgtgtaattagtttttttagtctatatttaatgctccatgtacatgttcaaagatcgaatgtgatgttttaggaaaattttttggtgaactaaaccaggccttgtttagttcatatggttagctttaccttttgaaagtgctactatctttttttggtgaagttcgctcccatggtgagctgcatgcatgtgacagaaaaatcagaattgaagttgacattgtgcttactgcttacgtgccaccaaattacagtgcttaaattcagaattgaagttgacattgtgcttactgcttacgtgccaccaaattacagtgcttaaattcggttataatttagaataatcagggatcatattggcttgcttcaaacatgtccaacagagaattgagcttgagtacttggactgtagtttttttttttttactttcatacagatatttatagatttcttcagttagttctttcaaatgtgcaatacgaggagcagtataccatcagtatgacagtcatcaactggtgagcttgtatggcagaaatgggtcctatataaattgaattactaattaattttagctgcagtagtgccagggtaccacctggtccaccagtctaccaggaacactgttcgtccgtaaacatgtgtgtgataaagaagatactca

SEQ ID NO: 24221 - DNA, 4351 bp, Oryza sativa
ctccaacagtgctaagttcaaaacgagataatgggtaaatggagaacagagttcctgaaacactacctgattacctgctataaaatggaatagtcactcctagttcctagtgttgcctaactctagaaaatcttcatccgccgtcgatcgagacagggacggatgaagcaatttcacaggaattaaactatctcctatgaaattcctccaaaatttctacgtttcaaaggaaccatgagtgtgtggacggaggacacccggcagtttctgttgtagatcatcccctgagtcgggatgtgagaaacatcacgtggcataggcaaaccatcctatccaacaccatctgtgcggcacatgtatgatgaaattatcaacagtgaatcagtgtgatggtttggatgatgctctgaacttgagccgtggagagggaccagttctggatgatcacttttcttgatcaggcgccggtccggtcaaggcctcgatcgctcgtttcgtttggtggttgtctaccactcattaccaaagctctgggacgagaccgaaaacttctttgttttctccttaaacaatgattacctgaaagcaagattagctataacaaacgtaacgtggctccctggctaatcaaagcatatggcgtcttgtgccgttgttgcttcatgccactgtgcacgcaaaggccattccttcctgccaagggatacccagctgggaatgtctctgacagaagagaaccaaaatggagacgtgaattcagacgtagtatctgaacatggagaagaattgtggattttggtgtctctgcagatgcagagaccgacagatacacatatatacgtatagggatatgctcagtgttcagtgttgttgccacctgccaatccgtcaggttaacgatccttttggaaattccacccgtgcattcttgtgtgactgtgtgcgcgaatcatgctctgctccattattggagctgagcttggcgtttggcatcttcctgtttatctggttaacttcgtcgtcacctactggctactcactccccctagtctttaacaagtcgtaaagctgaatagttgctaacatgttagcccacactgatgcagggggttaagagtattcaaatcggagcttgtcacccatttaacaataggtgtctaacttggtcggccattacacgggagtattctagatcaaagtgaggtaatcagcactaagtaatttcatcaacacaagaacagatgcatcaacacaagaacacatagggacataggataggaggcccttttttgcagctcctgggtgcgtgatgaaccgatgattagtgaagctcaattagtagctccttgacctttgccgccaacgaacgcagattcaggcatcgtttcagccataagagccactaaactgaacaataccacttttgttcatatgggaagttactaaagatcacccctgtgtgcgatcacatcagagaagtgaagtcacgtcacgttggattgtggcgcagattgctttatgcaaaagcgtctcactctcacacaaaaagggggtcaaggccgacgcttagctgttcaactcttggcgagggcgaggcttcagatcagatcagatcaaagatcaagatcagaactaccgcgatgaactgctctgcaacaaccgacaaccgcggttaatgtccacaagttgtgtgagcactgttcggcgacgaagcagaaacgaacaacgatccgtgcagagagacgagcgacgacaccaccggcgccgcgtgaattcgcggtagccgagccggggaagccgtgaggcgcgacgaatccgcgggggatgtgatcagccgaccgccaccgatgggccgtgcgaaacggcaaaaaaatgggcgaaacggccgaggccgcgcgggacgggccagcgctcggtggagttcgtggaattcacgggatttcacggggaatttggcccgcgtgcgtgtgggtttacgaggccagccagccagcccaccgtggaaagctactggctggctgggttgatgccttgatgggttacaagtttacaacggttgttgggtttggattctataatcaggaggacgtgtcactccgtgtccagttctactacttttttctctttggaagcgcaaggtgcaaagcatgtgtactctatcgttcatgtcgtgacgctatacaggtcaaacatggagaattggagataagagattatggtgttctgacagtacttttgtagtccatctgctccctgtttgttgatggtgattgttggtaaaggtgatctgggtatacagaaaatgattcagaaaaagaaacacacactaaaagttgctgctatgtttcttttttcccttcagttactaccaacaacagctaaaaacacttgctcaaaaaaaactgaaattgaatttggcatctagatgatatttaaaattaaaatgttcattttgaactatgtggataatctcaaggaaatactgatctaacggtggaacaattaacatttttttttgcaaggaacaatgaacatgattgcctgattgggagggagtaagaaaagataacattgaactttcctcaccaaagacctcgatgagaataccatgtgctcatccattttgcccgttctccgtactgccacatgaagcacgctaaactccatttcaacaacaaaaaagaattaagtaatgtaaacctcaagggatcagtttcggcacaaacaatagaaaagcccaactggcaaagccaaattaacgagaagagagaactatatcacgagaactcttgactattgattgcgcatcacatcgagcagcctaaggaatcctaatcatcatcatctacaagaacacaattcgcctaccatcacgtatactctattgctaacagttcgtgttagaccaaataaaaaaatataatcagaagtaatcaaagacgagtgaagaacaggtcagagtgagaccacaacacttgcgagaaagaagacgactggccatcacgagcagaggatgtggacgtggccatgtgaagagtcaggccgtgtggcctccacgacagtataacccgtgttcatgcacaaatcgcgccgtatcttttactactcgcacataatttctccgcacaaaatgacttatctttttgttgagaaaaatgaaaagtttattctacttgggtagtagtactatgttggctgatctttttttttctccctttttagcggttcatgagagacgcgcacgaattgatgattagttgcttggttggatgaataatttgcagtttacaaagtgtggagaaaggttccagtttgagatgaacacggaatgtgtcggaactggaattggatggattgtttatagggcagcaaccagctaccaagtgattgctaatcaagctactcaattccattcctttcatttcaatgattgagcaataaccatatgccgaataattttgtaaaaatggagcagaaagtgcgagacaaatacacacccaatccatttgttcttcgattctttttccctcaaccacctcacatcaccattattgttacactattccttttccaccacttatcctcccgtttgcaattaaaaagaataaaaagggaaaaacaattgcgagaagagaacagcataataataacatccacaccttcaattcccaatttttttctccatttcttgctaaaacagtagattttttttttaattttgtttgcctctcagaacctaacgatcttggccgcgcgcaccaccgggttgtccctggcgatggcgtccctcgccgccgacttgtagtcgtagctgcagccgtggcggtcggagtaccggtgctcgccgcagaacaggtggccgcaccggcaccggaacccggtgaggccgacacgcttccggcacctggagcaccggttcaccgccgacgtcttggcgaccggcgccggcgccgtcgcgagcgcggaggccatctcctccacaggcggtgggagaggagcctgaggctcaaccagcggcgccgccggcctcggcggctgcttgtcgagcaccggtgacgacaaagaagacggcgacgaggtggacgccgtggccgccaagaagcagttctggcagaggttctgcgtggccgggttgcccgggaatccgcagctgttggcgcacagcgtgatctccggcgccctgagctccgtcggctcctgatccttcttgtcgcgctgcgccatcgtcaataaccaaaaaagaatccccctcttggtctcaggctctctcagcaggctgaggattccgctcgcggtttgggtttgctgtgtgatgaggattgcaggagagatcgaggagaggatttgatcg

SEQ ID NO: 24222 - DNA, 11307 bp, Oryza sativa
gggggttggcgcggcggcaacgcggccctcggtttcacgggtggattccgcagccaaaaaagcggtaaacggcgtgcacggccgttgggtcggtcgcctcgcctctcccacgggcgtagtactacggtagaatcgtcacggcggaacgtgacatgccgccactcatggctcgctgccggccacagttcggcgctgggagtggaggagctggatccagatgggtagccgtggctcactggctcctgtgaccgtgtactggatgagtagtacagtggagctatcgttccgcttatttcatgaataaacgaaatgacatatttacaaacgaaaaataatttataaataaaatttttatatatgtattcttaacgatctaaaaataaaagatgaaagataaattttaataaaaagacttaaaatcagttttaaatttaatattaaaaatttaaattttaagtataagtataaacgaaaaggtgaggccctaagcgtgtggagacgtgtgggtggaacggtctttttccccgtaagatatgttgtgtttttaggacacgggacccgggcaagtagccaagtagcccaccccgcggggaggagatatgctcgaccgaaagaggaggggagggggtggaaaacgggaaagcgaagaaccggggcaaagcggtaaaccaaaccatcggcaagccgcatcgccgtctcgggtcggctaagcaagctctcgttctagctgggaattggaagttggaacccgtcgtcgtcctcggcctctcgacccgtcgcgtggcgtggcgcggcgtgcccccgttcaccgcacgttctcgttctgccgatctgcctgacgccgcgatgagaaaaattaaggaaaagatcccccctttctgctgttgctgccgtggagctctcctcgcgtcgctttccgcccgctgagctgtctggattagcatggccattcctttccttccggccggccttcccccccccccccccccttcttcttttctccccctccctccctacgtagaccgtgcccatgtcactgtcacacatacgtacgtacacactcaaaagccaaattgcaatccgagaattgagaatactaaatcacggcctctctctctgtatatgatatatgcatcggctgtacgcatgtcgacatggagaaggacgattcgtggaccggttttggtccagctacgtacgcaatacattgccccgtacatacgcgccgcgcagccacgcgctgatggcgttttcatgtgaaatcacggcgtagtttgttgcccgattttacagggaaacttcacggcctcgctgagcttaactcgtcctgaattaacaaagtacaaggcggccaaccacgaggagacacgcgaaccggagcgcacgaagagaatccccggataagcggattccctttgccccagagaggacggaaaagacgccggaacagcacgcgcgacgccacgcgagagacggagcgaaccgaaactttccccacatgagtacattgacaattcggcaaccgatcgattgatcgatcacctcacccgatcgaatcgaattggggtaaaggagagcgaggaaaatatgccggaatgcgcgaaatatctctctgcccttggataggtagcagcaaaagcaggaatggatggatggatgatccgtcgggtactttggatagagcattggagctaacttgcagaggttggaagatgcatggtcgtgatcatatgatcaattgatcattcaggggaagcttaattgcgcacgctgccgacaacgggtcgaccggcagccggccggccggccgcccaatcgatcgaccggcaaccaactcgaccaatgatttgtcctgccgatatatatacacgtaattgttcggctaatcatgagctacgaacgaaccgggctgttgacgaacacatgttatatatacctacatcataattcgatgttaattgagcttaattcggtccctcaaaaataacctaagatgcttaatgcttaatccttcatggtttccattgaattagctgttccctggaaaattgaagtcggcgtggaataatatccatgatataaaggcatcgaaaggctggaccattgctcaaaaggatgaggtcgagtaccgctcaagtgactgacaggacaatgagctagtaccagaaaactagctgcaggtataacttttgaaagccgccttggctggctgtaccaatcctttaccggaagcacgacaaccaggaaaaccacatccaaccgaagatatcaacaggactgtatattactgccgcaacacgtcaccgtccgtcttgcgggcaacagagagcgtcagcgtcggtgtgtccgttccagtttgcggaccgacttgatatttcgattggctttggattgctatcccttgaccctagaatcacctttgccaagtgctcctttttcgctcataaagttccagttcaggatgatgctactagtggctttgcacttcaggagtttactacataattgtttgtggagtttagacgtggcgattgtgggtggatggccggcagctggtgtgatatcctccgtcgaacggcggcggctgtgatcgaacccggcggcgacgctgcgcttcacacgtgtgtgacgctcgccaccgcgtgtctcccggccactgagcacgagcgccagcccagcacgggacagttcagggtcgcacacgcgtcgagccgtcaaccttcgtttactcgctcccggggccgatgtccgcttccggacgacgccggtttgaccgcaccttccggcttccaggagagtcgtcgtgatgcccgcgtgcgcgttttgcagattgggccgcgtaggggacacgctgaaaactgggctgccttttttggtccaacgtgaaaggaaaaagtacatcgaaggtccctcaacttgtcaccgagataaaaaaacgtcctcgaaccataaaaccagatatcgaaggtcccttaacttaccaaaaccggtcacaagtagtcccagggcagtatttcacacggttttatcctacgtggcactggttttgtccaccgtggtgctttaaccttggtcttcgtcgctgagtcaccagcgccacgcgaagctggcgcctggcgggacggagtggggcggcggtgagcagacgcgcgggcggagtgacggcacccgaagccgacggggtggcggagccaagcggaggacgccagcctcgttgtcgtcatcttccgacatagggaggaggcgtgggagctggagccggaggaggggctccgctagaagccgctactgtagaaccaggagcacatgatcttgagctccagctccgacgccgcctcagccgcgtcagttttgccgcgcccccacgctgtcgtcgacgccacctcgtcgtccatcatatcgaacattgatgcggccgcgataatcgccttggcgctccccgacagcgactcttccggggcggccctcctcttgccccctcatgtagccacaccgccccctgcggcggcctcgactcttgcgccgccgcttcatgactcactgcatgacgccagcagggagcctgacggtgacgaggagcaggatcgctgctcccttcctcctcctctctccctcttgtctggggagggcggccagtagcggtcgacttcgtcctcgaactcgccggcggcggcgagctgttctccctgccggcggagaaggatggagaaggcagtggagcggcaccgcccgggctgctgcttcccctgccgccgccgcccgcccgcgcgccgctccgctgcacgccgcctacacgctgctcctcccccgccgcttgcgctcgccggccgtcccccgtgcagctgcttccccgcccccgcgcgcgcccgcaaccacctccgccttcgccactaaagccgccatcgtcgtcgtctacttgtcttcatccaccccaaaatgtcgtcgcacctagacgggcaccgccgagtagccaccccttttccctcaggcgccgaccgccgcgccgcggcgatgcgccggtgttgatgaaaaacacgaggcctgggtcgttaatagccggccatcacccaatcggagccgatgccgccgctggcgccccctccaattggcgccccgtccttctcctcccggcgccactcccttccctccctcctccgcctggcgccacctcgattcctcccctctgcgccgtctcccggccgcgctgccaagccgccgcgcctcgcagcctctctcctcctgcgtgcaaccgcgccgccaccaggctccctctccttgccgccaagctctcccccttccacgctgccggcccctcttccccaccgccgccgcccatcacctgcgtcgctggcgcccttcctctgctgcgcgcgtgtgacgcgtgaggaggaaaaaaaaaggcagagagagagaacggcgaagtgaagaaacagagagaaagagacaaaataaaacaagaaagaacagaaaaaggaagtggaaccccccttgactcctccccgtgaaggaaaaagtacaccaaggaagagatgtgacgtggcagtctgacacgtggggtacatgctgactcagctgccacgtaggataaaaacgggctcaaaaccaccgaatgagttattgtaaccggttttggtaagttaaggaaccttgatatctggttttgcggttcgaggacgttttttatctcggtagcaagttgagggaccttcggtgtacttttccgaacgtgaaatgggtggtatcatgatgggctgttcaatctgtcgatatttatgggctgaattaggcttacaggcttagggcaagccgaatttcgtgggctattatggcagcttttctcgtgcacaaatatggatctttatttggcccaccgcgaccccacggcataacgaaacaggcagagcccctggaaagatttcagcaatacctgttcagacgacgacgtctgctctgttgttcgatttccgtccgcatattcgtcgtgtgatcgtgtccacgcctggagttttctggcacaggccgcgctcttctcacctcagcctcaggactcaggtgatcgtgtcaacgtccggagctctcaggcgatcgtgtctcacttcacaggttgacaggtcggcgcattcgatgccgttccaaacgcagaaaatttagagaaacatctcgggacagagcggcgctcccacgcgtggaatcccgcagatgtaaaacttcgttacaatttacagtgttcgcaacatcaagaaacgacattttttcattcgaaaatgctgcaaatctgcaactggcaatctctagacaaatcctttccctttcgatgccgaagcagaattgaagtttgagaatgttcttcgtctagaccgagcagtcagtgatctgcaagcgcgaggcgttcacagatcgtctcgacgacctccctcccctgggacgcgttctgcctgaacctctccgcgcaccgccgctccaccatctcggccgcccaggccgccacggcagcgagcggcgcgcaccgaatgctcgtctcctgccggaacagcgtccactcgtcgggccgctccgggtgcgggcggtagctgcaggtctcctcgacgtgcaccagcgcccggaggttggcgttgcgggagatcacccgcatggcccgtgcgggcccgtccacggtggtgtgctcgacgcagagcaccacgtcggcggcggcgacgaggccgcggaggaggagcgggagcggcggcgcccgccccgcgatggcgcgcacggcgtcgatgcgccccgatccagcgtcgacgcggcgggacagcgtgtgcacctcgaggatgtgcgacagcggcgccgcccgcgcgtccgcgtccgtgaacttgcgccacgccgccgcggtcacccggtgccacgggtggcggtacacgtgctcctgcgtgtacgagaccaccatgccggccggccggccgccgcttgcctgtgcgcgcgcgcgtcgcgtcgcgccgagatcgagcgaggctagcgagagcgatttcgacagcaactgcagcgaaataatgggaatatgagtgtgtgtggactccggactccggaggaagagaggaatattcgagttccacggggaattaaacccattattttgggctcaatttgcttggactgcaaagctaccagacctgcagcccagcgcatctacagatgggccaaattttgacatacttcttagtgggcctaagaattcatgaattggggccggcctaaggccagcagcccagtgagtcatcacctcgcgacctaatgtctcgatccaacggcgaagatcaaaaccctaacctgcgccatcgtcgactatattaaaagcccactcctccccgcgccgccgcccttctctcgagcaagcacccaaaccctcccctctaccccgccgccgccgccgaggaaggggcaagaggaagccggcgaagatgaagaccatcctggcgtccgagacgatggagatcccggagggggtgacggtgcaggtcgccgcgaaggtggtgacggtggagggcccccgcgggaagctgacccgcaacttcaagcacctcaacctcgacttccagctgctggagggcggccgcaagctgcaggtggacgcgtggttcggcacccgccgcaccatggccgccatccgcaccgccatctcccacgtccagaacctcatcaccggcgtcaccaagggctaccgctacaagatgcgcttcgtctacgctcacttccccatcaacgcctccatcaccaactccaacaccgccatcgagatcaggaacttcttgggcgagaagaaggtaagaaacccacctttggatcacttccatttgcccgctgttcgtggatcatcctagatctcccccacagatctctcaaatctgatgcgtctttctgtatgctttgtgtttcaggtgaggaaggttgacatgctcgagggggtgaccatcttgcggtcggagaaggtgaaggacgagctcgtcctcgacggcaacgacatcgagctcgtctctcgctcagcagccctcatcaaccaggtgaatgatacgatcccgtttcttctccctatagattggagatttcctggtcttctaatactgatatgatgcaatatgacctaattagtcctgatctttgcatgtgttatgtactcatgttgccatggttgtaggaattagttctcttgctccaatgatatatctaggtttgtaattgtttaacaagtcatgcctgcctgcttgtttctgttgtttgctgcttaaggttatatgttgaaactgctaaggcggcatgatgttctatgtccttagtttgatcattggcagttgtgaatgtcattatttacagtgctctacttaggttttaataaccatttcaccatctgtctgttatgtcagtactgaagttacgttaacacatttgtgacgaacaaatccatttcttgaacaaccaagatcccttttgtagttgggctaattggcattgctaagttcttggtttggaaaccatgagtggtgtcggtgctcagggtacagtttgttatccactgtctgatccctatttgaatttggcgtctgcacaacaccatgattatacatcaaacctttttgccaatgtgatttatcttctatttttcggttcgtcgagcactcttttttccatgctttcagtgaaacaagatattttatcaattatcgtgtgttttgctcttgttgatttgtttgtgcccttgttgtgttgttgatcaaaattccctttgcttgtaaacagaaatgccacgtgaagaacaaggatatcaggaagttcttggatggtatctacgtgagcgacaagggtaccatcacagaggatgcgtaaactcctatcttcacctagtatcatgaagtgctgtttcttgtctcccgtgtctgatcatcctctgagttgcaattttctgagagactgaattttgtaatggtgggttatttaggatgtaatggagcatggtatcttatcctacatattgtttctgtttgcgattatgaagtctatttatcatcccctaaagacagtttactggaagcattcgtggttagataaacagcataatgctacttaaaagtgtgagctggtatgttttcccctgcgtatgatggattgcaaactggaggagtgtttttcccctgcccttccactgttactggaagcagcggttagtttcgagacattggcttatctggacatagaggattccattgttagcatcatggatgcatgtgtgatttagagctgcaattcatttgattaccacactccgcactactgatctgacactgacgtacagaatcaacattgcgaatgctttttggggacttcctctcacattctcgctgtagagagtgcgtctagtagagggtgaaaccgtcgctgtacttaagagagagtgcgtctagtagagggtgaaaccgtcgtcgtaggagacgtggcgtccgcggcggcagggcggcgcgccctcgtcgcgctcctggcagcagctccacctccccttccagttgtctctcccggtgtttgggcgactccccctgtcgttccacctgtacacgatcaccccgctcttgtcgctccattcgccgtcgatcccctggtgcggcggcgacagcgagaacaaccccttctcccctgcaaacccgtcaaaagatagattcaagtcttatttaacagtaactagctgggtggtccgtgcaattgcgcggctagcacccaaacaaaatcatatatttttttaagtatgattttacttaaaatttattaaatagctatctcattgtcttaagattttgaaagatcaaactttatcatctccgtgtttctaattatataatttttaaaagtcacactagttgctacttcttatgtcatctccttctttatttgcttgtccgatctaccacaatttctattcattctccttggaacctttaaaaattggatcttatatttttttagagtttattgtcattttgggtttcgtttttataatttctagatgtcccgtcaaacgttgccattatactcctctacggcccgtccactgtcttctctttattgccattgagattttaaaaatcgaacataattatcgtttgggttcatttttactttctagaagtcccgccaaaccatcagcggctttgctattttactcctctaccactcggccgctgcctccctttttttttgtcattgagattttaaaatcaaacatgattatcattggtttttttttactttttaagaagttccgaacctttaaaaattggaccttatagtttttagagttcattatctggttgggtttcattttttataatttttagaagtcccatcaaacgatgtcactatgctcctctacggcccgtccgccgcctactatttatcgccacttgtgattctaaaattcgaacataactatcgttggaattcattttttattttctagaagtcttgtcaaccgtcggtggctctacaactatactcctatacaccccgcccgctgcttctcctttttattgtcattgagattttaaaaatcgaatattattatcaatggggtttattttttttactttctagaagtcccggcaatcgccttgctcgtttgcttcacggcctacatgtcgtccctccttttaatcatcattaggattatatttggtgttttattaacagtttttatatgtcgtatcaatcgtcaccactctactcttttataggtctgttacttaatttatcttgtcatgtgttttagatggttttttctttcaatagtctttattttatcccaaattttagttatttataaactgtattcataattgaaatcttatttttctttttctaatttgagaatttattttttccaaattttaattaataccatattgtgttattttaatattcttattttttattttcaattttagttgtttcaaaattgtattccgaactctctgttagtttttctaattttggatattattttattttttattctgaattttaattaatgtcgtattgggttcttatatcatccttctttcaatattgcttatttttaattccgaatttcagctaattttaaattgtatttctacttgaactctttttttttctaatttcagattttatttttattttaattccgaattttaattaatctcgttttgagttcttatatgaactcttcttttaatattccttatttttaattccgtattttagctatttttaaattgcattcctacttggattatccttttcttttctaatttttgtttttattttgaattttgactaatctcgtattgggttcttatatggaaacttctttcaatattgcttatttttaattccgaatttcagctatttctaaattgtatttctacttggactcttcttttcttttctaattttagattttattttatttttattttgattttttattaatctcatattgggttcttatttggaaacttctttcaatattgcttatttttaattccgaatttcagatatttttaaattgtatttctacttggactctacttttcgttttcttcttttttctccgattaatgtggaaatttctaacccccacggcaaacgtggtgcctcctttcaaaactgttttaataatataatagatacttatatttacagctaattattatttcagtgctatataatgtatatttatataaggtcatttcgttaatttcaaaatacgtcgatctaatcatttgaagatgcttataagtgttaaaatgttgtgggcgtctatccaaaatgtcgacacacttcacactacactagcccaagatagccacgaaccggagaaagaagaagatatttatcgcgaggttggctacctgtgacgtggccgtggaaggcgcagtcggtgggggagttgtcctcgtcgagatacaggctcccgcaccgcaggcatcgcttcctatccttctcctcgctccgactgccctgctccaccgcagccgctgctgccgcggccgcgccgtcgcctggagacgcgccgatccgcgccgtcgcaggccgacacggcggtgccgcggcgttccggtggcgagacggcccgcgcggcggcagtaccggcaccgtgcgggttggtgcgagagctgggctcgccgccatggcgtgatgaggcgacgggattggcatcttgtgctaatggagctcgcactccacacgcacacacagacattcccgctgagaattgctgcctcttttcaggttgtggcttgggggtaatgg

SEQ ID NO: 24223 - DNA, 2291 bp, Oryza sativa
agtaggtttaataaattcgtctcgcagtttataggcagaatctgtaatttgtttggtattagtctacgtttaatacttcaaatgtgtgtccgtatatccgatgtgacacaccaaaacatttcgtctcgcgaactaaggccctatttacttccaggggtgaaaagttttggcgtgccatagtgattaaagaaccaaactctgaactcgtagcacctgacatctttgtggcctcaaaatagaagaacagaactgtggcgaatgcactataccaaaacatttgggtcagggatctgaacacactaggctgcgtttgataggatgggttgggaatccatcccctccgcacgaaaaacggagcagtccattagtgcgtgattaattaagtattagctaattttttttaaaaaaatggattaatttgatttttttaaagcaactttcgtaatttttttttgtaaaaacacaccgtttaacagtttgaaaaccgtgcgcgcgaaagaaagtgagagaggttgggaaccttgaggttcgaaagcagcctaaagataaccacggaggaccatctgtgacaattcatcaatctttggacgaaaattcagaatatagaccctcatcgtttgggtgctattatgcgagcagaacactagaatctttcgacacatcgccatccccaacctccgtgattgcaaaatcaaataggaggctggggcttgggtcaaagtaggagcgtccaagttctaagagtttctatttggggggagattacgtactttgacctttttaagtcgggcgaggactttcacacgtcgatgtacatactttaattttgtttactccctcactatggggtgttctggaagagaggggctaaactttagcccctctctcaaaaatataagtctctaggagatggacttatatttttgagagagttagatttatttgttcaaagaaaagacgcctaaaaatcattcagggctcttggtatcctttaccacattcactttccatattccctttctttagttcagacgctatcatacctcagggaaaaaaattttctatcaacgattcccacccaactctaaaatgactctcccctctctcccttaacatatcgaaggcctcttatacgtcaactagaccttaatagctcagacttccgagccttgctggatgatgcagaagggccaacataagaggatcaaatagagcgacagtccagattcagggttacttgtccacaccaactaatcaggtatcggaaaatagggcatatttgtttcagccgggagaccccctgggggtctagttttaaggcgattaggcctattgagatgcacatactaccttctttcatcttatcaccccgcctagcgactttgcaagcattacaggctaggcaccgccgaaggtagtccagtccgcttgttagattgaattgaatcttatataacctacgtagctaaagagaaaatcataatagtctaagtggacctctcaaaggtataaataagtatacattagtcttactggttcgatctttttctttttttgttatgatgcccacatttcatacttctcaattcttatttattcaagggttcgtatgtactgagtttagggtttagcccctctcttccaaacaccccctatatatacaagatgtagcttttgccttcttaaaaaaatttagatcaggaagaaggtgaaagagaggagaaaactaatgaagtgacatgtcggactcgccctcaccttttattttctcaaaagatcctcttttttaatgattggagtcatataggccaaattaggccggttcgagcaagggatataacttaaacagtttgaaaagttaaagaggcacaatatatgatttgcatatttaagattgatgttagtgttccatggaattttagggtgccgttttacacatgcagttgattttgcttattttgttcctacaaaaatattttctacctgtgaattttgcatagcgtagctggttagatttcatttcgtgaaacatataaactatggttgaaatcttagatttagcatgggtacccgcatttatggctaatttttccaggtgtaggtgatgtatatgtcaacagcaaggtgctcgtgatgatttcatcaatcgcaaggtacatatcgattgtggagtgcttgtagtgtcttcgtaagccttaaggtatatgtcgacagcgaaacgttggtggtgacttcatcaatcccaagatatattggttgctcatagagaaaagatgtgtatgtattcacaa

SEQ ID NO: 24224 - DNA, 2635 bp, Oryza sativa
cccctctcgtctcgtcctgctttcgcacgccggatcaaacgcaagctagcttcccatggtattcggtgttgttttgcccgaaaagcaatctatttacacctgcaaactgcatatatgaaacgcatgagtttgtggtaacgagggccgggtaagattgacaaaaaaaaaaaaaaaggggaggatatgcatgcagtgcccgtgaagtgcacgttacaccaaccctccatctatcgatccgtcgtctagatgaagctaaggccctgttttgggttgaaagttttgagaagtactacctccgtttcaaaataagtgtagccgtggatatccgtacccaacgtttgaccgtctgtcttatttgaaaaaaatatgaaaaaattaaaaatatttagttacacataaagtattatttatgttttatcatctaatagcaataaaaatacgaatcataaaaatttttcaaataagacgaatggtcaaacgttgaacgtgaataatgtaaaactacacttattttaagacggagggagtaagtcaaaatcaattggcaaggggccgacgattatgagaattaagaaagttggttttttagcaccgggcctagcaaaagagaaatcgccatatactagccattatttagatatgggtggagcccaagaatatcggagagggtctaacaccctactattcagtttataattacctaattagttagatggtcctattataaaaaaagaaattatttgagggagctttgactccatccattccccccttgtctccgccatcgcttggtgagtcatcagctagtgggagtatgtcaaaactagatttcccaacttcttgctgctagctgggttcattctgaatcctatagctattgattcacatagtctagatgagtatatggaccacttccctcggttccaaaatgtaaaaatttttaggtttaaacaaatgagcaattttattgtacttgagagataccatggggtaccaaagatttagtgtaaaatttggtatatcatagtacttaggtatcacgaggtatcaaatttacaattgaaaaggcagtacctcatggtatcttctcaagtaccgtaaaattgttcttacacaaatactaaggttaggtcaaaagattccatgtaaataacttcagttgtcaattttgaattgcttagtttttatttcaagcatttcattgtcttaggaatcatcaatagaatgatatgaatcttgggaataagtgcatgaatccttataatattatgatgtaaaatttgaatcatagaaatacttactctctccatcccaaaataaatcaacttttatacgagaatatacatagactatatccagattaatgtataaaattttatattttatagggcagagggtttatattttaaattggatggagcatttagaagaggtggtgattctataagaagctgtaaccattggaagctagaattaagggcatggtcgtttcaacaactcaggtgagatttttcatggcatgaaaaagaaaatcattaacgagtaattaattgactattaattatataaacttagaaattgattgatctttttaagaaacttttacatataaagttttattttacgaaatgtaccttaaaatagtttgataagtatatccacaaagaattaacgagggagttgcttgcccgagttgcagaaacgaacggaaccccaggcagcacaactcgtaagataggcaatcgcatacagtgtgtcgtcccggcctgctctggcagaagagcaacttcctccatgcctgactagcggcaataataatattccaggtccccccattgattccctctcatgtatctttccctttcaatccaagagatgcatgagaaaagctcatcatttgacatgaacatctcatggtatttgtgtgtgcagcagcagcagcaggtagcaagcatgtacatctgatgttccatccatccatcaaccttgcctagacatacttttgtcggccattccgtggtgagccttcaagtgcgcccaaaaagttgatctccatctacacacatatcctctcctcgtgaaaagaagatccccaagctatttgttctctctcacttacacacagtgacacacacatactactcatctctgtgctttgtttccctctctctctctctcttgtttcttttacagtacatgcaatgcacaggtaggtcacagctccatccaattgtaggataggagtatataaatgtttgggcaaggaaacatctttgtttttggaagtatctccagctacaataccccattgctcccttttttcccttttctagggcaaacaaacaactggacatgtctctcacagcctttctgcaggggaggttcgggatgcttgcacaggaaagaacacatagcaacagtagaagcttgaccgatacagggttgggaggttattgttttccagatgtagacgaagagatggtgataaaattggccccatcccaaacgcatagcgttagctctagcaaaacctggcgttgtttgaaccgacaggttcagttgaaattaaaaaagagagctatatggcaaaattatccactcctagcttgaatttgctggggatcctctagagtcg

SEQ ID NO: 24225 - DNA, 366 bp, Oryza sativa
ccccggtggccgccgaggtcgacgaggccgcagatcagcgcgcacgccacggggcccgacgcgaccgccaggtacttgttggcgagcagcgacctcagcgcggcgcaggagcgccggcccgccgcgccgtcgtcgtcgtgcagcgggagcagcggcctcgtcacgtcctccgacgagctctcccagtggctgcgcctcggatccatggccggttacaaatttaacaaaaatcgttacgcgattcgcctcttccgcccgccgcgttcgacgacgactgattggttttgcgttctcgtcttctccagctgcagcgtcccaaaaagcttggcgcttttatagccggcgcgggaacagaaacagagaaac

SEQ ID NO: 24226 - DNA, 727 bp, Oryza sativa
  unsure (1)..(727): unsure at all n locations
ccaaagaatgtctacgatcaggttggaattgtacaacttgatggccaaaaagattaatttccattattttttctcaatttgtaagcaaaaaacactatccctgcatgtgccttataatccaatgatttctgtggtgcggccagcgaaagtgcgaaacattcgcgtcgaccatatatttactacgatcacaattcacaaatggtcccggtataagaaccacgtacgccgtttgctttcagatggcgaaaagacggaaacccacattaattcagtgttggtcccttgctgattcattctccgtagctaaaatcttgctacatgttctctctacatctctacgtaccgtagccaaattaattaaggtaaataaatttccatcgagaataatgttttaaattctgccggttaatcatgctaacaattgttaatttgtttttagtctagctagctctttttataagcgggatcaggttactctcagctccctcaattagcaggtatctcccaccgcgatgttaaaaacaaaaggagaatttacattatttgtatatatatatttccctgtttattacttatatatgtcctgttcttagaaacgtcctaaaatatgtgcagtcaaacctcaaaatcttaagttattaatagattaattcaaaggtatcatgattcaaaatatgaaaaatgtnnnnnnnnnnnnnnnnnnnnnnnnnnnnnnnnnnnnnnnnnn

SEQ ID NO: 24227 - DNA, 3805 bp, Oryza sativa
  unsure (1)..(3805): unsure at all n locations
ttggcagaactgttcaaaagttcatggaaagacatatatagctttggatgtacgcaaaagttagcatctgtactcatatgaaggctatgagtatgtacaaataattcatgaaagaggtctcataaagatgcgtcctgaacaaagcaagcgaataaatctacattgacataaaggatgaataagttgtcgatccaggtctaaagtgcaagacaaatggtaaagcatgaaaagacaacatcatcgttttgtagatcccaaattccaaatacctacattccactttgagcagtaactaacagtcttacagtactgagactggctaggagcctaggatggctgctcaaagcataagaaatcaccaggaaacaagaaatagtccttacggtgtgattctctatgttactagctttgatgtaagaagaaaatagatactatatgtggatatgcatcttcctcatgcgcattatatcagactagcaatccagtttcatatttcagtggcatatttataactcactcgtctgcttaattagacctcagaactttcagttcacctcaaattcatctagcattccatggtctgctaaaagttagaatgccaacacagtttgacaatatttttgcttacagtagtaacaatagatggcatatgtgaaaaacacaggttgcattttgtaaagaagaaatatgtaacagagttgcagtggtgggatggtgtttagtgtctacagtctacacaggccaagacactaaaacattaagtgaagtacgtacccttaaaaagatacaaggttgttcaaatataaagcataaattgcaggatgctccattgtaggaaggaacaaattaatgccagattctgggcctaaacagatttctatgaaactttcaccaaggcagtgttttcccctccacttatttgctcgtaaagtaaaattactagccaaacatattacacatggcaggaggcaggcaactaattccttatagagtacagagcacaactgattattttcccaatttgctgcataaaagattgaagcttctacaaagtcaatcaaacctcgtaacccagagatcagttaaaacagttaaatggaattgctcctatgggcaataggagagaaatcagggtttaaaattatttccccaaaaaaaagtgaatgtgataatttttagaagaactctacaactcgtacaacatgcaagaacaaggttggaacttgacattgaagaatcgtcagctccatattggttatgtatacatgaaaaacattcaaacagcagaagccttgctgggatagcggaccttattttcatgggcattattcatcatgataacaaatctgatcagctaaaatattcaaaattgaaaaaaaaaatattttcttgtcttccctaacctcattgttagttttaggcaaatgaagtattgacaatgtaaatcttcctactcaaaggaacccttatatttctctgtatgcgtgtttacaattgttgtgtttagcaagatgccaagaaaatggaaaacaaaaacaaagcactatggtcatggtctatggtagtagctaaggaccctcgatatcatgctatctgaccttaatatgtgatatgctttcatggttcaccaggcgatggtgaaagtgtgtcctttaaaaactaatgatattatagtgcatgtcgttgatatacacatgtttcatgtgaagtgatagtatgcaaacggatatgttcaataaattgatagattagttggcaacttggcatcaaatgaacttgagagaaatttaagcaccataaacaggagataaacaaataacagccaccggtgctacagtacgaaatcattcattgtggcatatttctaagttattttcagatagcttaaccgcgccatgatcagtttagcaacaaggtaacagtcatcatatttggcaagaggagtagctattcgtgtttagggtttggcttcagcattcatcacgatgatgctcaacatatttggtaagagggatagttattcgtgtttagagtctggattcagcattcatcaagaataagataatgcttaagcaacgttcaactatttgctcaacctaaccccaacatgcgatctgcaactgagttagttgggaacgggtgaaattcacgaaaactctcagagcagcacaactaaaggaagagaaaataatagaattacaaagcatttcaaaatgttcagggcattcgccatcattggacaaattccacgaggaaacagaacaaaaacagaaacaagagcacagtgttcatcccgcacatctcaaacatcttattgggagtaaaacagatgcagtattctagggttcgaggtgacctgaggcgcgcagatcactcggcctgggcctccccggaggccagctcctgctgctggaggcgctcgagcgccttctggtgcgcccaggtctcgagggtgaggtcgggcttggcgttgagcccgacgccgaggatgacgacggtgaggaacgaggtgacgtagcagggcaactcccagtcctcccacttccgcgactcccccgccggcggcggcggccggttgaataggtagcccttgggctgctcctcgtgccccggggtcgtccaccgcccgcccccctccccgtgcccgccgccgccgcggacgcgcgccccgccgcgcagccgcgcccgcagcatcccccccgctgccgacgagatcgcccgcatcgaagcccccccggttggtgcgcgcgcccgcgtggtggtggtggtggtggagatcggagagaggtcgccgccgatttgggggagaaaggggaagagttgctcagctacgcggagacaatgcagaggtgaggagttgcaaaatgggctgggctttggtcaagtacattgggccgggctgaaaaggtcgggttaataatcattatgggccggatttggaggtttggactcttcttctcgattttgaagctcccaatgtttcgcttgggtttacgcttataagctactccctccgttccatattataagacttttttggtcttatctagattgattcattgattaatgtactccctccatcctaaaatatttgacgccgttgacttctttaaaaatgtttaaccattcgtcttattcaaaaaaaattaagtaattattaattcttttcctatcatttgatttatcgttaaatatacttttatgtatacatatagttttacacatttcataaacatttttgaataagatgaatggtcaaacatgtttaaaaaaaagtcaacggtgtcaaacatttagggaatgagagagtatatattttgtatatatgcctagatttattaacatccatattaatttggataatgctagaaagtcttacattgtgaaacggaggaagtaaattttaatttttagaactttattttagagttgattttgtggttttttttcatcgtagtttattttacaacattttcttatgaagaacacgtacataaaatttactaacaaattatttttaaattgctataataagcagttcgcataagcataagtataagcgaaaaaatgagatcttttttgtatgcaaggttggaattagtagttatctcctaattccagaaaatttgaactgtttggaacgaaggatttttgaaaattttgacatcctgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24228 - DNA, 9705 bp, Oryza sativa
aaaattttgacatcctgacagcagctatggagaaattttttattttcttgggaaaatttgcagttcagcgggaccaagatctggaactaaaatgacgaaactccatggaacttgatgtgtttttttttcaaaaaaaacttgatgtgtttgcgcttaccatggagaatgcacagcgcagctgactcactgaactcaacatcgctttatggagtaagcaaggtaacaggcaaacaagaagttggaacagaaatatgaacagacaagaacattaaaattcgaaatccagatcagaatgacagcataggtttattatagacaattgagattgaatttgattgtatctgattcagtcagttcagtactcagaaatcaattcagcagccattctcgcccattcgctgaagcttacagggagttgggacttgaggatttttattgactggtaagaaccttatgccattcaagcgatgattatcaacatggtaagaccattgcctttcatgtgatctttatttacacgtttcagaaaagaatcaccactcagattgtgatacagatacttgtacaaatgtgatgttcagtaggcttgctcttccattacctactgacagccagcgattgccagtcatggaatgacagcttgtcgactgtcgatggctggaagaggagaggatcaacatcccagcctttgaggcttcctcttgaccatctcatcctcacattgtcgatctcaaggccagagatgtgctccagcatcataccaccggttcggtgcttcaccatcttttggcatccaggcctgtaatcatacagccctcccgagtagtttgtccatctcttgtaggttaggtcgacattcttgaacttcaggttgcgaagcagcccgtgcttcgatccagccaagaatactccgttttctgataccgatgagatgttgatgaactgaatgtctgaaatggtgccttctttggaatctgggtgccttggacatgtggtgatgtagatcggttcagctctcccccaccataaaggatggtagtacctggtgctcattttgatgtttgagaacaccacatcgctcacatttcctgcaggaatgaaaactccagtttagaagaggcttaaagcaaatctcatttctagaccaaagaccttaatggtgcagtttttacttgatgaaaattcacaatagaaatatttcagcatacaggataggttcgctgctgtataaaaatttcatggtgctaaagcaatttataaattctatataaacacggggtacaaatgcagcataaggttcagttttcctaaaaaaatgtccgtgaaaacaatctaatatattttaattgctgcggaaatcttatagcttgctagagaaaatagtaagtactacctaatatcacagaatggcaatacacacaacagcaagtacaggtcagtacctccatctctaatctgcatcccaagtcctctatgtgaatcaactattgtaatgttgtcaaataccagcttcttgaagtcaaagaagctagcgctgccaaacttgatagcgcaagatttagtccgtatccagcagtttgttgccgtcaagttgtaaacaggacctgtggttgatttggggcatatcgcatcgtctccggcgtctatgtggcaatgagtgatgccagtgttgtttaaatctccaatgtcaatccggtcgttgttgggagtgtcaaaatccccatatatcgacacattgtggatcattgtattgtcacacctgacaatatgcagactgcagggaatgcaagtgcatatagcctgttaactttccctgaatacctcatcactacacaaatgctgtgtaatttttgctaatcagatgatatctagggcagtggagtacaaattagccggatttatcatctttaggatgaaatgacaagggaaatgttgtcatgttttggctgttctactacgaattgagcaatggatttgaggtatcaagaaatgctcaccaccagtaggcaggctggttgagggtgatgtcgtggatcgtgacgtccttggagtcgatgaatccgacgagccgcgggcggcactcgtcgccctcgcagtcgccggtggcgttccagctcaccatgatgttcttctgcgggttgggggtgaccacgaatgccccgccctggccgttgatctcgccgccgccggtgaccccggcgccggtggtgttctcggcgaggacgacgtaccagcggcgggactcgggagggtagtccgcctgcctggtcccgcccagcagccgcgccccgggggcgacgtcgagcaccacccgcgagcggaggtggacggtcgccgtcaggtagtcccccggcgccgggaggaggacgcgcccgccccccgccgccgcgcacgcgtcgacggccgcctggatggcccccgtgtcgtaccgcgcgccgtcgcccgccgcgccgtagtccgcgacggagaagacgcgcgcggccgccgcgaacggcagcagaagggacgagacggcgagcggaagcagcagcagcagcggggacgccattgtgacgttgactcgctcgccaagaagcactctctcttctcttctactcgagctgcacaggattcgcttgggaattttgtcagttggatcggggtttcatcgtgtcgccgccgtggcgcggacgatcggagcgagaggcagggagttcgttgcgaggggaatggatgatgagatggataagctggagtggtagctgcagctttcgtgctggactctcactcgaggatgatggataatgggattcatggatcaatcatactacctgatctcaaaatgtagatcacaggtgttcttggttgcctgtacaagtttgagagttgtggcacgaggttgcacggaaccagatcctctgaagttgggaaaactactcccttcattctaaaaaaagacaacatattacaacgaatctggatacagaggttgtcttttttaaaaaaaacagagagagtacgtcagtagcccatcgatcgaccgtttctcaaatatggaacgctcccaagaaaaatccaatgttgtccttgctcgcacgctagcgaacatgatagtgactgcgagcgatggcatcattggcttttttttttggagcattccatactcggaggacaatgaattgatacaccactgccctctaacatagtttttctaacatcagagaatgcggtgccaaggttgcacaggttggatgggtcgtggatagggctggaaaaaaggatgatggcactttagctcgcacagctcggcttgtttgggtttgttaacaagtcaaaactaaagtttaacctactcgtaaatctcaacttaactcatcccccatccactcattgtcacaccactccacttggtcataggcctaaatatttagactgactttagatgattatatgaaagtatgaaattaatggtgcatttgctaaatttgtgatgatttaatacttatattgtatgcaaacatttgtaactttgaaatgatgttggttcgaactgagcgaggcttttggctcgtaggataacgagccgagctgaactggcttgatatggagccctagttgtgggtgaaatgaccagtcatccgtgctttgaatggtatgagtttctgtagtagcaactcaccgagacagaaaacacaattggtgatattataaacttgaaaaattgatttatttttaaaaaatgtcgatatagatggttttgaaaaaaaaataccatttagcaatatgggaaaacatgcttataataaaagagtgaatagcttccctgtagcacaatcctcataaattggagattctgccctcctcatcaacaatcctctctttctttctcccctttttctttccccaacttgcgggatcggtggttggtaatcttgagatgcttgcagatgtcgaggtgctttcggagcagacgctcgatgccggtaaggaggtagatgacgttaaggtacattcaagaggccatctcgatggagcaggcgagcatgttgcagtataaaaatttatcgtcggcgcccttatcgatcccttattgtcgccatcgcatcctcgtaagagccctacccggagagacgacggagccctggaagcggcaaggttggaggacctcatcccctccccatcgataccctaagcatcaccatcggtgttgagggagatggggtgtggagctctgggtggacaacaagcggtggccggtgaggccaaaacagcaagggtggcagagcttggggaatcctacatcgactctgacttcccaccttgccgccccgccactgccgttatggagaagagggatgataaacggaggaggtagaggtagctacacgaagaggaggtaggcaagcggtggccctccatgaggcagagaggaagggtgtggaagtgagggagatggcatcagtgctgggctcatcagcctcgtctccaccgcttgtcgggttcctgctgctatctgcaaaagaaagaagaaagagaagaataagagtgggctatgacaagtgggcaccacagttgtttactttcttttgtaccacttacacttgaatcctctatctatttttggttcatcttatgactagactgccattagatgccaaatcactgaaaactatcctcaaaacagtcaagggggttattttaaaatattttaataattaaagtggtagataactagatataccaagttttgcacttgaaatgtactcctatatgagaactcacattagacttttcccccgccgaacaaaatcgagcctcttctcttctcgggccaccaaagaccaaacaaagctgggcctccgtgtgggcctcctcggaataggatcgctaccatatccgaagggtccacctgaaccgtccgatctaccatgcgcggtggatatcgattaggcgtcgtctcatcgtcttcctcctcgcgtgcggcggcggcgcgccagtggccgtgactgactctgcgccggcggcggcggcggcgtgcaccggcgaatcccctcgcgggaacggaggtctaaagcctctcccgccaccactatcccttcctcttcggctcacgctcccgtccccaataacctccgctttcgtcagctccattcttgcaggcgtctctcctcggctccgctcgcttcggacagtccgaaggctaaggtgcggattttacttcattatcctctgcaatttgtgactaatttgagttactactatcttccaatttatctgctctcccgggtgaggggaatggtttgggtgcattggcacttgctgaattcaattgtgcatataatgcattattttccaccagcttagggttgtagtcttgtgaattcgggcatgggaatggcctggtagcacgaaatctcggcttcgcggccaagacaggaacttaaataatcttaatgagaatagttttctagtgattcgctgctgcccatgccctcgaatgctcgggatttgggagggcaatttctccctgtagcacatcctgagaagttcacgaggataatatggattctctacgcaagtgtgacaaagaaaaggaggacaaattgcttttgttctagcaagtgtgcgcttatgatttagcatgcccatccttcccattgttttgtcgaatctcagcagaaagtggtcgattgctagaggttggagacattcagtcttttatgctcactaataactatctgccacacatttatttcctggatatgtcaacgatgaaactattttttgtgctgaaaaataatttaatcctcttcaattgatactaatgttgacatcaatcatatctatcataggtccgttgtgtcatggtggatcttctacttcattgtggtggtggcttgctttatttgattttcgtaagaattatctcatgttccactaattcttaattttggtcatcgaaacatgtttttcagcttatacttggtggcgcggtgctgcctgaagcagatggctatctacacacctactgtctgtttacaacgctgtacttatagcttgtattctcagtcttgtcagttacaaggagggctgacacagggcatggcattatggaagtattctcgttcacaagcagtcggttatcatgtaaagatcagattagttggtttgcctcctaagatgaacataaaatcactgcgaacatgttttgccagttcggggaaacagttgtgtggcagacaacctgcgagggataatattctaaagctaaagcttgatgagccctcacgtcagaagttgtatagtattctctgggattcaagaagcataggacacaaagttggagctacaggcactggacttttcctaagttttgcagttcctgcgaaggcaaatgctgagggtcctgtggacaataatactgatagcccccaaactactgaatcgtccactagttatgctcatgggaaaaaagtttgcacggattattctgttactggtgagacagtgtgcgtgtttttctaattactatacaatatgcatttggttaaagcatgcatcgtctgctcacttgtgtttgattcacatggtaaccctcaggcattcctggagatggaaggtgcttgttccgatctgtggctcatggtgcatgtattaggtcaggtaagcgacctgatgatgatctccagagaaagatggctgatgacttaagagcaatggtatgcttgtaatgttctgctgatgtactactgttgatccattctgttcttagatactaaatgttgctctggaagcaacgcaaccatttctggtgaatttatcatgtaaaagatctatttaaatggtgtcactgttaggtcgccgatgaatttatcaagagacgggcagagactgaatggttagttctacctgtcctcattattctgttagttactctgcatctaaatattgttgagttacgcattcttatgcttcgctatgacattaattcacaggtttgttgagggggacttcgatgcatatgtctctcggattaggaagccacatgtgtggggaggtgaaccagaactgttaatggcttcgcatgttcttcggtgagaattagccatgatgtttggagttattttactctcaccatttcaaatgcagtatacatttgtgcagtaacctgttagaatacttatgccctcttggtcatatttatatagggttgatggttagttggtttgcttttaatccattttaggattcctgggataagtttgtccacttatactgtcttgtttgtttgtttttttttgtcatgttatgactgttaagcatcttccttttttttttgcggggatcttcctttttttttttcaaaacacaactcccaaaagtcattaatattccattttgttaggctttgaccaaagtttattaatgtagctcaacagcaatagtggatagtttcatatatgtgtagtcttgttgtattgtccttctgaaaacgggaagtaacaaaagctctaatatgccgttaccaatgtggccaggatgccaattactgtgtacatgcatgataaggaagctggtggtttaatagcaattgcagaatatggtcaggagtacgggaaagaagatccaattcaagttctttttcatggttttggccattatgacgctctacagataccaggaaagggtggtccaaggtcaaggctgtaacatttggagctcagattccaaacagtaagttttgaaccaacctttgtttccctttcttttcccagtacgcttgctgtccaaatgtaaccagaatctaccctcaacaaatttaaaatgctgcgatgttccaagttccaaccgctgaatccatctcttcttctattttggttgcactagcctcccttgtagtacatgtcaaaaagaaacttgcatgtatgcaccctggctggctgcaagcagcttgagtttgcttaccctgcaaacctctctgccgcgtgagccggccggtggccacaaggcgacgccgtctttggtcaaggctgtgaggtatccggccaccggcctacccacctgagccgcggtcgtcgtcgtcgtggtggtggtggtggttggcttgcactggtgctagaatgctagatcctatagcctcatgctgttgtgtcaaccgggagggaagcttagcgctggctggcgatctcaatcttgcgccatgcttgcctgcccgggccggtgtttccccgtacggctccggcttcacttccctcacatctatgcagtacgggggccctgcagttacgtgggcagctaccacctcttgtgcattgaaaggccaataaaaactggacttggcatctgctactcaggtctgggctggttgtctaactctcatgtgtttatgtgggcattcagttcagatcagagatcagattggagtcctccctgtcccccaaagaagtagagggctttcacctaactaaatttgtgcaagagccatgcactagcgtccaagtaattaagagagaaaaaatggttatttgagtgtaaaaaaaaagattatactcccactgttccataatgtaaaatgttttggtttgtccaaagtcaaacttcaagtatgacaaagtttatagaaaaaaaatagcaacatttccaacacgaaacatatgtcttttaaaaatatatattaaaatgttgatttaataaaactaatttagtactgaaaatgttgttatgttttattataaagttaattaaaattagataagtttgacttagaacaaaactagaacatccattatggagcgaagggagtattatctaaggtgggtgttagaatctgataccgggttgtgaaaatattattatttggacagcaaaatattgagaccaccacactaactaattgaattccttttgcaaaataaatatccatgcaacctttacacataattccgttatctttgtcttttcatcctttcatgctcctgtagtgatacgccctgaccaaaggtgccaataatgtgaagcttatcccaatgaaagaataatgtgacgtgattttagctaccgagaggaatagtgttcctgcaccacgatcactttggtaattggctgctgagagtaccttcctttggacctttctaagacataaaaatttgcaattgctgtcaggattcaggagattattctcaggggaatatatcacagaacattagtacataaatggtatagactgcttcagataataatgcatagatccttctgtatattcgaacaaaatgtgagcattattgaggaatttccaccggtaggaataatgggaacattaggttccagaaacggccaagttctcgtgaagatcatgaagcgctcatggcgacacatacatttcacaaatcctttggcactaatctgcagatggtatattggtattatccactgttcttgcagataacttcagaagatttttcttgcttgcaacaccttcatccattcatccatggtgaggtcgttctcgtttgatcaaagataccttatgccatcaagagatccttatcacgataattatgccattttatgtacaaacgcacatacactccatgactccatgcattgggggaccttttactgccgttggattctcgaggaatagcatcctcggatatggttcatcactttatcaatattagagcacacgattcttgatacgcctattctcgagaatagattcataaa

SEQ ID NO: 24229 - DNA, 431 bp, Oryza sativa
aaattgaaaaaaaaaacaattccatagagaggacctagcaagaaaaactaaccccactcattaccatgcgcaacttttttccctccactcacccgaatcctcattttcccttctctcccttcgtttgccctgtctccccttgtgatacttcacaattgttgcctgcaagtaattaacatcctccctcatgacgcaccatatctcctaggcaaaatttgccacaggacatgcaaaaaaaacgtgtaattggctaagagacaccgtgaaaacatgacacggctgatggacagtaaaaaaacatgtaattggctgtaggacaccggtcacattttttttattatttccaggtcaaaagaggtgagatatttttctaaatgcctgacttgccccttctctttccttctttaaacaccggtgggctcccatgtgtc

SEQ ID NO: 24230 - DNA, 2936 bp, Oryza sativa
gactcccctctggccgtggacctttcgacggctgccgaggaggaggaggctagagagcgaggtaggtgcggaggcaatccgatccgatgaattggcggcggcggtgctccatggcagggacaatctcgccatttgaaaaatattatcacctcttttgatctggaaaatataaaatattgtctccggtgtcctatagccaattacacaatttttagagtgtcaatcagccgtgtcacgtttttacggtgcctcttagccaattacacgttttttacatgtcctgtagaaaattttgcctatctcctatttgaccgatgtcatccgccactcctcgactgctcttatgacgtttgctttggtaccttttcatctactctagtttgatatctatgacggtttgtgcgctttcgacctgtgttaccgctcattagtttccatctcaagcacatcatcaagggccactttccatgcatgtccaggtgatggtacattcttggtggttgcttttgtccagacataaaatgccaatgagaacactgttttggcaaacacatggaacccacataaacacacatgccacatgtatacacattagctagtgacatgagccatgtccccttaaggccttaactaacaccctcaaggtctcaacagacaatgtccatgaacaaatccactaatctcataaaatttctcaattgtactatatcacatatttataaacgtgagcacccaggacctgcccgtatataccaaatacgtgttttgcttatggtagtatatggaaacaacatgcaaatgaaaaacagtatgtacaagcttgagccaaactctgtacaaacatttcgtctgaatgtgtatagtatatatgatggacaaacaagaataaaaacgccattattttcaatttgcgttagtcaatttgcgtcagtcaattttccatgtgtatagtaagcaaattgactgacgcacacatcgcgtccttgtaacgcagcatctcatattctagatgaacgaaagtacataccactgtacgaggtgatcgaaacaaatcgatcgagaatatcagacccgctggcaaatacgtacacacattgcattcacaggcaatatatgcagcttacagaccactccacgctacagcacccaaccaattaaacaagaaagatgataataacaaaacaaaacagaaaatctagacacgatcgatcgatcgattccttgatcgcgacaaagctacgggcgcgatcaatttgagatatcgccctagcaaaattaaagctagcctcctactataccagatcacggagttgcactaataatcaacaagagaacaaggcgtgtacgtcccaccagatggcgacaccaccaccatcatcaacagtgtgtacgccgtactacgtaccacgaagaagaagaagaagaagacaatcaccaacagcgagcgaaaccgatgagcaaactcgtatacatccacggtagaacgtagtagactagtagttcatagtagtagtgttgttacaatgaagagattcactctggtccaataaaaaaatacctcgaggttaccgatacattatggtaccaaattgtttccaatcgctggatccaataatacatatcttatccagctaaatccaacgatcagaaacgatttagtaatgtgaggtactagtacttcgagatactttttgctggaccgaagcaggtctttgcgattagagggatcgggcggcgggggcggtggaggaggagtcgtggtcgaggtcggagacggcgccgtcgtcgtcgtcgtcgagggcggcggcgccgccgagcgcgccgtggccgtggccgaaggcgcgggcgtggtccttgagggaccgcttgtgcttgaactcggagccgcagaggcagtaccagagcttgccgcagttcttctcgtgggtgcgccagtcgcccttgacggcgaacgccttgccgcacttgcggcacaggaacggcttcagcccgtgcttccgcttgtagtgcgtctgcagcgtcctgaagtccttgagcggcttcgcccgcgggtggtcgatgttgttccggcagcccgccgcgcagcagtagcacggcagccgcagcatcgccgtcggctgtatcccccgcagcgactccggccccttcctgtactgcgacccatgcccccacatatgcatctgcatattatcatattgaactcatcatattactgtattacgtatatactctatcaaataaacattgtacaatactactatatacgccctaagttagaaaaacacaacacacaactcctgaaaactactccgtgtatatgtacgtacaccgctagtaactcagaacgcagatgtcaggttgttgtctgtatgatcgtatgctggatttgcaggctgggttcaggcaatggtggtttccatgtgaacatgcagacttgtactgttactgctgctgttcatttcagtgtggtactaggacaccgtatactggctttctttttaatgcgtttgcttatcttgagatatttgcagacatctagtacggataatcagaagggagtcgatctggctggacctggccggctcatgcatcaatctctccttgctctttctcacacaaactttccggctttccccatgcatgcagctgtgataaaccggagaagccgcatgagcgcagaagaaacgccggccttttgaaagtgagggcgctatatatgtagctcttcagatcagacaaggctatggcttagctagtagtaggagtagaccattgcttgtgtgtttgtgactgttgcttgtgagatgagagagtgtgtggcgtgcttgtgcctgaggagcacagtgtgtgcgtcagggacagtggagctaagctacagcaagaacactgcacatctcttgcagttcttgggagaggtaaacggcagctgtagcaaa

SEQ ID NO: 24231 - DNA, 2340 bp, Oryza sativa
ctggccatatctgtcttgttcaatcacacgaaaaggcggccactgtgcgtgcacaactccaaccctctcctcctcatctcagctcagctcaatctccggtgatctcagagaccagaccagacaccagcacgtgtagcttgtatccactacttctcttatgagatttgctctaactcaaggtagcggtaactcacggtattaaatcatttccgatcgtcggatatagctgggtagtatgggtattgttagatctaacgatccgaaacgatttggtaccacagggtaccagtaccttgaggtaacttttttttttttttggaccggagcaaatctccttctcttatagcttgcttgctagcagttgctagtactcgtcgtatttcaacgataagctaaacaaaaaggtacgagctagcactagcagccatggaatcgaaggagaactgaactgaactgctctctagctttcatgttccctccgtttcaaactagatggctttgaaaataggtcgccagtttcaaaatatagctatctcattgaatggattttttttttcgaatggaaaaaaaatagctatctctgtagttcaaattatatggctttggaaataggaccttcatactttgtcgttcattaaaaatatggtgtgcgtgtatgtgttcatatggatgaatgtacacgtgttatgagcgattacgtttatactgtgtttctaaaaaaaattgactttggaataggagcttcatgcttcatcgttcattggtctgacagatcgagcaaaagaacaaattaatgttcagagaaagaaaagacgggattcatgttcttaagctagctagcccggctatggagtggcaagacacacttgataatcgagatttactagtgtacgataattccaagatcagctgcatgttgtgtgggacgttttttgtcaagaatttctcagataatatgtaggtttagcagctagcagagtatctataatgcaaagagaggttggtgaatatatggatatttttacatagatacatatgtatatcacttaattaatcactgtaaacagataactcttaagtaattaattaggttcaggctttcttcttaccaatcctaataaaattcggtcggcctaattctttcagtcaacccggcaaaaataaaattcagttttttgtttttatataaaggtagtgcaggttttcgttcgcatgctgatcgaggctgagtaactagctaagtataagaagcatacgttaatgggatcaagaggtatatatagaacgagtgagacgcattgtcaaacattattccgacaaaagaactagcaagtaattacacccagctagatatgcagcgttcggttcaagagccataaagctcccctgaactactactgtagaaatttttcatagccagatcttagaaagaaaaggtaaaaattgcgtcgcctactgtcggtatcatttatttgttaggtgattgcaattaggatatgcttgaaagaaaaaaaaattagttctagctagatcggatttattctagcctaagaaaagggatttatcaatctactgaagaagacatatgctttgtcataccatgacgacaaaaacgggggaagacgaacaagaggaccactagtggtacagtttggggatcacgcatgatgctatgtctaattctaagtaaattaatcacttattagtcttgaattgcgacaaaactgaacagcaataacccacaaagaatcgcaaaaaagaataaaattaaatggagcagcgataatctagagcaagcaagaacagtagcagctagcagaattaagctgtgaagagaaatgaagaaattgctggctgacctgcatgttgttgtatcggttgaaggttttgaagcagacggggcaggagaactgcgtggggccgatgaggatctgcgacggcgtcgggatccagtactggcccttgttcagacgcccgatcggcgtcgacgcgaaccctagcggcgccgcggcgtcggcggcgtcgccgccgtcgccgtcgtccctgctcgcgccgccggcttcctccgcctcgtcctcttcctcgtcacgacgcgcggtggaggatcttctcccggctgctgacgagagccccgagatgaggtcggcggcggcggtcgggctcggcaggccgatgtgcagcgcgaccgtgacgtccgcgtcgtcgtcccccgccgcggcggcttcggcggcgcagcagccggagccggagccctccacgtccatcgggtctcccgccgcagccttggtgttcaggtcggcgaagagccgccccgcgcggcgacgacggagctggtggtgt

SEQ ID NO: 24232 - DNA, 2690 bp, Oryza sativa
agctcgtgtgcgtgtgtggtggcgtgggcgtggtagttgccgaggggttattatagggcgtgtgagtgtgacagggaaggcccccgaaggggattgggaatgagtatatttactatttactgtggaggttaattagctaatgtgtgcatggaggacgtggtacgtacgtacgatgtaccgggagataactcttgttttttcggattactaagatggacgcacgcgcgcgcacaccattatacactctccaagagtcggaaaccaacagcgcatctctgatctcagtaaaaacttgttggaagcccaactgcatgtgcatagttttcttggacatcacgatttaaaccctggtgggtgaaatcatgtgcatacgacttcaacaccagattttctacttcagcaccgcaccagtggtgcttcccctcttggtttttttttctttctcgtaaggagggacatgttctttctgcagagtaaggcttcacaagctcgatgaattttgatcggatttcgggaatttggatcatctcgagttatcatgtttggagtttatggaaattcattcgaaatgtgtcgatttttctagattggcgaaaaatcgatgtctcactgggctcgaatttcactggccaatcaataccttgtgactttatcacttaaattttgtattttatatattcattaaaaggttcatgaatagaatcaaaatatagataagaaatatatgccctctttagggggcttctagcagccatagatactccgagaatctcggctagctccccaaacaatccaaatgtttactcaagattgtgacacttagtaaagctaaaaatccaggaattaattagtgctataagctaggggattatatatacttctctatattctcaccagctcgccagatatattataagaaatgttctttttatgggaaaaaaagatttgtagtcaaatttccattgatcgattcatttttccatatgtccttatttgaaattaacgaaaacccatttattgtgtgtgcccatagttacaagctagtgatggtacatgtactattattatgtgtttggtttataaaattttgatggagaaatcttgtccagatgggttttctttctttcggcccggtactgttgttccttatatatacacattattagcattttgttataggtcaatttgttttgtccggggccacaattcacggattattgatgctgctatttaaagatgagcaatagcttgtgtcaaaagacaactaagaacatcatcaccggtcttgaccaaactacaaacgtgcaactttacgagttcttacattaatttccgaaatattgtaataatggaaaaaagatgttttctgaatcggttaaaaaatgaataaaattaactaaattcaggatgtatgaagcacctagaatatgaatatatatggaatgagggatcctaaaggacaaatataggaatcgagacgagagatccgaggatgatatgggagcctagagaacaaatatatatataggacccaagaggataaatatatatggcactttagaagaaaactaagaggacaaatatgggactttaaagggaaggctcaagggatgaataagaaaatccggaggaagattctaagggcgcaaggccttgttagtagggaaaaatttttgggtttggttgtcacatcgaacatacggacacacatttgaagtattaaacgcagtctaataacaaaacaaattacatattccgccaggaaactacgagacaaatttattaagcctaattaattcgtcattagcaaatgtttactgtagcaccacattatcaaatcatggcgcaattaggcttaaaagattcgtctcgcaatttacacgcaaactgtgtaattgtttttttttgtccacgtataatactccatgcatgtgtccaaacattcgatgtaatgggtgaaaaattttgttttgggaactaaacaaccccctatatgaatgtggctacaaaataacaccgatatttaattcttacaaatttttttcgatatgcatctttggagcaaaacttttattacatatgtacacttgtcatataaattgaatatatagcaaaattataatctataaaatatttttgtagaggaagattcgcatatactgttcttgaatgactaatctaaacatttaaaatatcccatagtaaaaatgtcaccacatcacattttctgtacattagctatgttttagtgtggaatttgcgcttgtcgttccgaaatgatcacaactttgccctttcgagggaaggtgttgggttcctgtccatcgattcagctagtatcttcttaatggcaacatattcaattttgcttgcttgaaattatgaaatgttatatagcatataattataattaccgtttcaagtaccaaatgttgagaggctgatttaaatattctttccgaacttcaaaactttggatattacaatgcgaaactgccctatataaacacatagtatattgtaagaatatgaaaagggtgtaaaatgtgacatcaatatagtatttgtattttttggagaatccattttgctattgttaattagagtctagacgtcataacactcggtgagaaaaaaaccgaagtatatattgatgccttagacctcttcttgatggcattttccaagta

SEQ ID NO: 24233 - DNA, 1901 bp, Oryza sativa
aaatatatgctttagagatcgtattgatgtaataaacgaagtaaaaggatcggagaaaattagagcattataacccaaaatggtcttacagagttatggtacgttatattgaaagagaagtcgtgcataaaaaatacttcataaagcctttgttggaaacacacttctcaatgtgtttgaatgaccccgcaaaagcagtcgcaataagaacattggtcaacatatgcctcttaagagctacaataagataataagcgagttatatatgttatcatattatatttatacttatgtggaagaaagataagaaatgatggctacagatttgtaaccatctgcagcaaagtctccaacaaactactccctccgtcgaaaaaagaaaaatcaaccttaggttgaggtttttttttaagacgcaggagtgtatgaaagagatgggtggattagatattaatgatgtaatatatatatctataattaactattgtatgagtggactattaggttgattatagatgatgttttaatttttgaagccaaaagttggctatattattaaacttcgatgcaacttctatattattaaacaaagccatgggttaatatagtagtaatttttaaagcaacttctatgcggttcgagaaatgtgcatatagaaaactatgcacatttctcctatacaatgttttttttcctgaggaaacatgcagggagttcctacaattctttatagaagaagaaaattgatccagtactcctatacaatgttcaaaacattgcctcctttgaaatggagtactattttcaatgaaatatcaaaagattaagggtgtgtttaggcttcgttcgttcctgggcaatctgggggattgagagaaaaaagcatctcgttttccgcgcgcacgcttcccaaactgctaaacggtgcgttttttacaaaaaaatttctataggaaagttgctttaaaaaatcatattaatccatttttgaagtttaaaatagttaatactcaattaatcatgtgctaatggctcatctcgttttgcgtatcttcccaatctccccaatccccttctccttaaacatgcccttagttcacgtcaaaattaaaagtttggttgaaattagaacgatgtgacagaaaagttgaaagtttgtgtgtgtagaaaagttggaagtttgaagaaaaagttgggaactaaggccctgtttagatgggactaaaacttttaagtccctatcacatcggatgtttgaatattaattataaatattaaacgtagactattaataaaacccatctataatcctggactaattcgcgagacgaatctattgagcctaactaatccatgattagcctatgtgatgctacagtaaacattctctaattatggattaattaggcttaaaaaatttgtctcgtgaattagctttcatttatgtaattagttttgtaagtagtctatatttaatactctaaattagtgtctaaagatagagactaaagttaagtccatgatcaaacaccacctaaaccagcgtaaaagagaagaaaatgggcgtaaagccctgttccactagagtctgccatccatttgacctcaacacagtttttgcttgtacggaacgtatctttgtcacgggttcatgtccacagtccacctgcttcatctaaaaaaaagttactgtcagctcgatggtttaagttaccatctagagtagaccccacagcgctatttgctcccattgagtcgattattactacggaaatctttacaaaacgcatatgaaggctgtgtttagttggggaaaaaaatttttgggtgtcacatcagacgtttgaccggatgtcggaagaggttttcggacacgaatgaaaaaactaatttcagaact

SEQ ID NO: 24234 - DNA, 13430 bp, Oryza sativa
cccccctcccctccctccctccctccctccctccctcccaatgatactactagtgttttcgcttgatttaaatgcctttacgttttcatatgagcacatattgctcctcctctcgtaattaaccatatggcatccactattgacaaatagtactcccattttgtcttagtataatagtagtatcatatgagcacatagtgtgtgtcttagtgtgagcacatattgctcctcctctcgtaattaaccaattaactctagtatcatagtgtgtcttagtgtgaaataagatgggagtgtagctactctaaaaatagagtaaatatgacctgtttaacttacttccattttcagagtatcatttgactgagcctggtattgataagtgcttctagatgctatgatggcaaatcaactgtacattttagtttcatttgtggtatgttttattgcatactcagctaaaaaattgtattgctgaagcacttcagtgtggtattttgggtagattatgtgcattttttgctcatgttggagctttgggttatagaattcatcagattgcagattacagatctgatagagcaatctgtcaccgtattgtcaggtcttcaattgctatagtccttacaaccaattttctttggttaatacactgctattttcccatttgtgtattgaaggttctaaactaaggcatatatataatttctattaaccctagtttggattggattggacaaaaataatatagtcagcctggatcactatttgctagtatccgaagctccaatgcacaaaatgcaagcaaaccaaaaagaaggaagaaaaaaaccccgataagcaacagaggttcaaattcagccctcatcaccataatcaacactttcgcgatccacattacccacttgctgtcacacttcttcaacttgcaaaggcacttaaaagctgcatcaatagatcagtagataagcaacttcatatggtgatcgattagcagctctttttgacaacaatgccaccacaccaccttccatgtgtgatccttcattctccatttaatgatctctcaattcctggcagctacctggagctcaggcctaaagaaatttccaaaatgtgttgccatcgatagttggtggagctaccgcaccaattagcttcaatcttgaagttatgctatttttcttcatacagctactctacagcttgtagtctttatattgttgaaatggatgaccaaacagtattgcgctgccagtgatatgctcaatctccgtacttctcttagccctggctgtatttaagatcaaggaggatagacttagacaatgcctctgccactgttgggtgccgcctaaatgacagtaggtatcatgcaaaatgaaccctgacatcaagtgccacttgaatgctccaaaaaaaactccttccttcaaccttgtttaaaagaatacattagacatggaaacaacctgttgaagctctgcaaacattagcagttacaaacggattagttcactcatagcattcgatcacttgagatgtttctgcactaatgaaattaatcgcttactgcatcctttgttgagtatgctgttttggactaaaaaaagttagtagtcgttcctagctttatgctgattgttttatgaatgctgtaccataatagtaggcattctaactttccgaactgatctctatgttcttgccctgatacttgacagacatccttcacatcttctcatatctcccaagagatctgaattttattgagcacacaagcaatattggttggagggagtaagaacacttttctgccatgtgtttctgaacctttctgatattttcttcattatgattgtttctggttgcatgtgcaggtaccaaagggcgagaccaattattgtagatccagcattgcagatctcaaataaaactgaggttgtgacaacaaaggagaaaaggagcttgccttcagctttcaaaatatttgtaggtattgcctcatccttgttttctacttaggaaatttcatatattctgtactagttatctgcaacattttactgttgcctatgttgatatgttccctcttttcaaaatataatcttttcgagcacagtactgatagattcttccatatttttatggtgtatattagaaataacaatttcaatgttagctgcgttttttgcgcactttatagataatatattatatatcacatttcaatcataaaattacatctagaggttgtataaccagcaagctcaggctttgtttagatcccaaaaaattttggccaaaaacgtcacatcaaatgtttggacacatgcatggggcattaaatgtggggaaaaaacaccaattgcacaatttgcatgtaaattgcgagacgaatcttttgagcctaattacgccatggtttgacaatatgatgctacagtaaacttttgctaatgacggattaattaggcttaataaattcgtctcgcagtttacatgcggaatttgtaatttgttttgttattagtttacgtttaatacttcaaatgtgtgtccgtatacttaaaaactttacacccgaagaactaaacacaccctcattcatgaaggtaaagtagttttttgcataattggtggtacttttatgtcagagtgtcagacatagaagacttgtaaaaggggtgattgtgcaaactatttcaaaaatatgatcatacagagatctaaatagagaattcctcgacaactgaactaacaggacacattgcattcttggtcagcctttgagacaagcagcatacggaattctggctctactagattgattattctgtctacctcagatatatatgggataggaccataatgcatcccatttctttaccatttggacagctatcatcgcagttgcacatttgggtgacatctgcattatatacagatgcctgtattttgactatcaacattctgttggattatttaaaatgctcgatatattgcttaattcacagtccactcagcacagtcaatgggcaattttatcatctgtagagttgagctctaacctgtaatgtttctcctgacgcaggctcttcatgggtaatacttagccgatcattcctggaattttgcttattgggatgggacaaccttcctcgcactctactcatgtattttgccaacttcttggcatcctcggagggctacttccacacggtgatctgcaactcaaagtactatcagaacactaccgttaataatgatctccgattcatggcatgggacaaccctccacgaacattacctgttaacctgacaaccgagcattttgacgcaatcgcaagcagcggtgcaccatttgcacactcctttgccaatgacaatccagtcctggatatgatcgacaccaagctgttgaggagagcacctgaacgattcacacctggtggatggtgcttaggtagctcggtaaatgacaaagatccatgttccttcttcggaaggtcttttgttctgaggccgacgaaaagttcggcaaagttagagaaattgctgttgaaacttttggaacctgataatttcaggtctaaacagtgtatataacacattcttgttacatgtagccttgtagccagttgtagaattttgatagtgttcagaggcaagtgtgaccggaggtggagatggtttctcattgttgcggctgtaggcacacagtgacacagcgtgtcgttgtacatttgcaactggaaggtcaagtaaagtgactgaaatcatacatttacacaaaattttcatctctttcatggatacgaatacgctgcacaatgtgccatggaatcaggtaccccagttacagtggagtcaggccgagttatgggcttgcggctgaatttttcgtgtaaaaaaaaagggtaaaaaaaaaaagaaacgcctaccgagtaccgactgttgatttcgtgaatccttttaatgcagcctcgtagaacgccaatgttcgcttcacctcccaattgcagttcacacttgtgtgtatgctagcaaaatggcttcccgccttcctctgattaaaactgcatgtatatctgtataaatgcggcacaatcccctgtactgatcagcgatcacccaagcaacttctcggctctctccctcggagaagatggggtttctgccgggcgacgacgacgggccggcggtcggcatcgacctcgggacgacgtactcgtgcgtggccgtgtggcggcgcggccgcgtggaggtgatccccaacgaccagggcaacctcaccacgccgtcctgcgtcgccttcaccgacacctggcgcctcatcggcgacgccgccttgaaccaggccgccatgaatcccctcaacaccatcttcggtgagaactcgaactcccttatttgccataatgccatccatcccagtaccaaacgctagtaactactgtaactagtaagtacttgtttagcactattccttttaatttgtagaacaaacatagaaaagtttagactcaatcctatataaaaaaaagtcctataaaatttttgaaatcatattcattctttgaatctatctatctatctatctattctattatattattaaaacagctttgaaagaatgcaccacgtccgctgtggaggctagaaattcccacattaatcggggaaaaagaaaaaatctacaccgttagatcataacatatctagactacaagggttgagatttaatcacaatatatgtaaaagcttgactctttgattctgtttttatgaatcggacacgtgaaagagcgtggagttagattttgatgtgtgctacgcagcagcctttgaaatcaaaatcaaattaggaaacttaatttactgacaggagacaaacacgtcatgtctgcatagctaaattagaaataataaatatgcacaactgacacgtcctgtacaaaatcatatgtaggggagataaaacaactgggcatccgaactccttcaaccacatttaagttttgctctatcgcataatctttagagacggtatgttttttagaaaaaataaattctactccctccatctacttttgatagtcatattttcaaatctgaaaattctatttttgataggcatatttcaattcaacaacctatcatcttaatgactttctcggatttgatgcatgactctccattcttccacacaagattggctacttgagcatcgtgaaatgtaaatattaatgaatcgcttgtttacgaggaatgactagtagcatgtttaaatggatgataagtagaattacttatcattggtctgtgtgccaagatgaaatatgactatcaaaagtagatggagggagcaagtaacaagattcccaatagctttctctatatttagggtccatatgttatagctcatactccgagaatggggcagagctgagaagcgggcggaaatcaccatattaattaaaaaagtgaagtatttaaaggatctagattttaatggtgcatattgattgatataattatatacaaataaaatattctatctattatcttaataaagtaatgtaaaaaaagtctctaagtttgctctcgagacttacaaattctcagattaaaaaaaatctaaatagtttgatcatggtcatgcctataaagaagtagagtggtgacggttgatgggaattctaaaaattaaaaacaaaccaaatagaatcccaatgaggattaagaggagggacgacagatagaccgttaagcagtatggttatagcagttggttggacttatagaaagtaaaaaataaacctaatgataatcatgtacaatttttaaaatatcaaaaacaataaggagaggaggcaccaggcgagccgtagatgagtacattggcaaagccattgacggtttggcagaacttctagaaagtaaaagctgaaccaacacgataattatgttcgttttttaaaaccctaatgataataaagagatgaggcagtgggtgccccatagagaagtacagtggcggtgtttaacaggactttaaaaattatggaagagttcatgcaggaatacaatttataaataaaaaatgctagaatgaaaaatatggaattttcaaaaaaaaaaagaggacaatctagaatacaacaatgacaaacgataataaaaatgagaagcaacatgcctataaagtagtagagatgatggttgatgggacatctagaaattataaacaaaactccaaatagaatcccaattaagattaagaggaggaacacagacatgtcgttaagtagaacgttcacaatggttgagaggaggcagcgggcgagccataaaagagtacgatttggcaggacttctagaaagtaaaaaaacaaaccccaatgataatcatgtataatctttaaaatatcaataataacaaagaggggaagcaacggacgaaccatagaagagtacattggcaaagccgctgaaggtttggcgggacttctagataattatgttcgatttttaaaatctcaatgttaataaagagaggaggcaataaacgggctgtagaggagtacagtggcatcgtttgacgggacttctagataattatgttcgacttttaaaatctcaatgttaataaagagaggaggcagtggacgaaccgtagagcatagaggagtacagtagcagtgtttgacgagacttctaaatattgtaaaaatgaaacctaacaagccaacaaactctaaaaactataaggtataatttttaagttttcaaggagaataaatagaaacaatggtagatcgagcaagcaaataacggagatatgccaaaggagtgagtggtagcgactggcgtgacttttataaactataaaagtagaaacaccgggatgataaggttcagtccaaagtcttaagataacgagataactatttgacaaattttaagtaaaatcatatgtaaaaaatagataattttgtatggatgctagccgcgcaattgcgcgggccacccagctagttcctatataatggataatcttatagatattttagaagaaaattagcgagagctccatcctcatgaaaaaactagtcgtgtttttttttctatttaaacaattattcttgtatttttaacgagttttgcaatcttctatttcgtacttgtgatttttgtaaaaatgttgtgtttttgaatcgattgatttcttgtagatgcgaagcgattgatcggccggcgattcagcgacgtgtccgtgcagggagatatcaagctatggcctttcaaggtcacctccggcaaggacgaccggccgatgatcgtggtgcagtacaggggcgaggagaaggagttctccgccgaggagatctccgccatggtgctcttcaagatgaaggagaccgccgaggcctacctcgacaagacggtcgagaaggccgtcatcaccgtgccggtctacttcaacgactcccagcgccaggccaccatggacgccggcgccgtcgccggcctcgacgtcctgcgcatcatcaacgagcccaccgccgccgccgtcgcctacggcctcgacaaggtggtcggcagcagcgacaagaagaagagagtgctgatatttgacctcggcggcggcaccctggacgtgtccgtcctcaacatcgaccccggggtggacatcgacataggcatcttcgaggtgaaggccaccgccggcgacacccacctcggcggcgaggatttcaatggcaggatggtgaagcacctggttcgggagttcctgaggaagtacaagaggccggagatcaggggcgaccagagggcgctccggcggctgaggacggcgtgcgagaaggcgaagaggatgctgtcctccacggcgcagaccaccatcgagatcgactcgctccacggcggcgtcgacttccacgcgaccgtcacacgggccaagttcgaggagctcaacatggacctcttcctcgagtgcatggacaccgtcaagcagtgcctccgcgacgccgggacggacaagggcaccgtcgacgacgtcgtgctcgtcggaggctccacccgcatccccaaggtgcggagcctgctccaggacctgttcgacggcaaggcgctctgcaggagcatcaaccccgacgaggccgtcgcgcacggcgccgccgtcaaggccgccctcctcaacggcgacgccaacgagaaggaccttcgcgacgtggtccttctcgacgtcacgccgctgtcgctcgggatagaggtattcggtggcgggatgtcggtgttgatcccgaggaacaccaccatccccgtaagcaggcagaaaatgtacactacccactacgacaacgagaccgccgtgctcatcaacgtgaacgagggcgaaggccgaagaaccaaggataacaacccgctcggcaagtttgttctcaccggcatcccaccggcgccgaggggcgtgccccagatcaacgtcaccttcagcattgattataacggcatcatgaacgtgtccgcggaggacaagacgacgggacgcagcaacagcatcaccatcaagagcgacaaggggaggctgagcaaggaggagatcgagaggatggtgaagaaggccgagaagtacaaggccgaggatgaggaggagatgaagaaagctgaaggctatgtggcaccctaaagagaactatatttcttctgcgtcttctgatcatgcacgggcatatgtatggccctaacatgtgccttgtttatgctggaagttggaaccatggcttagttggtgatatggtgggagcatattattgaatgccttgcatattccaaatttgggagtatttgttttcaatattgcagaattgcagatggagttgtaccaacataacaaattatggagtcacaagctgaagaaggtaacacgggaatcaggctagaactgggatcgaagcttattcacaagaagaaatacaagttaatgctgcaggcagagacatccaacaaaatgacagtataccgcaaaagccgcaaaccacgttttatagtgtaaagaagttcagaggaaaataatatcgatattgtgttgaaatgcctagtctgagatataaagattattacaaataggccattgcattacgactccatatcatcaaggcaacaaacatcatgatcaacaaagattccatattaccggaactaaatgcccttgtctcgtgcaagtcgctgaagatggtaattgatggtctttgctgcattctttggccttcctttctgagatcatgccacaagcaggaatcagatttcaggataaaaaaatgttttgaataaacaatttgaagggataaaaaaatgatctggattatgacctgagcctgagcacaagcaaccaagagatccttctgtcggacacacttgtcatcgttctgtttgttcaaggccaggcaattgaggaaggaaaccatctcgatcatgcaaggcttcgtgacaccaccgaacttctttgggtttatgtaaagcgcacccgccttccgacccattcttgcactaaaccttcatgtgattgatacatattaataaaaagggtcccaagataaatgggcatacaagcaatgtaagaaatgaaatgtttgaaacaaaaaacatggagaacgctagaaaatggaatacacatttatcatagactgctgttctactaaatactcctataacagtaatcatgttttttttttcttctatgcatgtaaattgcaaaacttttctccaaaagttacaggtgataagtgctgattttaactgtacatagcaatcatagcattagggcgattggaatcgctacatgtacatatcttaattccccttcaaagccagctgtagaaataattacaaactgacacatcatttgttctacgtctattatctccagatataaacccaacaaatccatttagagttcaaaggaaaagacccatttgattctccaattatcatgtctttgacaatctaagcctctaaggggttatatgttcacaggacaatcctgaaatacacctataaaaaggaaaatgtccaccgttttcattttttttcatcaaaaggaagttcacgattctgaggtaaaactgcacttccaaagttcatcctatcaactggatctcttttctctgttaactgttaagcctattagcttgcttttcacaaaatggatctccattgccgatgttttcaaacatgaccagtaattccttgcacgatccataatctattacaagtaaatcccaatcgttccactagaacgatggcatgtaatctccgcttcgtacaacttcttaaactaattatctgcgtacgagcattccgtcgaacaggtcgcaggccccggcgagctgagccgacccagcaggcgctagcacagcaattcctcaacggcacaagaatcgagcgcaaggaaaagcaatgcgccagcgcgagtgctaggctcgacggttgagacgcaccaagcagtagcccgtgcgcagccgtcggcgcggccggccactccacgccggcgcctcccgagaagtccagacgaggctaggtgagtcgcgggacacggaagggtgggggatgggcgggatggagatgcggcgcgtacctcgagatagccgggggagagcgtcgccgtcgccgtcgcagccgcgcagccggcggcgttggtggggaagcggcggcgggaggatgcacgagtagtttctggagaagttgaggccttttctgggatctgctagttctgcttatttttcataaaaggtcctacataaaattgatatttctatatttttgattaaataattacataaaggtctttaatgaaaaaatatggctacggattaattccaaatagttgcgaggatcaatttgaaaaagaggaaaaccccgaaagccctagccgcaaatctcttcctccccattcgccgccgcatcgttcccccacttcgcctccacctccatctccggcgccggcgaggccaggtttgaatcggcggtgctccggtgctcccctcccctcctcgaggcgacaagttccatgggtgtttgcgagccgacaagtacaagagagagcttcacagcctaaacccaaagcttaatctccgcctctctgaagcatttcgtcgagcagttggtgcgggcgctgaggcagaggccatggcgatggcgaaggccaaattgatttccctatctttcgccgacaagtgccgggtaccgctcgccgtcaacctgaactcaccctcctcctccttcctcttcctagtgttacctcggtaagtttcgctttctcttcgcagaatatcctgtgtgcaaattgggaagcgcacctcaacactatcaaagctgacatcaagggaaggtgtgcacgctggacacttcgattcgtactgatcatataatccgcatagttcttgttttgatttttcatctttggggctccttggcagcaagggggagatttacacatcaagggtgcactacatggtcgagaggggcacgacctacttgattgttcccgaagacgacaggcacaccattgtaatgctatagtattgatgcttctcttacttgcaatgttcgatcaatccatatagtgcttgttataatgaacgaatgtgttgcttgtgtgatatccccaatttgatagaacattgtaatcgacgagcggggatctctctcggtctgcagcccaatcccaggccgccttactaccttgctcagatcactcgggaaggtagttctataaatcccgagaaaccacaattgctatacaattgttcttattgcctttttcctttatgagttttgttacaattggtggtgatcttgcttttctggtgtagttgcctcctcgaatcgctatgactggtgatgtgctgttcatgaaaaggtctaaggtacacaatgttctgagtgcctgcacatggatacccatatgcatgattgcttggtactccctccgtttcacaatataagactttctagcattgcccacatacatatagatgttaataaatctaaacacatatatatgtccagatttattaacatctaaatgaatgtgggcaatgctagaaagtcttacattgtgaaacggaggaagtataagttgtaaggtgatattgactgcttcaactattgtgcttaaggttccagttatcgccgatagcctgaagaaagctattctgaaggaacacaaagctgctagtgaagctagccatagtgtgtcagcaatattatcttctgcaagtgctgcatgcagatcacggagcgaaggactcctcagtttacttgaccaagggagctcctacaatatcttaaagtttgaaattgggtatgtacttcatactctcgtacttaatgatattaattttaggtcatcacaggagatttttagtagttgtcaatgttagtagttacaagccgctatttgtaatcgtgaaattatttccgtgcagttcatgtgtctacatagattcgcttgggagcagccataaagttgatttggataactttgaaccaccaaaagcagatctgttatgtaagctttctacttgatccattaagctatgtatctatttagagttgactgctctaaacaattattgttccttcgccttctcattttgcagtatgatattcactttccaaatatatatatattctcctctgtagtgccattctctgcgaggattattgatggcatcaaccggagtgacccaagacggagagcacttatctttttctgcttcgagtattttaatgtcactgcaacggtaagtgatcatcatatgtatcttaagttctggttgcaatgtaggataactgtataccacactgatgtattttcttatatttgaagggttttctttcttgtgttcgaaattaagaccacctattgttgtacaactttactactgttgactttgatcctctgtattttgttgaaggacgcactcttgctctctattgatcaccatggatttgatgtgctcgccaaggtccctgaaaaagcagtgctccttgatgtcccacgacagtacgtctggagagagttcaggttttcattcaaagaagctgccaaggatattgaggacttctgccgcatgttggttgagttagaagaagaagctctccagagtatgaagagctatagcgggttataggtctaaaggggggaagttaacttgtttttactacgttatgtaacccgagaatttatgatgtctctcccttatcttttctgattggaggtacatgcagatcgttcaatagattttatcttatgtctctgcatcatctttactgattggaggtcagatcgttcacaagattttgccttgttctttgttgtgcacgggtcacaggttgataccgtccaattaaactag

SEQ ID NO: 24235 - DNA, 2452 bp, Oryza sativa
aaaaaagaagaaaaaagagcaatggtataaattgctactcaatactatattaataaaaccataataatccaaactttaacaagtaaagcaaaaccggggccataatgaaagcccgtaccaaaaaagttgcaggagcactcaagaattcggtgtaaaacgaacgacaaattattgcaggtataactaaaagcgataaaagatcgatcatttagtcgacttcctcgatcttgggccctggtccgctgcttccgccggcggccgccggagcatcctcgtccatgcctccggccatgtcagctccggcgccctggtacatcttggcgatgatggggttgcagacgccctccagctccttcatcttgtcctcgaactcctcggcctcggcgagctggttgctgtcgagccagctgatggcaccgtcgatggcgtcctcgatcttcttcttgtcggcctccggcagcttggacgcgatcttgtcgtccttgatggtgttccgcatgttgtaggcgtagttctcgagcgagttcttggcgtcgaccttcttcttgtgctcctcgtcctccgccttgtacttctccgcctcctgcaccatcttctcgatatcctccttgctcagacggcccttgtcgttggtgatggtgatcttgttcttctgcccggtggtcttgtcctccgccgagacgttcaggatgccgttcgcgtcaatgtcgaagcacacggtgatctgggggacacccctgggcgccggcggaatgccggagagctcgaacttgccgagcaggttgttgtccttggtccgcgtcctctcaccctcgtacacctggatgagcacgccgggctggttgtcggagtaggtggagaagacctgctccttcttggtggggatggtggtgttcctggggatcagcacggtcatgacgcctccggccgtctcgaggccctgagacagcggcgtgacgtcgaggaggagcaggtcctggaccttctcgttgccctcgccggtgaggatggcggcctgcacggcggccccgtacgcgacggcctcgtcggggttgatgctcttgcagagctccttcccgttgaagaagtcctggagcagctgctgcacgcgggggatacgggtggagcctccgacgagcacgacgtcgtggacggtgctcttgtccatcttggcgtcgcggaggcacttctccacgggctccatgcacttgcggaagaggtccatgttgagctcctcgaacctggcgcgggtgatggtggtgtagaagtcgatgccctcgtagagggagtcgatctcgatggtggtctgggcggtggaggacagcgtcctcttcgccctctcgcacgccgtcctcagacgcctgagcgccctcgggttgcccgtgatgtccttcttgttcttcctcttgaattcctgcacgaagtggttcaccatccggttgtcgaagtcctcgcctccaaggtgggtgtcaccggcggtggccttcacctcgaagatgccctcctcgatggtgaggagggagacatcgaatgtgccgccgccgaggtcaaagatgagcacgttcttctcgccgatgctgctggacttcttgtcgaggccgtaggcgatggcggcggcggtgggctcgttgatgatgcgcatgacgttgaggccggagatgacgccggcgtccttggtggcctggcgctgggagtcgttgaagtaggccgggacggtgacgacggcgttcttgacggtgcttccgagataggcctcggccgtctccttcatcttgttgagcaccatggacgagatctcctcggcggagaactgcttctcctctcccttgtactgcacgccgatcatcggcttgtcgccggggccgggtagcaccttgaacggccacagcttcgcgtcgctctgcaccgacgtgtcagagaaacgccggccgatgagacgcttcgcatctgcaaacaagcgatcgagtgtttcagatcattgatcaataactttgcactgaaaattgaaattttaagttttaactgacaaaaccgagcagagcaggtcgatctaccttgatggtttcactaacaacttattaagtaacactaaatttaaaatttaactgaccgaaccaagcagatctatctgtgttgatgggttcaggacgatgatcaagtaacaacttagcactaaaaatttataataattaactggccgagccaagcagattgatctggtacgttgatgagtttcatggcgatggtcaactaacaacttagcgcgaaaaaaattgaatatttaattggccgagccgagcagatcgatttagtagtatttaatagagacagtgcggcgatgatcaactactaacaaacaacttaataaagccgagcagagtagcgtcgatctagtaattaataaagctgccgatgggttcatgtcgatgatcaactacaacagctagatatt

SEQ ID NO: 24236 - DNA, 9885 bp, Oryza sativa
gatgatctcgacgcggtcgtgctgccacacgccgacgcacgagtaggtcgtcccgaggtcgatgccgatcgccggcccgtctcccttgccggccatgatctccctctccctcgctctcgtcgaaagctctcaagcgaaggggaaaaaaactcgaaaaggagaaaatcgatgcgatctgaagatggcaggagagagatcgatttgtgagtggacgagagcgaggcagcgatcgttttataggtctgcgtggttctagaatgttccgtggaccggctggaccgtcggatgcgatccggacggtggttggaggggcggcgggttcgtagcggacgtgggaaacgggcgactttggagagtttggactcggccgcgcgttggagacgcggttccagagatctccggaaggttctagagacttgagagttgagacccgttgggccggtaacgatcaatcgttttggtacggggctatggcctctgccagcttgggccgttcgatgccgatcagacggatgggcgggcgaaccgccgggtttgaccgggattttctgcacggttgaagtcggccgctttatgtactttgcctgttttagggcttatttggttcagtgccctaacaatttttttggtagtgtcaaaatatagataaattttggtgctatcaattatttgatagaataaatttgtattcatcttatttggtttgctatcaaaatgtagccaaattgtgataccatagcgaagaaagttctagattgctaccaaatttaggatgggcattaccaaaatgttggcatcaatccaaacaaatggtgggtactatttaggctaccaaaatattggtagagcaaattttggtagcaatccaaaactgccctttgttaccaactttttcttcaaacttctaactttttcatcacatcgaaacttttctacacaaacttctaacttttccatcacatcgtaccaatttcaatcaaacttcaaattttgatgtgaactaaacacacccagtggtttattattactccgtagttggcaggtgttatgggaacatattactgcttactgtacaaattatttccatgtgtacgattttttttttgaagaaacatgtgtacaaattttatggtatcctataggaaactaggggtttctatgagtgaaaacagtcagaaatgatagtatcttttcgggaacaatactcgatcagtcggtaattgatcatatttattattttaactacttagggttaatattagtacgatgtataaagaaattagaaaaataaaatttatatagcaaaaaaagtaacagtcagaaacaatacccttttgcataaacggcactcggttatcgggaatttccgtgatcattttcgttcctaggggtttccatgcatgcaatttagcgttgaaaagatgaattagatttgtatacaactttttattcctatttccctattgtagttatactccatatatggttgatattaaatgtgagattggattaacgtacacctcttctcttttgtttctgatatacaattgtatctctatcttagttgcagaccacgccgaccatacctaattttgttatcttgttgcaaacagtgtgcaacgataatgactcaaaacatgtttaacctacgtcattgtgcatgacacttagtaagttgcactacaatttatatatttgttaattttagaattttgcggtaaccggggctgaacgaatccggttaatcggctttaactgccggcgcgtgtatatgtgcttggttttcgaaatttacgagatcttttaaagggtagattcgatccgtgccattacaaatttgtttattcaaataaatatcattacaatttgtttattaatcgtgccactgaaattttacaaaattcgaatggtaccactaccatcacattttccatccatctccatcttttttttttccgttttctttcttctttctaccggcttcttcccttgagcttgactggcgagaggaaagtgacgacgatgagcttgaccagcgacgatgatgatgagaaaaggaaggggaaggattaggctgggcacgcgtgttaggtgctggtaaccttgaaattcgggatcgaaatggcggcctcctccacttccgcgttgatcggcgggtgacctgctccgcttccgcgctcgtcagctgtgaccttctagcaccaacaagaaagaagacgtgtcgcaccttctgtcacggccacttgtcttggatctcctctcgccggttgaagaggacagggtttgccttctggatctgctggcatcaaccgccaccctcctcgtcctaccccttcctctaaaatgatgtcactgttgccgtggagctcctcctcctcaagggtgtgagagattattgggcggcgtgatcaactcatcaagaatataagaagagagagggaataagacagaaaaggaagaagatcgataaaaacatgatggcagtagcacgatccctgtaaatgatatggatattcatatttgcaatgatatggatccaatttaccctttttcataaaatattttgttaagcacgaattgcacttaacaaaagaaaaacggatgatactagctactcccaccgagaacacacaaattatgcacggcgcgaggcacggacgatcactctcaggatcctctgacttcttgtaaagttctgatgtggttacgtgtctccaaacaggccaagagcgtcggactccaagcagatggcagctcggctcgaactcgcgtggaaaagtcgggcaaagtgtgtgtggacagaggacgagtaggaagcctcgttgcagccactacaccgaagatcccgcgtggaaaagacgaaggccctgtttagatgggactaaaaaacttttaagttcctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaatttgtctcgtgaattagcttttatttatgtaattagttttgtaagtagtctatatttaatactctaaattagtgtctaaagacaggaactaaagttaactccctgatgtaaacgccaccgaaaagtacgtcggccatcgtcaagtctactactccagtcagcagctaacaaggccagcaactaaacaacactgcgtcgacagtgccgccgtgccatctcaccctgctagcctgctactgctagtcttgcacggagcattttgggcatcaactcttggctaccggcccgttgcgtcttgcctgcttacataggtggactcttggtgttgggccgcatcgtttgccactgatccaacaacagcggagaaggggagaagcccggaaaacctcagcactccgcacttcagcagcatctgcatctcccatgttcaggattgatattatttttaaccataccattttttaataaattgctaaaaatatctatatttagtttgttaccgaactttgataaatacataagaaattctgttaaaattttagtaatattgctaacttgctaaaatttaacaggtaagatttattttggctactatcttaacagtccctcgcccctcggtgtgttacctgatgcatccggcagaagaccacagagacgagctcactggctggtgacgatgacctaatcgtcattgcgagtcacgactgaggaagagatggaattatttggttgcctgtctgctcgatgcgaaatgcagtcactcgcgagagagaacgggaaagtacgtctcgtgccgtctttgctaggccttaagggcggatgcggcccaggtaaactttggggcccagcatggaggacccgtataagactgcaaagctaccaacggtagcagtccgacttccgcttgttctcgtgggcgaggaatggaggaacccgtaataatactccctccattttttaatagatgacgccgttgactttttctcacatgtttgaccatttatcttattaaaaaaaattacgtaattataatttattttgttataggttgttttatcactcatagtactttaagtgtgatttatatcttatacatttgcataaaatttttaaataaaacgaatggtccaacatgtgagaaaaagtcaacggcatcatctaaattggaagacctgctgtatctactagtttttttttcaagcattataaccggattcgctgacaaatttgagagacctaaagtgaacttattatgctctaaaaattatagacagcccaagtaatctccaaaaccaacacggacagcccaatttgggtcgttgttagtacctgcgatcgagttcgccggaacgtcgtcccaatcggccagtccccgtcccgcaccgtatttgtgcggttttagttgcgagcggggcggtggtttggtggaatggtggtacgcgaaacgaaagcgacggccgctcgcttgcgttatctttgcttgccaacccggtgattgacgggcacgtagctagctaggccgggtccctctctcctacagctcgaattcttgcatgatcagatctgtagtatctttttttttccctacgtaattagctaagctatatactccctccgtcccaaaatgtttgacgccgttgacttttttaatcatatttaaccgttcgtcttattcaaaaaatttaagtaattattaattctttttctatcatttgattcattgttaaatatgcttttatgtatacatatagtttacatatttcataaaagattttgaaaaatacgaatggtcaaacatatttaaaatagtcaacggcgtcaaacattttgggacggagggagtatatatctcgtacgtaattcactgccaatgcgcgcggcttcaatgaactcgagtatttccttttaattttatgggactgtttatatatctgttgacagaaaatcctacctcccatctttcaaattttggaccgttggatatgctttaggattcgtgcacagctttaaccctaacttttttctcccattccccacctcttcgcgcattttgccgccgctgctaccctcgcgcgtcgccaccgcccgatccccgccgccaccgccccaccgcgccgccacccgcctcgccggctagccggaaggcgtcaacggcgccgacgaggccccccgaccagcctcctcccccctccttcctcctcgagccgtcggcggcgagatgcccccgccaccacgccggtccaccgccgtcctctagccttgcagctccggcgccgccaccggcgcctcgccgccaccggcgcctcgccgcccacccgatccacccaccaccgagctgtcgtctcccccgaccatccctctaagcccagcgaactcccccttcttcccctccccctcccacccttcccagttcccaccccaccccaccccaggaccctaattcgtcggctcttcgccggagtttgggtcatcgctggcgccggagaagaataggagtttgtcggagttggagaataagcaactggagcacgaatcgcgaagcacatccagtgaaccaaaatttacaagatttggaggtaggttttctgtcgattgaagcttagcaattccgtaattttatctcgcatatgctccattattgccgcttaaaactgatgtgaaaaaaattagcaaacactttagttttgcctcactacataaaatcttccataaatgcccgtgcgtgtgacatgtaaatcgccttaagcaagattctgtcccaataatctttcgaaagagaacggtttgctagctttagatcgctgtctaacggtagctatcagatcaaattcaggtccggcgcgggcgacgacactgcaggtttacgttgacgcgccgcgaaaatgcgtaggaacccggcggcccggtcggtcgcttaaagcctaaaggcgccggccggccacgaactctctctctcgcgcctttattccctccttcccttttgcacggcggaccatcagctgagagagccctacacacactgctaccaaccccttcagataacctcccccttcagccaatccggcgtccgggcggcccacacgcatcgtgatcgcacaaacaaaatccatgttttctcgcactgtgcggcaacagcggaagatcgatataataccattcactcctccacaccaaatattccccctgcagctagctagctttcagtctttcagtctctttttcaggtactgtatatctaccagcacacagctgatgcacacatccagctgagctggccgtacatcatctcctgcaaaagctctggaaaaagaaggatagacgatcgtggaagctgaaattgctttccggcatttgcagcttagctcatggtggaagctcgattgccgggcgggggagcaagctcgctagctaggcggtgaaatgctgctgcagcagcagcatgcatggctagctagcccactgggcctgcctgaaaccatggctgccggccaatcgagatctcgttcccgcgcgcccttgcatggcgtgtgcaaccactgtggcgataggggccatggctagctagctggttagctgcaagatcaaacgtactacgccacgggtgacccacgcgcgcgtgttcgtccgtgcgtgggtgcagcttgcgcgtacgcgcgcgcgccgagactgacagaccgaccacgccgcgggtggcccggccggccgaacagcaagcactgtccttgtcgccgcgctgtccgaacgtacagccggccggtgagagggttagctagatggagggaggcattggtttcggtttcagtacctggctacctgcgtgttgcattgcgttcggcaaaagaggtggctgacttgacgcgacctgatcatcagtcgggctggaaatttaatttgggttcttatataccgatgcatttttgttgctagctagctagccgaactgtttgggtacatttgatattttgatttgtttactatcgcggccttagtgtattgttttcaacaggttgactatgccgtcgtacgtgcatatcggcatgttctccttaattttgccccgttgtaacagtacgatcaagcatcgatcccaagttcccaatccaactccccggccaatctgacaaagtcgcggtgtggggctaattaatgccatgtcatgcatggaaatatggaatctggatcattccaatgtttttttaaaaaaaagaatataaaaatattgaattcccaaaatagtttttatgatctcctttatgctggaggaacagccataacaaaggctgcagttctaagaaaggcaaattcaatgatttgtcactcaaagagctaggtttattgttcatttttagacgactagctagcatatttctagtgtgttgcaacggatttttattttgaaaaaaataacatattttttatggtgaaaaataacattgattgttattaatccttttttccatcactttctaaatatatcaagcttaatgtttgcatgtctttcaggtaagaggtggaccctctggtccaatattacatttttttccttttaaaaaagcccaaaattttcctccaaagtttgtatttattatatttaaggatcatcggatggcttgaacagtgaaataaccgtcgcctttgtgatcagttggagcagcctaattttttctcttcctaaaagaacttaattacttttttcttagcttagcctaagcccaggacggttcgacccattttccatccaaaaaatccatgtgtctattcatataatatcgttactaaccgctaaaagatctagtggctgtttggatgctatataataacattgccactatttaccatattttttttgccatacttagctaattaagttgtggctaataaaaagtgagccacgctttaactagaaaaaaaaagagtgtgccatacttttttgagttgatgccatgtgaaaccatgagaaatgagaactaatcttatcataattaagtgtggccaagaattaatcaaaatatgagctaataacttggtcaaagtgtgtggtaaccggtaaccttagccaatgtttggcaatgaaccaaacagtcgtttggtttttcttgaactcatggctatagacctcaatccttcaatgcttaggttaatataataaaatatatgttaaggtgcacatatttattgcgctgacagtagcgtcatgcttcgagtactcccaacaaagtagaaaaatattgtattggccatgacaaatttgaaagacaagtgtaaatataatggtagtcatcacttcacaaagttttttgaattaatgtatatttgatatatgagttgagaaaaaaaaagaattccttatcgcaggaaggatatatatatacaaaagaacgagaaagtttccaaatgaatttgttgctccatattttcttttcaaatgaaattttttggactagtggatagctatctgcataccttttcatgtattggggagcatattcccctgccggaacaactgatgaaattccttcacaacgacatgtggctttgatacctgaagaacattttataatactaccccagaagcactggctggctagctagctatagttggagtatgtattacagtattagggtttctgaagcttcttcttttttttttgcatcaactcttattagcttcatatatttatctgaacttctgttcacgctagaaaacaaaccaaaaacagtcacccctcactagtcaccacctatccagccatttcttgccatctcagtcccctctgtatctccaccagctggttttttgcattcaatttttctgctgagcacaatgctaaacgagtacagtcttaaaggctaagcaagctttaattacacacacacacacactctctctctctctctctctccaaacattcttcccaaccccacagagagaaaaaaaaaccccaagaaatataaagccaccatacgcttaaaaggagagaagataaattcatgcttttctcctcccctttctctttcttagtttctctctctctctctctctcctgtcttctctcctgcagctgctggatgtgattctccaccacctcctccttcctagctagctagccagagtgagtactccacaccaccacctcccctctcctccgtttaatttcttccctcccagctagctgctgcagcctgcagctctcgccttgctttcttcttctctttccatacacaaatccccaacaaagaaaagtgcgaatttataaagaaaagatcagaattcaaagcagaagtaaagctagaggagataggggtggtgaggggaggggaggaaatatatctcaccactaactggcttccatggtgttcccttcagtgcctgcctacctagatccacctaattggaataaccaggtacttttgctgcatgatcttaaattcttaattgcttctccctcccttcttctccatcgaactctctcttgctagtgctgaattcacagcttgttcatggcaagagaatttttttgcaccaagaagcactgcagagagatattcttgtagtgttcttgaatattcagagtcaatatattctctcctaccttttctctcatctctgatctataacaatatgcttaattgcttacgcttatgtttatgtgtgtgttgcagcaagggcagccgcccaggccggcgaacgtaggcggcggcgatgcacagcacctgccggtcgggccgaccgcagctgcggcggcgccgggcgagatcggggggctgccaacaagcagctcgtcggccagcgcggcggcggccgcg

SEQ ID NO: 24237 - DNA, 3927 bp, Oryza sativa
ggcgcgatcatcccgccgtcgggcctcagctccatgtctcaccacctcccgttcttgggggcgatgcacccgccggggcccaacctagggctaaccttctccgccggattccagcctctcggcggcatgcaccaccacgtggacacggcggaccagttcccggtggcaagcggcggcggcgccaccattggcgcgtcactcgagcagtggagagtgcagcagcagcagcagcagcagccacaacagcatcagttcccgttcctcggaggagcactcgagcttccgccgccgccgccgatgtaccaactgggactggaagctactcgagcagcaggcaccggagcaacggcggcggcggcgttcacgttagggcagaccagtgctacagccaccacgtcaaggcaggaaggttcaatgaaactggaagatagcaaagggctggagatgagcctgcagaggcagtacatggcggctctacgccaaggagatggtgtctggggtaacaacaacggcggcaatggcggcagcgacggtggcggcaatggcggcggtggcagctggacaatgaacttccctggattccattcgtcatcaggcggcggcggcgatgatggcggcggagtgttgtagtacactacttctagctaggtcacacgattgatctggctcatcaacaattcgacaagaggtttttctaattaatttgcatggtttgagcaaatgcaaagaggaggcaaagaagaaaggagggcttgacttgagtgttaaactcttcatcaagtagaagcacacggctagctagctcatgatgatctcaggtagggtggtttaagttaaagctgctctttagttaacgctttttttccgccatttggttttgaactcaaaggtgtgccagtgttgtgtccatagtgtcgcctttttcaacttttttacagtattgtttacagggggttaatatatataaccaaacgtggtgcattgggggtatatatgatcagggatatagtatttgacttggagagattggagattgatcaaattacctctcattagttctgcaaaaacttgcatgaaattaatgtatggtttgtgtgccctttaatgtttatggtcctcttcttacaagatttatcaattacttatgcacctgaacttttgtgggttcaaagcatacacacattccttgctagccttttggtattgaataggactgtacgtacgtatatagcagtgcatagcttttgaatgcatctggactgacatgcattactacctgaaattgaaggcaactagctagtacacgttaaatatgcaacttaattaccgtatgcatcatgtggtggtgctaaccattatagttcaaacataggagtatatatatgtatatacagagttacatacattaattggcatgactacttccatcagctagtgagcatataatcgtatattcaatatctatatatgcatatctaaatcttctcatattcttaatggaaaatgtaaggagagtagcagttcaaaaatctgtcatatgctcataagccatatatatggtgaataaatgcacgcctagttggctactgaaccatttgtacaaaatcgatctcctggtaacgcttcacttcggattaaaaacagctatggtgatatgaatttcaaaatgcaagaagatttctgatcgaatcagtaaccattacactcaattaagacacccctccattgaattttgtaaggagtatctcaattcaaaaggtcaaacactatagattttaaagttgaactacaatcgatcaaaatatataagtgcattcagtgtataaattatacaatggatttatatttcaaagtgcttttacaaaatgttagttttacagccactaagaatatataagttttataatgtaagagcaaccagtggtcaaactttaatcttgctgactttttcataatttaatactctctccatttgacgtataggacaagattaagtcaaactttaaaaactttcttcaattttatagtagaataagtctaataagtttaagatattgtgatagtattttccaagataaatataaatgtaccatttaaaaaacactaagaattcgagaaattgttgatcaattgatgatcaaagttttaaaagttagatcaaaccttatcctaaatatcaatgcacgaacaagaggagtacaccctatacaaatcaacagaggtagtttttcctttagaaaaagaatcaatagatatataggtggtcctgcaggattcataggatttttcaaagtttccttctagactactatctcgttctcatagatatcatcctagaatacacacagttaaacctcgaaaccttaaatgattaattaataaaaatatattaggatttggcatcaaaaaactaatatcaggagctattcgttataaaaacactttcatacatttatattttaacaaatttaaaggttgtgatgaaacatgtgcattcaagaccatacgtgtcaatgtttcaaacgagaagtagaaaataatggatgcaatatcttctatttgatccattatttagcacacaaaatgtttatttatgggagtatatatatatatgtgcgcgcgcgcgcgcaacaaaattaattaaaactatctagctagagccatatatatagtagagtaagtaattaagagtttttcacattgaaatggtgcatatatagtacgtaaactgtagtatagaagagagtgcaggagtactttactagcaaatactcctatatagtagtatttcgccttgggcaaaaaatatacacacatatatagaactcagtactggtctcgatcgtgcatgtgtgcatgcaagcttttcctcagttttttgcagtgccagtgtgcaacatgatgtaacctcggccggtcacaaagtgccagtaccaccatgattagattatgattggaaatgatgggttttccttattgggccgatatatgatcacgaaaacacacacacacacagatatatatatatatatatatatatatatatatatatatatatatatatatatatatatatatatatatatatgcaaccatatacatgtatcaatatattcacttttcatttttcacacaactaggcacagctgcatcccatgcatatgcatgatttgccatcgggtgctcactagttaattaatgcttccattcgtactcttctgaacagaaaaaaaaaacaactactaaatgtcatgcccgttttgatgaaatcgaaaatggtgaccgaccacattcatcttaattgcgatgtgcaaacgccagcgtccgtggatagggatgcatatgctcgatcggtacatcgtctctctaggaagggctagctgatgccttgtctgctctttggagcacactctactgctcggtgaaagctcagtgtgtgtggccatagctagccatagctaccatatgcacaccccgtgtagctttgtggggcattttggccggctttgccatctatccttggatctttttcagtagagctggctggctggctgtagctagacagagctagggcgctgtgcatttcgctttgctgaaaagaaatggcttttgaccaacctggtgcacattcatgtccaccaccggtgatcgatcgatcgatcggcctgtggtgtgcaaacgacgacgacgactgatatttccgaccatctttcgccggccggcgaggtgtacgttgacctagctagctggattgttagagggaaataaattaagctttaatttctctctgcagcttcaattgatcacctccacgatcgatcgatatatatcaaatcttcttgcagcactgttgtacaattaatgtcgggaaggcaggtattctgcctggccctaaactctgttgtcagggccgttaattataccttt

SEQ ID NO: 24238 - DNA, 3194 bp, Oryza sativa
  unsure (1)..(3194): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggccctgcatgccatccctctggtactgctgccacatcatctgttcctgagtcaagaactgctgcttcttctccatctctgccatctgaacataggacggtggtgggaagctaagggacgccgcaaacgggtctccaccaacattctgcattgaaccatctggtgctggcagagccagcacttgtgttttctgtccagccggaggtagagcaacgctgctggcactcccagttgtcacttgtgcattgacatgctggcgcacggcaccctgatcatacataccattcagtagcaatggatccataccacctgtcattgtggccttctgcttggacagattgctcgctgtctccacaagggcaagttcccagtcagccttcccaggctcagctgcaggattctgccatgcagaagtcacctcattgccaccatttgaggggaaggcctcccatgagccattgcttccaccagctgcaggtggcccttggaagagggccagagcaagccggttaccttgctcatctgcagtcacagtttcttctctaagatccactaaatcaccctggggttgcggtgggggctctggctttacttcctcctccaccttctcaggttcaggctccttgtagtcttctggtgctggcagtgccttgatttcattcatatctggctcaggctcttcctcctttacaggttcaggctcaggctcccgaggtgggctcttgggccgctttgctcggtccctcataaattcctccaatgtctccagcaacttatcggtaacacgctgcacctctgggtactctgatgacctagcgaccccagtttccttacaccagccatagaatgcacaaagctcgtcaatctgctttgcggcgctggcatatgcctcaaatgccttcacgcactcggcatactccatgtcaaagaacctatccagcagcactgcgagcacctcacatatatcagcatagagctggaagctctctctcacaatctgatacagcgcgaccagcaccatcctgctgtgcttggcaccacctgtggggcggcaagcaaggaacctgtcgagcagctgttgcaggtggtgcatacgggcaaggacccgttctggcttcatgtctctcactggggtcggcggcttcttgtcatcagtgttgttgttgccgttcctctcacggtaatcatcataaccaccatatccatacccatttccgtttccagggggtgaggagtatgagggtgaccggcgaccatatgggtcaggtgatccccagcggtcacgcggtgacgggccatttgcactggaactggcgttggagccggagccttgcttgcgctcatggaggaagaactcaaggcgctggtcgaggtacagcgcataggtacggacgaaggcagagtggtcccatgaaccggagtgagcctcgtcgcggaagtcggagaggttgaggaggcgagtgcccctgcgcgtggcgtgcaggagctcgcggtggaaggaagggtcgccgtcggcgagaaggcggtgcacgagcatgagcgacttgagcgcgacgacgtagtcgcgggtgcgggacagcctccgggagcatcccgcgacggcggcggcgacgtgggcgcgggagccggaggtgaggtggaggatctctcggatgtgtcgctcctcggccggctcgtcgtcgtggctggtagccttgacgatgagcacgtcgagctccggcgcgatgttgctggtgaccttggccagaccgatgctggtctggtccttcaccgcccccagcgccttccggatcgtgctcgacgacatntngccgtngccngngcntcctcctcctcctcctcctcctcctcctcctcaccaacaaaccaccaacaaccgcggccgcagcagcagcagccgccgcctcttgctcggtttagatctgaacagaacaaacacccacatgagaatcggagataacttcgccctgtttgttgtctgttctcgcgcaaacagggcaaaaccagcgcgggatttgctcaaaaccaaacgcggatccctgaaattccgcaaccttctatcctcaaaacccatcggagtacctaccgagcatgagatccgcggagtcgggaggcgagatctcacccgcggaatccacccaacaccgatgaaatgaatagctagatagagatattaattaatactactagtcgactcttagcttatcatcagcatctatagcagcagcaaaccgtagctaagccgaagctactctctcccagccaaagcggcagccggcgccctccggcttcatcgtgaaaaaggcacggatctagcgagcgagatcgatccaagcgaaagatttacctttgcggtagatccgggagctcgagatccgggcggtggcgcgcgagcacacgccctcccctcccctctctctctctctctctctctctctcagctctgtctccggcctcttggggtgggagaccgggagctctggggctcgtctgaaactgcggtccgcggaggaggcgagggagacgagggaggaagaagcgaggcaggcggcgtgtgtggtggtggcgcgtttttgtgttggggggcgtttggtgccttgctgttttcagatttttatattttgcgcgaggggaagggaaggaaagcgagcttcgcgtggcttccttccgcgcgcgcgcaccgacgcgccccctcggccgtccgggttttcccaaaaatattttccactgcgaaaggaaagtggggtggcatgccgtcgcgcggggggaagccaaggccaagccgcggttgaccgctgcgccgccggctgtgttgtgcgcacacgcaaagcggcgggcgggtgggcgggggcgttgcaccgtgcagctcccgggtgtttggggggggggggggggg

SEQ ID NO: 24239 - DNA, 18269 bp, Oryza sativa
ggacgggaggggtcggcgcgccgttgacatcggcgtgtgcgggtgcggcggaagctgcgggttggtcggtctggctgacccgtcacgccaaaggtgacagtgtgacacacacccctgcgctgcgttgggggggcctgtggttacttctgggcagaccgcataggctaacacgatggtcgtcggagatagctaaagcagttgatggttaatactatacggagactattcaactctgttatgcacgatgaaagaaactgtcataatgattatcagttcaaatataggctttgctaacgatccaatgagagttgcaaggactttggtatttttattttagtagtatatattaaaaatgaacttttcagcatttgattccttactaacatacaattgaaaattatcctataaaatcgaagtaagaggttgctaattagtttagattaatccttaacggtcgagtaaaaaaaacataaagaatattgtaacaaatggacattataacattttcattacttcttcaaaaagtgtttcttttttatgtaaaaattttctttccttgtaattggacataatgcataagaagggtttaagctgctcagtaattagtatcatgtgcttgtcaggttcgtacatagatcctccattttatatttgtaattgaaagactcctttgttgctaaatactcctcaattgcaggtaataattgcatcactggtacatctacaaataaaaaatttagttagcaattatttgaatgcccatattgtatattatatatcgacaaaaagaaaaacgttgggaaaacccctcttgataggttgcggtgctctatctaaatcaagctagttaattgctaaactgcttaattattgtaatcacctccacaacaccactgatacatcttgctagattagatcttttatctttcaaggggattaatatacaatctggtactagcttttatttgtggggggagaaaagggcattaatcacaatctgctagtttatttttttttggggggttgtctggtagttataccacgcaatgatgtaatcgaaagaaatagatgctctgttcagtcactaaaaccaatcttttggatttacctctagtcgagtgacttaatttttaagctcgaatatgttctattattcatgttggataattcaaattgtactagtaatttattttataaactatacttctaccatctactcctccatcctataatatagcaacttattacgggatgtgatattttacagtgcaacgaatctggacaggaggatgtatagattcattatattataaaatgttacagcagttactaggttgctatattatgggacagagagagtaatagttttgtttcattttgcgtattactaatataccatgatgataaatctatatattgggtacaacaaagtccaaaacaacctttttttcctcatactgtaccttatccacattttttttctctcaaattgcaatcagaccacagtccacatgtgcacatgatactatatacatttccctcattttgtttacaaactagaattgttgtttgggtcgttgcacatgaaaacaatcatagatttcacaaaagctctataggcctaatttcacagcccctaccagtattcacgacacactggtccctttccatttatgcctcgatttatttggcaggtggccggtgctatagacaaatgcttggtagtgtataacacggttggctttggcttgtgaagtgtcaaataccaggacggccggcccttgcatgcgtttctccgctgtacctagcctgcaaaggtggactagtgctcgtggtggatggaagtagtactcgtacagtcgtacttggctggcatttgggtggcgaaacaactgaacccatccgatcgatctgtaaacccgagagaaagaggagtggacagtgtgtctccagcgagcacgcagtgacaccgtttttacatggtccaagtctgtgctaagccatccactgtttttccttatctgtttgattaatgattcacccgttgacaccgttgtcgacgcgtacgacagcaatttgtccccattctcctcctgagtcccgaatacacgggataaggttgatattccattaccagtctaaaaaaaaggttgatattccatttggagaactgccgggtgaaaatagattttgtttacggtttttgattagataacggcctattaggaacatcatggtacaaattattagtgctgtaattaggtgaactcgtaaaatcattcttttttttcaagcgctagataagttgccttcccattgaaaatgagttctgtagtgaccgtcgacttgtaaaaatgcatttcattcatgcctacgcatggtactcgttccaaatccataaactatccagatcccttccttttttcagttttgtcccttgttcatgctgacctgcatctttgggtggggacagattgagcacttcagctaaaggttaggcatcgtgttcttgatgaaccagtgaagctagtgggcaaaaaagccatcgcctatctccctgaatcactgagaggctgagagctacggaatggcatatcttagtcaccaagtaaaacgtccacactggtaagcttcatgtatgattaagaaaggatacctccactgagctatgagatgggcgatggcttttttgtcctccaagtgaatgtacctctattttggctgttgatcacttgtacggtcatcaaacttcacgtcttattctgccaaatccttgaacaggtccatgcaacattgatttgagttggtgttagaactagttgagggagggagcccggccagtaatatgcataggtatgggggattagggccggtcctatgattttgagggccctaggtgaacttatcgtgatgggccctctaaactatataaaaaattttgtgatatatatagacgctaattttacttgcaaaacaaaaataaatatatccatatattaaatttaatatgtctggtaattattgagaaataaagtcgactaaaataataccttagaactaatatcattaccttagtgaaaaatagaaccccatcatattcattgcttcttatgaaaagatacttctttggatatttcttgatgcaaaatcatcaagaacggtattaagatcaatagtgtccaagatatcattctcgatagagcacataaccaagccatttaacctttcttgcgacatagttgatctcaaatagttcttcaacaacctcaattttgataaacttctttcagctgaagctaccgtcataggtacagttaagagaattcgataggcaactgaaacatttggatagcaatctgtatccataacagacttcagaatctcaggcgcggacatcgaagattctgactaaaaatcattgatctaaacatcggatgagttctcatgagtaagggcccctttgaatcacagggtagaaaaaacagaggaataggaaaaacacaggattctggcaggaattgaagtgtaaaacagaggattgcaaaacacatgaaaaacacagaaatggtcgtttgattggagcgcaggaaaaacacaggaattggatgagaaagatagactcaaaggaaattttccaagagattggagctcttgctaaattttctctaaaatccacatgcaatgtgccattccataggaatttcataggatttggagagcttcaatcctttgaatcaaagggccaaataggatagtttcctataggatttgaatcctatgaaattcctacatgaatcctttgattcaaaggggccctaaatgttttcgcaaaaatcttgcagtgcgaccaaagatctacttcatcgaaggattttaaatttttagagttggccccccaccatcatgggcccccggcggtcgcctcggctgcatagggccagggccggccctgtgggggattaggcaaacccaaagcttgaagactcgggaactcgctcgggttaacaaagtggatcgtagcattgtcaacatctgacgatcgtattaacctttcatgtagtacggtttttgtctaggctataaaaaactgtagatatactacaccattgcggcattgcggtagtcggtagagacaaacaagtttgcaattatcgcgtgaccccgagttcggtggttgacatgaacggtggccactggccaccctttttgtgctccagagtttagagagctactagtacagttgagttgaaaagggcaaaatgtatatttgccaatacgacgctactccgtcagataattcactggcagattatagacaattcaagagggaggtttggccgtgcgggagtgtttctttaccgacacatgcatcggcattcggcaaaaccacctgctacacccgtgattcatttcaggtggatcttcttgttgctttgccacaaataatgtcctaactaagagcatcctcagcagatgcgctatccagtccttcgtataagaaatagcgcatgaaaataaaaataaacctctagcagatatgtcatcacattcttaaaaaataacgtatccgctaaacatgagagatgaatgccaaatttgatattcctctatcctcacgccaaatcgcaacgaccatgtttgaatcgagctcccgtcctcatcctccggagttccagatcaaccccggcatgtcgttgtcgtcgtcgctggccaccaacgaaaacgagtccttaatgacgatgcagagggtggagagggagaggcgtaccagatctgggagctcccatcgcccccttgcacccctccacgctcgctaggtgccgccgacgggctcgcttaagccgtccaccaacgtctagcggcaccagctatcgtcggccggcgtctctttgcccgtgagttgttgacgtcgcccctctgcgctcaccgggtcaccgacgggctccgcgatgcggcgcctactctggtcgttatcgacaccaagatgtggcactagctgccatcggcgcacctttgcctgtgagctgccactgtcacccctgtgcgctcgctcccacttcctgttggagaaggagaagagattgaaggatagaacagagagaaaagtagagaggaagaaaggcagtggaagaaaaaagaggaaaggtttggatttgagaaaaaagagaggaacaaagcatgcctgttgctaaactcttgttgtcaccttacttatcttgatatgattacaaatatgtctgttaaaatatactcatttgaaagattttatgtgataaataacattgtaaaaatttagtcgttcaaaatataacccctgtagaagaaaataacacaaatatattattagttgaaacatattactcgaatagtaggatgttatatgaatgatatgttggagtgggaagagatatgaaggataatttttttatgactatttatatgaggatatggatgatcaaatttggacgaggtgttgggatactctaaaggctttaatttggattggtggtaatttttgtctaattaatattttggtagtgctatatagtatgggtaaagttggatcaaattaaatgtttatccggtactatttaaaattgccataaaaattaggagggtaaaaattggctcttagtccaaaacaggcctcagctacgaacgatggcagtgttatcctgtctgagaaaaaagtagagtgttatcctgactgtcttttggcacgagaggaaagacgctcgacacgtagaataaggtcatcatggtctgatggcgacactccatttcgtcccactcaaacctgttttctgaagatcattttgcacctcaaagcgaacgaaccgccgtgcaatttcttctaccggttattatataacgtggactagtgtgtgtgtcgagtagaaacttgttcagtcaactggccttggtgactcggggtcacctctagctagtgaaaactttgtccgttctgccggcgggtgaaaagtgctttgtagtatgatatctatctagaaagttacttcgtaccacccgtttgcccgtatcattatactgtaaatgtggtatggccaaatcgtccagatagctaatttattctaggcacatttctgcattatcatataggcaccggacagcttattggtattgtatggaagtatgacgtgtgcacataacacttgcaatagaaaagaagacaataccatcatcaagtctaaagacaagataaaagaagtggaggagaaacgaattccggcgccattgataggatggagtggttgacgatgacgtcaggggacaccatgagaccaatggtagtgagttgtggtcacgccttaaccaaataggagtatatttttagctaacagtaacaatattaaacacatgttgcaactggagccaggtgtcccatgtgagctgcataagtgagctaactaatcacctacttatcgtacggcttccatccataatactccagttaatcagcctcctgtagttagtaaacgagtataaaatttccctgtgataaaacccgctaataacacgtgaaaccggataaatctcggaacttgatgtatttcagactgatgaaatccatgaagtaacatgggttttgtacccgggcagtggatgacaaggcccaccacccagacgcgatggcagattggcggtccagcagcagcacaaccagccgcggcgctcgcggctcgcctcacgctcacgggccggaccggaagtggtagtaggaaagtgtaggcgttgctggctggctcgtgaggcgcgggcgtaaatgcgggcgcgtcctggcacggcgtggccgtgtgcgtacggcggcgtcatacgggagctgtacccgcgacctaactaaccggaaatctgcgccctacggcgaataaaaataggagtaccaccgccgtaggtgccggacagcaacatgatggtaggagcaggacaacttgcgattgggttttgtgacttttgtcccgagtcaatccaccgacgctatctagcacgcgagtgccattacagagttacaggcattttatcgtgttttatttatggggcaattacgtttttatcctgttttggtgcctatttttaatttggttctgtttttttaagtttgcttatttgaccctcttttttaaaaataaagatcaggcttgaccctattctgtgaaggcaacctaacggcgttagctcatgacaaaaataccgtttatgcccttgctcatttgaccctacttttattattatttttatttatccaggtttgacaaagcggtgttatatttgagaaattttgatatgggtttgataaatttaacatacgtttgacaaatttcgataattttgacataaattttatatatttttgacaaatttaacttacacttcacagatttggtaaattttttgtaacatcaatctcaaactgtacatatccaagaaaaacacaaacacgtagttaaggtatccccgcaggcttaaaaaaaatccggaggctaaccagatggagctcgaatgctagatagccatctcccgcatgtcgttgctgctgcagctgagcagctcctacgcgccgccgcgggagcactcgcgcgtcgtcgtcggtgccgcactacgcgtcgctgcaactcctgcatgccgccatttgctgcacctgcatactgtcgttgtcgaagccctttcgcccgcacatgccgccgctgtagcacccgtatgccgccaccgcagctctcgcgagccgtcgccgccgaagccctctatgtacgccgcctccgcagctcgcgccaagtgctatctccgtagtccctaccgcgcggcgcccgccgttgcagccccgcctcgtgccaccaccgcagctcccgccgcctccgccatagccgaagccctctctgtgcgccgccaccgcagcccccaccgagcgtcgacgccgctggaccacagctcccatcacgagccgccgccgccgccctcaccgtgtgccgcctccgccgaaccctagctgcgccgccaagaaggcacgggatgaaaaatttgaccgtggggtgagaaatttggtgtttgatttggtgttcactgctcagggttattttagtcagtttatattataaaatgatttttttttctgtttcctttaaaaaaccctaacggtggagtggaaagaggatcagacggcaatttcgattttagaaagcagggttaaatgagcaaagtttaaaaagtagggttaaattagtagttggacttcagaacagggtcaaatgaacaattgtccctttatttatctagtagtattgcgatttgcgagtagtactggagtaactgtttagtaacaggccaactgtgtacgggccggcaagttagatttagtagtattgcgtagtaatgggccggtctgattgtttcctcttccttttgtggtggaataagttcactttgtggccatcaaaagtgattgaaatctaattcgtgaccttcaaccataaaatcagatatcttgacccccaaactcttaaaacaggtacaatttgactccctcagcggttttgctgacgtggcatccacgtggcatccaagtcatcacataaactaaaaaataaagcgggcctacctgtcatcttcctctctctactaatatatctcacttctcatccgatcaaccctctctcttgccccacttttttcttggcgtgacatccacgacgccaggatgatgatgggcgacggtggggctctcctcagaccccagccctttccaccccgtcactggtggcagaatggtcgggcgagtggggattggtcggatatgcagcttcctcgccagaagtcattgatgggccgcggcggcgggaggaagttgaggcaggtggatagcttgccaaggtcgcccatggcgctggcgtcaagggcgtcacttgccaagacagagtcgatagttgacatgcaggaactcggcgttgtggactgagcgtcggctattcgtttccgctgcaaggacgtaagaaggaggggcacggcacaggcggcgtgccccgcgcgtgaaggcggtcctcgaggggcctcaggcacggcgcggaggtgagagaccacgactggggtgacgctccgtgtggtgggcccgtggcatggccgcctcgcgcgtcctgatccggggtggcggtggtgctcggtaatggcccaggcatctattgccgcacctgcgtcgcctaggagcgtgtctgcacccagccatctggtctcccgtcctcccgattgccaccgccaccaccgccgctccggcccttgcgcacccaccgccgctgccgttccatcacacatcctctcccgcgcgaacatctcctccccttggccctcgtgatggcgttgagtatctgcagcgccatggcgtcgtcatcgccgccctcctcgtcggtgctgaacgacatgagtggacggagcggcaaccggaggtggccccgaccccacgggtgcagttgatggagatgtggtctagcgactcgcgagccgtcggagaccacgctggtaactgcgagggcgaggatgacgagcagcagcgtgggccaccgccggcgttcccctcgtcctccctctatcgccagcctccgcgacagagccgccgcccctggtttctctacgccccgatgccgctctcaacaaagaaagagagaatataggagggggtcactgacaggtgggccctactttttttaaagtttatttgacgactaggatgccacgccacgtcagcgaaaccaccctataaaaccaccaaggagctaaattgcaccggttttaagagttgtgggtcgagatatccagttatgtggtttagggttacgaattagatttcgatcccttttaagggtcacaaagtgaacttattccacagctcggttcggtggcttgagcagctttgcaggcttgcagcacgtcggcccatcccaagtcccaacccaactggcaaacgtgaggcaactgccgtcgtgaccgcgcgtgccggccgaccgccaaccacggcgcgccgcacttcgactccagcgagcgagaggagcgccgcgccgcgcgcgctggtgggaccgcagcccgcaggccaggcgtggcggccctgcctggcacagatgctgccccgccagcgccagaagtggaggacgcggcggcgtccgcgatccgctttagcgccacccgtcgcgactcgcgacgaccccgctagtccgtcggtccgctgcatcgccctgtggtctgcgtgactgcgtcgccttgccttgcgttttcagccctcgatcacatgcgcatgcgcgaggccgcggaccacgcgcacaagtgtcgcggccacggagccgtctcccggctgtttcctacagtagtccacgccgcgcgtgagcgcgtcccatccattcacatgaggagaggagaggagcgtcctgatttccctccccaccgtcggatcagccagggaccttcacgacggcgtggatcgcccccccccacccccactccccctgcggtggttggccggtgggccctgactggcctcggggaacacgtcagaccatgtgcgcgctaggggcccatagggggataggcccaggtagcccgcggcggcggctcgcgtacagttggccagccgccgcggccgcaaggaaaaccggagagtatagccgatagcgagatcaagccaggctgccagccagccagccgcgcaagctgggagccggctatcgtacatgcggacagacgcaacagctgcgcgagagcgacgtacggggggagagaacgcacttgcttggaaggaaggagcatacatttcggcggattccttgggcggcggcaaaaaggctctgcatgattgcagctggagaacaattcgatctgtaaaagcttacgtgcgccggcaatatacgaattgggcaaatgctctcgtgtgtccttttagcttggaccaggtgtatgttattatagacaaaacctaaagaaatccccttcttttcttgtgtagcggaaccacgacacgtatgattaggccagtgtttgcatagtgactacgaataatgataaagagttcacgacgaggtatcaactattagttgggttgaatctcacataatataatactcatgtatatagctcaagagatccttaaatacgacaagaatgtatacgaatgtatttgctgattatttttgggagaaaatgcaaaaggtaccatgtcattcgattacaaatgtatggctgcactgagaaacagtttctggacaggttaacacataagcaaagaccatttcataatgcacatgctcttcttattcttcttgtcgaacttacatatgtcattgacaaagtggtatccaaaaatctttgatcactatcatacgttaccatgcttgtttaatttgaccaaataaaacttttttttaaggattggtttccaaaacttatgacctagtccattacgagtcacaatgtctatgatttattcagaatacggcgcaataattttatataacttgtccatcatgaatataaaacaaaaaacttgtgtttaaaaaaatatgaatatatagttaccattagagcaaataaacttgtatacttaaaaaatcgttaggcaccggtgaaaggttcaatcgtaataagatacttcgtctcaacacgtcaaactaggtgaaatagtcggcatgcaggagattcgaatccaggctgatgggatacatgcattgccagctgcccagccattacactgtaaacgcatctcaaataaacttgtacgaacaaatatctatactaaatagaataggtaactaaagtataacaaaacaacgattaaaaagaaaatcatttttggacatgtgctacaacttgcaaagtttgagctctgattagagtgtggttttaggcgaaaaaaaagtccagtcttgtcttagctaagcagacagatcatcacgcatctcattgtgcttttgaagtccctatccgtccaaattaggctatctctaaagattaactaacgagccactcaacgaaaaagccaccaaaatctaaacactccagccagcccaaaagccacgccgtccactccatctccgcctccagtgggtcatcatatctcacgattaccatctcacatagtacaccggtgtggccatctgcaccgtccattgctcatcgagattattccaactcccttggtctacacctccggtgcacccgcgcaccagccgagccgagccggcgccgcggaaggaggcggcggcttgcgtaagcccgtataagttcacgggttacactgactggtgggaccagaccgggtggcccactggcaggaggaggctatactagtcgaggcgatgaaaagccactaatctccaacctcgtctacacttctccaaatccccccacggcgcatcgcccgctcgccctcgccgccaccaccacccgcctccggccaccgcacactagggcggcttgagccccagcgccgccgccatggacgaggaagcgaagccgaaccctaacgccgacgcggcgcctgctgcagcggaggcagcagcgtcttctccgccgccgctttcgagctcggagtcggcggaggggaaggataaggaggaggagaaggaggaggaggaggaggaggaggcgggggatttggtggagaagctggtggagttggtggaagagatcgccgccatctcggacttcaggaatgcataccggcggcagttctgcaacctgtcgcggcggatccggctgctcgcgcccatgctggaggaggccaaggaggggccgcggccgctgccggatgtgtcgtattccgctctccggcggctcagggaggcgctcgctgactccagggagctcctccggctcggcgtcagcggtagcaagatctccctggtgcgtttctcgcttgaggctcgttgttttgttgccatatttggtcgttaaaagattacatttcttctgcttatggcctttcgagtttatttaggatttaataggagaatttgcctcaagaattggagcggattttagtgcgttcatactccaaacttcgtattagcacttccaattgtcccctgtgatatgaccattttagataactctttgacatgatctactgtatctctacatttttaaaatattttgttgtttcttaattgttattttgtggttgtgaagtaagctcaagcttaataatacatgctgaaggttggaccaggttttgttatacctgggtgtcaaatcaatgccgggccagagcagttgatgctgtttagcaacaagcttgtcaaaaacattatctcattatatttttccttttcgctggtgggtcagagtgaaatcggcctcaaccatggtataggaactaattctgtcacataagttgtaacgagcttaatttctgacgcaattttgtgcgcagctagactaaaattcaattgaaactagagatgtatttgataaacagtcttgtttcgatcttttatattattaggagaggtcagtaaggatccactaagtttgtactggacaccaataatttgccacgttaattgcagaaaaagagaaatatctgcaccgttagattgtggttaggtcaagattacaatggggtagatttatcatataattttatacaatgtagagttgcatctatggaaacaaacatgtatatgaaattctgctcttttataatctatagttgcacacaaaattgcacgggaaaatccgctagtgtatacaagtgtattttgtatatatatataatataataaattatttgatgggcaatattttatagcatcatggttggttagttttaaggttccgctcggtgttttaggttctcattgcaaaaacatctctgtgggggattgaaaaattcttttcttttttacttttcagcagatttttgctgcatttgaacgaattttcagtgcatccaaacaagtttccttttttttaccagattcacttcatacaggatctacttgtaaaaatttcgaatcaaaatttcaaagtctggtcctactagggcatttatagtatagaagctcaataaactatatttccctgatttgtaaagaaagctcactgtgaagttactgcacattaaccctggtcccaccagggcatttatagtatataagctcaataaacatcattttttctgacttgtaaagaaaactctgtgaagttactgcacattaaccctggtcccactagggcatatattgagttaccataaatgttaatttccatacctgggttgctctttgcagctgaaaagaaaaactgattgcactcgtgcatttatcttgtaaccttcgtcagaatgatgtgctgtgttccccctcccaggatcgttatcctcgtcccgggaatatggggacaatcttatccctgccttgttaaaacctttcaaaagtagtgtcactcatgaacctgggagctttggtgacatgtaactacaaaggaaaaaagaaatgtaccaagaaaaatgcatttaatatggatctgtagcatcggacttgttcaaaagaatagctctttactttattctgtactgttgctcgtggactaacagttctgttacacaaaacataattgtggttattacaatgaagatgaactattcacagaagtgctttgttctacttgaattaaaaaagaagagaaaaatcacatgctgattacatttgacattcctattaaagttcttacgcagatgattaagtgaagaaattctcttagtaatcgctaatgtagaagttatacgtagaggtctcatcgtctaaatttcttctgggttctcatcaactgttcttcttcttttcctttttggagtgcgagcatcgcctgctgtgtttttttgcccaatgatcggtacattggaacctgctcatgaaaaaaaaaaactgaaatatagtctggtacatgcactgctgaccttggctatcatgggccacaaacacatgtggtaaggatagtgtggttattgcaagctatgagcagcgagagatgcaaatttcacatttcttgggtggatctaaaatggtagtttctggagttccatattgatgttgtaactgatttacatcaacttttttttttcaatatgtcaattgcagatttgtggttgaaaattttacgaattaggggtccctattgtaatgcataactactacaaatattagcttttcaaactaccaaacagtgttttttgcaaaaaatttctatatggaagttgttttaaaaatcatattaatccatttttcaaaaaacaaattagttaatacttaattaatcatgcagtagtacatatttcgttttgcgtgccggggaggaggggttctcctcctcctgaacgcagccttagtaaacaccggacattgaggaatgcaacgtttttagtagacagtcatgtgcatttcctaaccataagggtttgattttgcaggttcttgagagagagaaaataatgaagtctttccaggatattactgcaaggcttgaacaagccttaggtttaatctcatttgatgaacttgacatatcagatgaagtaagagaacaggtaggctaacatattcatgagtattttttttccatttagtaaaagaactattggagtgagatatttttagtattttttttattttgttttgttcaattttgcaaacttgttaacatgtgtgtggctattgtgcaggttgaattggtacatgctcagttcaaaagagctaaagaacgatctgatccatctgatgatgatctctttaatgatttggtgtccgtctacaactcaagcaccagtgctaatgttgacccagatattctccagaggttatctgacaagttgcagcttgccactatatcagacctcaatcaagaatcattgatcttgcacgagatggctagtggcggtgatcctggtgccgttgttgagaagatgtcaatgctgctaaaaagaatcaaggattttgtgcagagtcgagatcctgaaatgggaaccccagtaaatacgacagaactttcgggaaaagacaacatggcatctctgattgttccggatgatttccgttgccccatatcgctggatttaatgaaagatccagttattgttgccactggacaggtagttgattaacctatgtctactttcaatacgcatgcctcccatttgtatttggacttacaataattccttcaatatgcacatgcagacttatgagcgaggatgcatagagagatggttggaggctgggcatgacacctgtccaaagacacagcagaagcttcccaataaatctctaaccccaaattatgtcttacgcagccttatagctcaatggtgtgaagcaaatggtatggagccaccaaaacgtgctgctcaacatcataatgcaccagcatcatgtaccgctgctgaacatagcaacgtcgttgagcttcttcagaaattattgtcacaaaacctagaagaccagcgtgaggctgcaggtatgcttcgtcagcttgccaagcgcagtcctgaaaatcgtgcttgtataggagatgctggtgctattcctattcttgttagcctgctatctataactgatgttagcactcaagagcatgtagttactgctctcttgaatctttcgatatatgaagagaacaaggcaagaataatcacctctggagctgttcctggagtagttcatgtgttgaagaggggaagcatggaggctcgggagaattcagctgccacactgttcagtctttcactagtagatgagaacaaaataacaattggggcttctggggcaattccagctcttgtgcttctgttgagtaatggaagtcaacggggtaaaagggatgcagctacagccctatttaacctgtgtatctatcagggcaacaagggcaaagctgttagagctggattgatccctgtactattaggactagtcactgagactgaaagtggtatgatggatgaggcccttgctatattggcaattctctcgagccatcctgagggcaagactgcaattagttcagccaacgccattccaatgctagttggagtaatcagaaatggatcagcaaggaacaaggaaaatgctgctgctgttctggtgcatctctgcaatggtgaacagcagcaacagcatcttgctgaagcgcaggagcagggaattgtgaccctgttggaggaactagccaaaagtggcacagacagaggaaagaggaaagcaatccagcttcttgagcgaatgaatcggtttcttatgcagcaaagtcaagcccaagcccaagcagaggccatggcacaagctcatgcgcatgcacagtctcaagctcaggttcaggctcttaacgaagctcaatctcaggtagagatgcaggtggagcaattgttgcttccaactacttcacatctttctgatagacgagacggttgataagcaggatgttattcatagttagtgggtttcttttttattcatagtcagcggcttgtttttttggctgaggctagcagttggaagatcgcctgcaatgcctagcgtggaggtgtgtggtttttgttaagcaattagaatcaggaagtgccattagcgtgattctagggccatgagcttcttgacaattgagttttgaggtcgtggaactgttaacctgtgtgccgtttgtacaatgcacccagtgatgaatgttgggaccctcgagttttagggaggtgccattctacttgtacccggtgcctattacaggactggtctgtggcttccaaggttgataattttacttgcctgactcacagtttcagtgaattgtttgttcactttgttaagccaagatttccctacatagctatccataatctattgcatggctggagcatggagggcttttcatatggaatgctctttcttcagttggtttaagcttcaggtctgatctacatttctcagctatcatgtacaccctctattctcaaatataaatatttctagaagttttagcagaaattaagattaaggtcagaataattgtgattggttgggatgagaaaaaaaaatataacttatatattataatagaagtttaaaatcttagaaatgtttatattttaggcggcagtatttacgtttctcccacaccgctacgtatatgccaacacctcggactggagggcaacttcgtctgttcgattgtgcttgcaacaatcctccccgggaatactgtcgcctggccaggaatctacctgaacatca

SEQ ID NO: 24240 - DNA, 19194 bp, Oryza sativa
ggggggtttcgatgaacgcgtcgatcgtacgcgcgaacacggcgacgacaagctgcgccgaggacagcaagacgacgacgtcacatcgtgggcgcctggctgcgcggtgcacggagcgtgcaggcgcaggcaaggggcgcggcagcggcagaagcaggccctgacgacgacgacgacgccgatcgatcggtgtcacggccggccctgaccccgatctgggaggcatcgttcggtgagtttgccttagccagttaggccatgacactaccttctgtcgtctcaagacactctctggttagacacgcccatgcctcggtccgcatgcgtgttccttactctctccgtctcagaatatagcaatataatactagatgagatgagacatcacctagtatgatgtatatggacatggggtatgtctagatgcattgtactagatgatgtcccatctagttatagttataggttgctatattctgggacgaagggagtaccttttccatcgtcaacgtgagagagagagagagagcgagagtgtgttactgtgctaggacgtactactgctgctgatttgcttgcttgatcgagcctttatggtggagaaatctggttatggaggtgacgatcgatgctgccaaagagtcaaagcctgatgtgaccggatgagataaaaaggtggagtaataacaacgtttgttgccacaggcgggggcccaacataatgcaagcgccatgcgatgggccattccgtcatcgctagcaacagtgtatggcattgtaggctatcatccaaactagttgtattgcacaattgtttctcaagaaaatctcacatgtacaggagagtgatgtggaaaaattcaaaggataaaccatcatctcagttttcgagttatgatattaacggtaaagaagaaacacacaagtcgaggaattggctagtgattatccagctgatgagaatatgaataataaggggttattcagcttcctgctactaatttattttttcaattacatactactcctactttggaggtacttcctccgtcccataatataatcaattttgagttttttcttacactgtttgatcagtcgtcttattcaaaaaaattgtgcaaatataaaaaacgaaagttgtgcttaaagtaatttggataataaagtaagtcacaaaaacaataaataataattctaattttttttgaataagacgagtggtcaaacagtgcaagcaaaaactcaaaatctcttatattatgggacagagagagtatattattccatccgtcccaaaataagtgtacttttgcattattcacgttcaacgtttgaccgtttgttttatttgaaaattttttatgattagtatttttattgctactggatgataaaatatgaatagtactttatgtgtgactaaatatttttaattttttcacaaatttttcaaataagacgaatggtcaaacgttgagcacggatatgtacagctgcacttattttggggcggaggtagtatatagtagtctgaattgtttggtggacctgcattttttatggtggctagagccgacagaagatctctaaacaggcatcagctagcggccgtgtgcgtacgtgcctttccaacgggaacccaccagcggatgtcgctcgcgctctcgcaactctctcggctgcattatttgatgatccacgatggcacgactcacatcaggtcgcgtcgcattattgacacatcttgatcgcacaaggcgggccggctagcgacaaattaacctaccaaattaatagcggaatataagaatagccctgcaggttaatcatctgaaaaatcttgattaaagcaggtcatacatgctgagcagtgagctacagcaagcatgcggtgatctcatatgctgattgattagttaattagttagtacgatatgatccatggacgtacaatctagcgacaaatgatcactcagatgtcaggtcagaagcagcctacaaagagaaagccatcatgatctctgttgttatccgatttggcgtcgttaactactatcatgcattattgatgatttgtcatccagttggccacttgagctcggttggaatcgcttcaagagtagaaaatacgggccctacctttgacaatgctagcaatcttagagagagaacgagagaacgcgaagaaacacaccggaaagggtggaaaccgacgttaacgttacgacaaactagtgtaaacatcagacaactacaaatacagaggctaaattatcatcaacatcaacttactaattagattatcctaacaattacaaataaaattatcacaaaactacaactttattacaacttgtacgttactgacacattggacctatatgtaacttagagataattctcgacacggatgaaacattgccaacttagcacgcgtggaaagaaaaccaacaccttacggtccagctacacaccatcgcagcatagtatagctccagacaggggcggagctagagcgagatggaggggggtgccacttgtttaatttatctgctttatatcaagtttaagctaatgcgggtgtctaaatttgtattgaggtggtgcatacatagtgaaaataggtcaagtatagctacaaaattttcttgaccgggttcctgggcacccccctcaaacactctagctccgtccctggctccagagcaacttagtactagggttgaaactggttcggatagtttccgtccgtccggaccatttttcggatttggatagtttcggtcggaactatccgaaaattctcggattcggaaacgaattcggattttttttctcggaaacgatataaatgttggagatgttgaactaaaataataagcgatatctcttcctcgatcaagtaactcaatttgaggggttttttatataccggtaaatattcgctaccgtattcgttccgtctcgtattcgctccgtatctgtattcgataatattcgatttcatttccgtatccgagttttcgattccgattccgatttcgaaaaaaaaatgaaaacggatatgataaagctagtttccgatccgttttcatccctacttagtatgtcctgtcataactcataacccagtcaagtcggctgaggtgggcactgcacacattgtttccatccctttcccgctaattgatctgtaatacgaatcaaactgctaacaagattatcgttagattattttaaattttattatatttattagatgcctcataagtaatctaccttaccatatgatgtgaagaatatctgatattattctgcataggaagggaggggggaggtggttctaattggaggcaaaccatgcatgtcgatttcctcatctcgggtgatgagatgttaatcaacatggcatgctgtgagaccactacacaataaatgcgatgatgttgagtgttgatgtgtctcaccatttcagtgtgccaaaagacacatgtatgacatgtgggtctactgtatccgtaagttaagagttgtaaccgaattatagatttatgataattttttccgtaatggttgtaacaatctaaaatgtgtctctaatgttgtactaattaagttgatagtttagtcaataaaatggtagttctctcaaatttacttgaaagactaaggttgcagacttgcagttgcttcattagtttcacaatgaaatatcttagatccctatttagaataaacaattaatgtactaggtatgcagctagctagaactggttagacttagactgtgtttagttcacaccaaaattgaaagtttggttgaaattggaacgatgtgactcaaaaattggaagtttgtgtgtgtaggaaagttttgatgtgatagaaaagttggaagtttgaagaattattttggaactaaacacggcgttagccagtacaatttttctctgtttgccattcaatatatcttgacaaatctgagatcattattaatcaaccactagaaaattgaagtgctatatatgtatctaggttacaatcagcaacttcatgtcacgcgagcttaattttgcgcttttctttaaatgggacggtattccatttttatgtaaatgatgaattgaagtacaggagacagattgaccctatgaaagaacgcaaactagtgtgtgattaatgatgatgctacacaaacatggaagctgtcactaactcttcctagctccaaaaaatggtaaacagaagtacaagtgacacgacattactggtctggtagtatgagagtatcattttgctatacacctatgggagggaaaattgccaacatacatctcttcaaacaattacacacaataataatgtgcactactggaaaactgatctttgctcggtcgccccaaaaccacagtagtcccggttataaaaagaacccgatttaaaaccccatagccattctacgatctttagtcccgattggtaacaccaacctggacgaaagatgatctttagtcccggttcatcccctgtcagttcattgtcagaggggcggggatctttagtccggttggtgtcacaaaccgggactaaagatcaccactttagtcccggttggtattactaaccgggattaaagatctcctagatctttactcccagttggtattaccaaccgggactaaaatcacgcgtagtatataatccatattccctatcatctcccccacaaccggcctctactctcctcagatccatctccctcttctcctccccttcctcctcccatcccggccctctcctccccctcctcccttccgatccgatgcttagcgagcgtcgcctcctccccctcctcacttcccgcacgcgtcaggcggggccacacgcggtaggcggccggcggggccgcgcccggcgagtagcgagcggcggcaggcggcgctacccgcattcattctttttttctttttttttacaatttgtgattcactgagatgtataattttgtgatttgttgtatggatctgatatgtataatatgtgatgtatttggtttgtgtgtaatttttttaagatttgtgatatatttgatttttgtgtacaagtaacttaagatttgtgatgtgaatgttttaggatgttactttgatttggggtttgatttgggaatatgcatcccactcgatttgggagaaaatacagggattaaactctagctaaaaaataatgaaaaaaaaggagacataataggactgccgctaccctctgttaccaaccgggattaatctttagtcccgattatttcacccggactaaagatagcgatctttagtcccggattcatagttccggttagataaccggtactaaagagggggttacgaaccgggagtacagagggtttctccaccagtggtgcattcgtaaaaaactaatcaaatgtctactaatttgctactgataaaacaacaatgaatcatacatgtagtctagtattcactactacggaattattaaactaataaaaaataataattgcactggtttttgggtcaagcctgtctctcaacttgtattgaatcgatgatgtgaatacaaataagagcattatcaagagattatgaataatctttcctaaactgaagataggaagtaaagaaactgatctctctaagaaagcctaaattttatcctaaaaattaaaagtggaccattttgttaaattaccaatatttttttcctccaagcgcgtggtcctcctggcgtgcgagaaacagattgggagtaggaagggaacatacgttctcactcaaattgatggagtgagaaatacggagaagggaactccagttttgaaaataatataagtacttcatctatccctaaatataagaaattttggttagatatgacttatcctatgattctgtccagatttattggactaaaatatataatatctaaccaaaatcctttatatttaaagatggagtgagtagaacactgttggttgctgctctaagagagcaagttcaatagctaaagcaaattgaacgaagtcgtcgttgctcccctcacacatatgcatgtgcccttgccatgcacgcatgcatgccatcaaattaaaggcggctgcattctattgctatatgctaccacagggtacttactacttacgtaccccccgacacgatcattacggctttgattcgtttcgatcgatcgattagcaacaccggccgcggccggtagtctcgctcatactgtagtcatgtggtcaccattgcatgccgtccgatcgattgatcgatccatcgatgccgtgcatgtgacgtgctaacgcttgcgcagcccagcgcactcgatcataagagccatgcagctctgctgcttgctgcctgcatgcatgcatgggtgtaccaattactaattaaacgcagatgctctcgctttctggctgatctgatgcccactaaaataagctggctttgctgctttagagggcaaacagtgaacttgccatcctgataatgatgatgcatgtcatgtgatgagtgcctgagtcactactgaaaaactgatttttgctggatcatgcaaaatctatattagtcttggttcaactaggaaccggaactaaagaatatctttagtcccggtttaaaatgttacaatctttaccaaccggaactaaagatcatttttagtcccggttcaaaataggtcagacgtcccactatttttattcccggttggtaccaatcgggactaaagattgatgcaccatatataatccctcgcacttttcctcacctcctctccacaaactcctcctcctcatctgtaactacctttccttctcattatcctctctatcttatctctatcctctcatcctcttttttttttccagcatcctctccttttttttccagcggcgaggagccgcgctgggcggcggcggccaatgcggcgctaggcggggagcagcgccgggcggcggcgggctgcgcggatgcaaatttgtgaatttgtttcctgtgaattttttatttgtgatgtaaatctgtgatgtgaatttgttcatactatggatctgtgaatttgtgatgccaatttgagtatgtatattcgatctgtgaatttgtggatgattttgtgatgttttgtgaatggggatgattttgtggttgagatcggtttgaaatcaatataagtagcaaaaaaaattattaaaaataaaagaaaaaagactacagatgggaacttcagccacgtggcgctccggtctttagttctagttatttcaaccgggactaaagatacccatctttactctcggattcacggtcccggttatataatcgggactaaagggagttacaaaccgtaagtgaataccctttcttcaacattgagtggcagtgcaggagccatcggtcaaatggatgacgaacttagttggattttttttctccgtaaagtaacccactaatcaaccacccagatgtaagaataataagaatcttaatcccatttggtagatctcccgagcattattcttccgcgtgatttcaaaggtgtctttttctaaaccgacaccgatgattcatctctatcagcgtcgcttgtgtggtgctggggttgggaatccggcacatctacgtggagttcccaatcagcacccatgagaaatgtttttgtgctagtgtgtcaggattgaagacgtgtttagctagcagctaacgtgggttggctatatataaattggggggaaaccacggaaatcgatagcaatctctcgagaattaatggatcctcatataaccttaattttctcttaaatacaatgcaaatgatcctgaaatattcaggaaagcatttagaaattagtgcatcgagatatattgatcctctcaatcgattcttaggccgcgcgcgttcgagtgatggtttggagccatctcttcggaacgaaaacgaaatatctcattagcgcatgataaaataagtactaaattaaaataaattaaaataaatttttaaaataaacttttctatataaaatttttgaaaaaaaaagtttcgtttaaggattgggaaagcgtgtttacgagaaacgagagagtagaagatggaaataggtattttccgaacacaaacctaaaagagtttcgcaaatatatgagagtgggtgtacaatctcaaccggattttgtttctctctattttggttgtagctcaagagttgtgcatttagggccggtgtctgtagaaactctcattttttttttcatcttaatgcaacgaggttttgcgtttccaaggtaaaaagtactatgtaagaaatagtcttttcgttccaaaatattattagtatttctaacttattatatatctggacagggaagtaattaagtgagttcgatggagctttaggtatacaagggagctcaggaagtactcttaacaaacattggctaataagttgcagatatccctgactaataattactcctacttaattactatttcccagtattagaacaaatttcgtaccttgacagtacgtcgagccctccatgcttggttcgacgaccaaaggggatcggaaaagggaacaggaaacactcaaacacacgtaaaatggctgaaacaacatgtggcacggcacaccacagcggacgtgccatgcaacgagacacaggcaggccggccggggtacagatcgacagaatggcccgttttgcccgcgctctaacgaccgacgaccaactgatatatcaacggatcgaagtgcgcatcgatctactggggcgaagcgaagcgacaagcggcgaaggcgcgcgcgtggaaagctatagcagagcgcagagcggtgaactcgcggtgtcgccgggacgcgaaggcaccaccctccctgccaccacgcacggccctagctccatcgatcctcgatcgatcacgacgtgatccgccgtattatctcccgcagcggcaggcgccggccgcgctccgtgcaccatcgcggacaggccgggggcgggcctggaggtgcacggcgcatgtcggcatgcatgcctgacgcagctagctcccgcactaaactagctagctagggagagaacgaaagacgatggatatatagatccagggatggatatgtgtcgtcgcgcaccgaatctttcttaaggctgactgctggctgctggcgctggcgctggcgcgctgctgtgtttcaaggatgactgctgttcaccaattaatgttgctcgctgccgcaagcccggcgcgatgtccggcttctgtcccctctctcgtacgctagttgcatcagcatcaataccgccaggcgccagcatgtgggttccggttccgccaggcgtttgctgctgcacggataggtgtgggttaatttgtgattttgacccaccaggtaatatataggtcgagtttgataagatactaccctactgaaattttgttattagtgctaccaaaacatgccaatggttaatttgatacttattgttatatagttggatttagtcatacctcggtaattgatgatgagtaagcacgacttaaaaggtagggtttctcacctatcagaccggtcttttgggttgtataaacccataacctaaagtcgtggttttaattggatccgtggtggagcaggtccaccgtgaccttggtggttcatggttggtgccttggtggccggccgggctacgcactagtataaattttgtaaaagttgtcaaatatttgcgtcggttaccctacaaattatcagttgcatgaataaactcaattttgttaatgagatacaaaatcaacaaatcacaaagggaaaacactattctttttttatttctcctatgtttctcatttttatatctcacaaatgaagttgagtttatccttgcaactttacatggttgtctaatactacattagctatttgtgagattttttcccaatttttttaaaaacttttatatagttgtttgagatataaaattgagaaacagaagataaacttcctctatgatttgaaaaattctacatgactagctaccacataatttctaaaaaaatgttaaggccttgttacttcagttctaggcatatgattttcttggctccaccactgaaactatcacataaatttagggagagggtggcagtggggttattgagggaacatttgcggctgggattattattagatggaaatcttatcatccattcgtagttaacacaacatccctacaatcaatttccctaccaactaggaatccccctcttttcctatatgtcgccctttcttcctctacatgatcctaggcgcctctagctagatttgcccccagtggccttccccaccactaacctccgatgacgagctctattcaaattttatctgtagacctatccttcatttgacattgcacatgctttttcatgtgctgatgacacacatgttttcattgccaccatgaccgccccattggcatctacaaatcgtgattgtggcattaacatgtggcccctacatcacccatcctagtagttggttgcaacagctaaagccaatgcccctaatctagtttgactttgagtttttatatatacatttttttatggcacacggttccaacattatttggtaatacactctctgtcctacaataagtttatttatccttcctcctatttattccagaataaattcatttttgagtaatcgttgtatcaaagtttgtgaaagtatggaataaatgtattgcaagtagataaagtgaggaataatggcattgaaattcgataaagtcggggcattatagtctcttgggtttggtattggtatacatgagatgggtaaaataaacttattttgggatgacgggagtattagataagcgttttaccacaatgagaggtgcttgtattatgtgttgcagttattttccctagtaaattttaaaacttaatggagtactccctccaggttgaaaatacttatcgttttgaacaagggtgaggtcaaactttaaaatcattgaatataaatatgaataatttctaaaatatttgccgtagaagtatggagaccatatgtatagattagtcttaaaaagtacttcaaataaaccgtgtatttgttgattattttatttatactataatagaaaataacgatcaaaactgcttttaaaaaaccgtgtccttgtctaaaatattaggcaaaatttgctacagggcatcgaaaaaacgtgtaattagctcgtggacaccacaagaacgagaatttgctgatgggcatcacaaaaaatgtgtaattagctcttggacactcgaggccttattttattgtttcctgtggatttggatagagaaacactggtgagagtacgattttgcccctgccctcatatccagcaagtgattcttgcacggctcgccggcgatgtggcgccaccgccgccgccgtgatctgcagatcgcgtacacccacccgacgagcttctccatcctgcgacgcacacccaggacgtcggcgggccatgagtccatgccgccacggccggcgacgtcggcgttgtgcctttgcaggatctccctcgtatgcaacctgcagcggcagaagcgcatctgcgtgcgtgtgatccggacaacattccatcctgcagaagccgtcgcgtaaccccacccccctccaccggccattgctattgtttgccttctacgttcactgaccccgtacgcatggttcaccaactggaaaagaaaaaagaaagaatacaaagctctgcagacaagatgagaggaatgagagattgcaatggagaagaggacgagaattggtgcctgtttttttggttgatttgaatcgagatgaatcgatttgaaccatacatatacaaaattggaaatttgattaagaagagaaggagaagaatcgaatctcttcccggacatggcgcgcaccagcgcacacaccgccgcggcgccacccccggcgtccgcgatcaccgcgtcgtgcccgccctccgtccggcacagccgctccaccgcggccagcgcgctccggctcccctacgccgcctccctccgcgacgcgacgcgcgaacgccgccgcggctccggcggcgacagcgcgggggtggttctccttagcaaggcagagcatgaaaatgccacggatcccgatgcggatggcgcgggcgtgggccttctcctcgagaagcgtaacgaggccctcctgcccctccatgaccccctctgccgcgcccagcaccgccctagcatctgccccggacaccaccgccgcggcttaacgccagccaagccacccctacggtccccaaatttaagggcaaacttgtctttatttagtgtttctctctctaaatacacaagaaataataaaataaggccacgagtgtccaggagctaattacacgttttttgatgcccgacaacaaattcttgttcttgcagtgtccacgagctaattacacgttttttcgatttcctatagcaaattttgccaaaatgttaagtactatcaatccagagggagtattttgtatccgtgtgaatccatatttcacttgtcataactttaattgtacaaccttattggagtatgagagcataagtgtactcccttgcatgccccgaaagaaaaaaaaaatgtatagttgactctctagacatcactacacacaatggaaaaatcatagaaaaatttccatgctgattaccaggccatgcatgtcttgtgctcattgtagtcaaaatgcacgtcctacaactaaacattttgagggcgaaaaagaggaaacaaggaatcgagaaattattgctgctagttccaaggggtagaaaaaaaatcccaaaatatagtgtgaaagggtagtatcgataaaacacgcagaataaatatatatttaaacataaacttcataatgcatactactccatctatccatactaaaatataagaaatccttgatgtatccgaagttaaactattctaactttgaccaacattttagaaagagaattaatatccacctcaccaaacaagtaaattatgaaacaatattcgataatggatctaacaatgcacatttgacatcgtaaatatttttattcgtttctataattttggtaaaatttaaaacaaaatgatttaaaactaatattagataacttatttttaagagggatggattagtaattcatagtaacaatgataatatatatgcacagggccaccatattagcaggaatccgcactaccacagaacacgtgaatagtgccagttagaaaacccctttccgtgtcggttttcccaatcgacactatggaggcagcattgcagagtaaaccggcaccaatcccattttaaaaaccgtcacctttgataccactcgtgagccaaaaaaaaggctcgatgcatcggctcaaatcgagccgatgcatcaagctcatccaccccgcatcacggaactccaaatcaatcaaaatccccaatccccaatcaaacaacatcacagaacaagaaacattgaagaacatcacagaaatcatttcactaacattggaggcatcacggaaatcatcacagaaagccaccactgcctctcgtccagccgtcgcatctccctcccttccgccgctgccgggccgctcctccgtggccgccgctgggttgcccctcctcggatttggcgaagggcagggcacggtcgccactgccgcttccgccggctagccaccggccgtggacaacgagagagagtcgagaggggagggcgccactgccaggccgccgctgcctctcatcccgccgccgcatcccccctcccctccgccgccgcatgccgcctcccgctgttgccgccgatgggccggccctccccggatctagcggaggggagggcgtggccgccgccgccgcctccgctggccgggagaggagaaagagaagagaagagaagagagcggagagaacgagaggagacgagcggagagaacgatagagagactgataggagacgagcgctacggaccttatctcctcgaagcttcgtggtgaggcccgccggctcggctcaattcgtaagttctggtttattataggtgccggttttaaatattaaaggttctgatttttttaataacagacacaaaatagaataggtgtcggtttttatttataaccgatatctataattacttaaaggtgtcagtttttttgcgatttcaactcacggaggtgggaaaaggcctatagcaaccggttttagcactatcaaccatatttgctttggttttagcattttggagttgccatcaatactagctcttagatgcgacctagtttatctagatttttctccaatgaatgcaaattatcctaaatacccgcagtgaaaacttttcggtaggtacgatcttaattaatttatagctagtcgtcctacattcactgtaagcctgtaacgtacgtgcagtgaaaacttttcagtagggatcgacgacacatgaaccttaaccactgtagcttgaatccattggcccattggaactcggcacactcgcactcgctctgactagtatacgttgcatccgccggcgtggcgcgtgatcttggtagcaagccacgcctagctagccaagctcttgcatgtgtcgagccgtaacgtgccctgccccggcgtacgtactctcatgggccatggatcccgtatacaaacttaagctggtgaggctgaccacacacgcataaacagtcacgtatagctactctaggcggcagcttgtggtgcgcgcctttcccccttgccactgtgctcattatgtttgtgtacgactgagcttgcacagaaacatatgggcatcgatcccatttgatgtgcgtgcgtgctgcctttattattctctcctctcctctctctctgatcatctaccgcatccatccctagctatacttgcatcgatgagagagagagaggaagcaagctgcctcggtactcgggaaagaagggtctcttcttcagctaccactgcttgcaaggtgatcgaccgatcgatcatctatcgataggccagcatgcagcagcagcagtgcagcagtgtgtggcagcagctagccccctccacagattcccttggcaagcaatgacacaaaacctttgcaaagcggccgcggccagcgagccattgcgcgcacgcacactcacgcgcacacaatgacacaaaacctttgcaaaattacacgggaaatggtcctcgccgagagcttttggcatctcgcttcgctttacccgcgacgacgcagcctgtgccggccgagactcatgtcactcctatccctgtctttttcccgcgctgcttttgattgttgctagtgcatgcatatgcgctgctactactactacctcctcatcatgcatgcgtcgttggatttgttttttggcgcctatcaacgcatcacagttgtaaaggaccagggtatagagagatagctaagctagagaggcatgcaaaagctttagctaaacccatcagcgccgtgtacctggaccatgcaaagcatacaatagcttttcctaccactgttgtctccctctcccacacccccctgttggctatagctagctgttgtgtctgtgtcactcactcactgtgtggatcagcatgttgatgtgtatatactactactactacaactactactacgtaccagtccactgatgtggctagatgaattgcatttgccgacagatttgcgtgcgtggatttacgtttctttttagtacgtggtttgtgaatctggtaggattgattgcgccggaaatagacaattcatagcaaaggtagtagctttatttacaagtgagagcactgaccggcccatccctctttcagatcaatatggaggcaaaggatatataatgccatcgaacttcaatttgagtaatctgattggcatggaagaaataaataaagttagtcgcatatgcatatatgtcaaatcggtcgacatcgtggcttgttaacaaaagctagtaatccaggagaaaatggatattgttgtatatccataggtagagaactttacatgggcaatatattcaagaggggttattatagctccatctagtaaaaaaacatgttgttgcgtatgaattgtccgtgcaactataaattaaggggtacacttgctaaatgattattaaaaattccgacatatatgatcgatactggtacaaaaggatataaaacagtcctaataggacatgatcacctaattaagtaacatggcaaggcatcaaaacctactcagacaaagttattaagagatactagtgtataccagttttatgtatttcgtaccagttctatggaattttaggtaaatatagaaacactactacgaaacaagccatctttgccgccccattagtgtcggttagctaaaacccaacactgatatgtaggagttttcctatcccctactactagaaaaatcgttttccgggaggccaaaaatagtttttcctagacgggagaaaggaccgtctgtacgcaaaggcatgtgaaaatcatttttgcaggcggcatcttcatcttcacaggcggtagattcactcgcctgcgaaaatcatttcagcgaacaaagaaaagatccacaccacccctacccgccggcaacgccgccggcctccccctctggctggcggctcttctcctctgtccgctgccactgctcgaggggagcgtcccctctttcatccagatttgggaggggaggggccgacgctgtttgcagtagttgtcgtcgtcggctcctcctcttaagtggtccctgaaaaaattgatttttgcgagagaggttaaatttggaggctctttagctattattcacaaacgattaaaagggtttttttttgtccgcctggaaaaataaatggctaacatcggtaaaaatcgtttttctagcattgccctgaacccatgcgcaccatgagagagaaaaaacccgacactgatgtgtggtcatcagtgccggtaatttaaataaaccggcactgatgtatttacagtacattagtatcaggtttttttaataacccaacactaatataaggtcatttgtgctggttattcatgtaaccggtactgaaacaaccggccaagccgagctataagtgagtcagaaaataaaaacaacagataaaatcgaccatacgttctgagacgatcctacccatagagtctaaatcgatccaatccatccaccctcacgctccatccctcgcccgccggatccaagatgttcttgatttgtgatttgattgttctcatctttggcctgtggatgtggagttcttgttcctattctctaatagtggatgtgaatttgtggccaatatggatgtgatttggacatttggtggcgtgtgattcctctccgcctccttggagaagagtcgcaccctggtgcacggcagcggtggtggccaccgccctcctcaaggcgtcatagcggaggcggcctcctcacggtgcacggcagggcagtggcaccctcagccctcctcatggcgccatggttgcggcgccctcccgtcggtggcgccgccttcctcatgtacggtgcacaacggcagtgtcgctccctcccatcagcagtggcagcctccccatggcggcagtgctccccttctccaacctcttgtacacctctagcatccgttcaaccctcctatgatgtgcatcgcctgcatcatctcattgttggacggccagatctagccaccacaactcggggcagctagatccggtcgccatgagtaacggtatccctctgcctccgatgagaagtggcaccggcgtggccttgaagcactagctcgaatcgagcagatgcatcgagtcagctttttttcattcttgaacttcaaaggtgccggttcctaaaccaacacatttgattatcctcgttggtgccgtctaccgggcactggttgggaaatccggcactaatagagatttttgcagtagtgacaaccagcactgatgacatattttgtagtagtgaaagaccgtgaggttaggatgggccagatccttccatgttcctctataagctgatatcgaggagcttgtcgatcagacctcaaccctagagaaatcgtcaagagatgtactttagccgtagccagccataccctattcatccatgcatgtaccacataggtagtactgttcccgtacatatacgaatgcagacaaacccaatggaatcaccctagctaaagggatcttgaacttgtataaaatctctctatgtgtatatgaggatttacgaattcttgccgttacatacaaatgatcctaggtcgtatggtaaaaacactagctgcgaagataattgatgttcaaacactgtaatgtttggcatgaaacatctcatgactaaaatgatgttttccgtgatcgtccggaaggagcactgttgtctgatgcgggtgtgcaatttccttctatgccgtagggttccgtttaatttcctcaaatatggatatgatctattctggagtttggactgcactacagtcaacatccatgcatgtggctctaacattaggtgttttcgtcccatccttttaattttttgtattttgataaaagcagcttaattaattacaatattggctagtgctataattaaatcatacataactgggtcatagtactccaacagtagaatagccataaatgggtcatcagttgtaaagcaccgattctctctcctggcacaagagagtagctcaccttaactttaatttgatactgccatgccataagctgcatatataattgcccgtctgacaccgtacgtgtatcttcatatgcatgcatttagctttgtgtacctagcttgggctagaatcatatgcatatgtacacactagtacacgcagatgacacgcagaagcgcatgcagagctccaagtaccaagtaccaacctgcagtccaaggaacaaaactacgtggtgggcaaccagatgtataaattaaagatcaaaagcgagacgaaaaaggtaggatcataataatcaaacagtgcagatctctgtacaggcaattaaggttcatt

SEQ ID NO: 24241 - DNA, 771 bp, Oryza sativa
cttgcaggagacgccgcgctgcagcggcagcggcagccgcagcccagcctctcgccttttatctcacacgctttcgtctcgtctccaccatcccagcaaccgagccgagagccctccagattttttcttttttaccccgattaaattcgtattctaggcgttactactagtagctcgtacggctccggcgagccgccgcgaacgaatgccggtgatgctctagcggctccctcgccgacgcgcgcggggcggcggaagcaggacggacatgaggaagcagccgcagccgcaggggaaccgccggctgaggtggctccgggcgctgctgctggcgctcccgctcctatcggtgcccgtcctctacgccgcgctcggggcggcgcgccccgcggcgccgccgcggcgcggggcggcgccgcaccagctgccgccgaggctggcgtacctcgtatccggcggcgccggggacggcccgcggatccggcggatgctgcgggcgctgtaccacccctggaacttctacctcgtcggggtcgccggggaggaggagcgcgcggatctcgaggcgttcgtgcgcggcgaggaggcgccccggcggtacggcaacgtgcgggtcgccgcggcgggggagtggggaccggtctcgcggcgcgggcccaccgagctcgcgcgacgctccacgccgccgccgtgatgctccgggagttcgatgggtggagctggttcatcaatctcagcgcctccgattacccgctcatgcctcaggatggt

SEQ ID NO: 24242 - DNA, 10632 bp, Oryza sativa
  unsure (1)..(10632): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacatattttcgtttgcttcacagtatacagtccctgttagtcgttgtggataacgtcctaattaaccgagtcaaatataactagtcaacgactcgtagcaagcagccaatcagccagctggctcgcaatatctgcagaaactagtgcatcgacattgccatgtccgactcagcaatagttaagctcgtagtagtctccatatacgaccgtcaacatcaaccattgcatgcaaccaattaaagagtcaaaaaaaggctgcaatcacatcgctcctaacccatatccaactcatctttataagatccaaccattcctccccagtgaacccaagccccccacacacacttctaactagctaggtgtgatacacagcagtgacagtgagagtgagagtgagcttgagtgatcatagccatggcattcagtagcaaagcttgccgttgcttggtgctcatgtcatttgccttgctcccactgagcatggccatggactccattggcagctactgttcagggaacagcttggccggcaacagcaaggccgtggcaagcatcaactccgtcctcaccgacctcgtcgccaagggctccaccggcggcggcttcgccacgtcctccgccgggaaagccaacaacgtcatctacggtctcgcgcaatgccgcggcgacgtctccaccagcgactgccaggcctgcctcgcctccgccgccaaccagatcctcaccagctgcaactaccaatccgactcaagaatatggtatatatgccaagtgtgatgaccacaaacatacgaaaaaacaatgaattcaggcgactgataaacttcaaaactataattattctacgtgcaggtatgactactgcttcatgcggttcgagaacgagaacttcatcgggcagacggacacagatgccggggtgattcttgtgaacgtgcaggcgatggataacggcaaggcgttccagaaggcggtagggaaggttatgggcaaggcaacgtcgcaggcatcacaggctgggagtggtgggctgggtaggacgaaggatcagtacacgccgttcatcaacatctacgggctggcacagtgcacacaggacttgtcaccgctggcttgcgcacagtgtctgtcaacggcggtgtcaaggttcggtcaatactgcggcgcacaacagggatgtcagattaactacagtagctgcagggtgcgctacgagatctatcccttctacttcccgctcgccaccagcgcacgcagcgccaccactgacatgaccaagtacaccaagatcgttgtgcaccgctaagcatccatggttagttgcacgtacatggtgatgtgcgcatgcaaaagttgcaaacacatcacgtacgtacgtattaatgttcaacgtattatgtgtctgtggatgtttcagcgtgcagtggatgaataatcaaggctataaaatgtagccttagcatgttataactgggaataaagatgtgagtactagctaagcaatgtacgcgcacattcgtgtggagtaataatattagagtttttaaccattgcattatgtgtgacgtataaagtacagacaattaattatataccacgttataaaatataagagattttacccatttaatcttacttatatagataaaatcttctatattttataacggagataatatccgtgatcttccacttataaggacaagcttggaaggcatttttatagcttcgacttataagtcgcatgatcatgatatagcgcacaaaattaggttatcatttattttaattacgtgcatgggtgggaagagtaataatgtcccccggcgatactatggtgtatgatctgctatacatgatggccaagccaccaaggactcaacagcttataattgtgacgataaaatgaacgaccagatattctttctctaacgcaaagggacatttttttgaaggatttcaatgagaatatagaacctaaaccggatgaaaattctatgctgtcacgttaatatatcgtttacacatgcctccctatcatgccctatcttcactttagttcttttttaaaaaagatattcagaagacactctctacatttcttctctccctagtcttaatattttctttagaaaaaaaatacatgagagatgcacgcacaccctaaactataaatcgaactgtcgctaatccctgatctcataacgttatatataagaaatcgtttaatgatcagttgatcactactcgatcggttcttgcgctctccaactgaattgatttagcagattgaaaatggcgctctagctacatcttactgtgtgtgtcaccatctgatcgatcatgcccttttgcactatgtttttatttgctgaatagatgaatggttgagtgattttgtgattactattaaggtacaaatgaatgaactaagtaatacaaagttgaaaaatgaacacataatagttttttaaaaattcatatatatatatataagtgtttttaaaaaataacaccatttagaagcttagatagtgtgtcatattaatccaccatgtatctccttagttagtctccttacggagtaataataattagatatatggctgtacgttccacaacttctgccaaaattgaacggagcatgtacaggtcatgaaaactacgggggtgaactttaaatgtactttctccgtttcacaatgtaagttattctagcatttctcatattcatatttatgttaatgaatttagatagatatatatatttagattcattaacatcaatataaatgtgggaaatgctagacttacattgtgaaacggagggagtattataacgacttcggtctggtcaaatctttacaaactgtgccttggcggttcgctctggagtcacatataatgcctgctattggcgtgtgctgggatgctttgaagatagagtttgctgcttacgtacatagccccaaagtccaaacttagtgccagatatatcggcaggacgatgaactagttgcggaaacgacgtgacatacctaacaaaatttcggagttaggagcgatccaaccggatataccgcccaatcagcaccgatttctatagcacgattggccagttgcaacttgcaacgagccaacgacgtccactatcttgacctcatcccgtcgactccatgccaatatgccatggcactatggcagcatctatctagctaggtcagatgttcacccttgcagctgcagttgaggatgctgcggcccagttgagtgtttggcaaaaagtgaaaaagggcctggatattcggcctgctaaagaaaccgttctccgagcccatacgtgacaggccttacatgtgtgggccgtgcaacctgctgcttgctcggcccgaaccggccggagacatcctcaccgatgacgatgacgatgagcaatgagcagggaaagccagaggcaaacgtacgtggaggcaggaggagtggtcaccgcgtgcatgcgcgccacctccccggtctgccgactctggcggctgcgcccgcacgcacaaatgggagctcgtgggctccaggaaagaccgaacactgcactgcacaacacaagcgtcgtcttcaggccgtacgtgacaaacctcagcaggcgagtgtcatggcctccgaaggcgccgtgagcccggcgttcgcctacaccgtcgtctacgtcaaggacgtcgccaagtcggccgccttctactccgccgcgttcggctacaccgtccgccgcctcgaccaatcccacaagtaaaccatcctcggttaatattttttttccccgtcttaaatttttaactggctgcttgaaagtacttcctgatgcgtgtgacgtgtaatgaattataaggtgggcggagctggagagcgggacgacgacgatcgcgttcacgccgctgcaccagagggagacggacgcgctgacgggcgcggtgcagctgccggactcggccggcgagcgggggcccgtggagatctgcttcgactacgcggacgtcgacgcggcgtaccggcgggccgtggacagcggcgccgtgccggtgagcccgccggagcagaagagctggggccagaaggtcgggtacgtcagggacatcgacgggatcatcgtgcgcatgggcagccacgtccgcgcgtagcggccatgcgcctgctcggttgggggattttagccgtgtatgttcaataatgtgaactgttctccactgatctgttgatatatggaataaaactgtgatctcgttggttgtggtctgtactccaaagtccaaacgagaaaaaatggccatgtttgatgtatgatgtgttcaatcatgaatcacatgggtaaggataggaataagttcactttatccctcaatttgtcgtcagtatgattttcgttcctgaaccgtaaaattagatacaacttattttccaacttacaaaactcgttcctgaaccgtaaaattagatacaacttattttccaacttacaaaactaaaacgtattttctaacttacaaaactagtacggtttagatagcggttttggctgacatgacgtctacgtggctagtttaactagtttaactaggtcttcatcctatagcattgacatgacacttacatggcaattatatatcggaaaaataataaaagccatgggcccagatatcagctacacaacaaaataaatatggtgggtgggccccacatgtcatcctcttccctcttggctctccctcctcttcctcatcgcaccgcagcgccacctcacagccatcgccgccatcgttgtcgtcgtcatcccagtccccaccgtctctgatgacgacggcggccgaagcatgccggcggaacagcggcggcagaggtagccgaaggaggaggaagagaaggaggtcgccggcgagcgcggcaactgtggcgggttatctcctcaggccgccgctcgccgctagtagctcttgaacacgcgggaggacttcacaagcgcgtcccctccgcgctgcacatcgcgcacccatgcacgctagaggacttcacggggggtgtcctctccgcgaccgagagcgcaacacctgcctcgagctccacaaggcgtgtggccggcggcgacagagcagaggggcggcggcgagaagagggacggcagcagagagggcgtcggcctggatctgcacgaaagggaagggcgggtgggcggcgaggagaatgacggagcaggcgagcgaggcgggaggtggcggagcgaaccgacggtgggcggcaacctcggcaaggtggggaggaggcggaggggagcgcggagaggtcgacggtgacagccggcgggaagaaggcgagcgtgccggagattgagcagaggaactccgccagtgggtccgtcgtgaaagacgacgatgacgaggacatcggcagcttggagggccgcgtcggcggcgaggatgggcgccaccacggccaacctctcgcctgcggcgccggcgttgttgttgtcgtcctccgtcgccttgcccctcgtctgtgccgcggccgccgcctgctggagccgcgtggagcgccgccttgcccctcgcctgctccggccgacgccgctctgccggcctgctctagctgcggcctgccccgccctgtcccaccccgctcagccggtcagccgctccgccccagtcgtcgcctgctccggctcggagagagaggaattattttttgtgtagctgatatatggtcccacgatttttattattttttgggataaaattgccatgtaagcgatacgtggatgccacgtgggacgaagacatagtcaaaggagctacgtaggcgtctcatcggccaaaaccgcccttcataccaccgagggacctcgtttgcccggttttcgtaagttgggggatggatcgtattcggttttgtagttaagggacgaaaataggactgaccgacaaatagagagactaagggccagtttgttttgtgaccaatgtttttggtaaggccaacatgtgtttggattgaagccaaattaaactaatttggctattaaaatggcctatgttatataggcatgtcaaaaacatacacaattattgttaaggttgcaaaaaaatttgacaagcctaatttaggcctgccctaagtgacgatatgcatggtcccatggccatatgctaccgtgttccggcccatgaactacagctaagggcctacataggtgatgctgtcagcctgccacaggcacagcccaacggctaaccactgtcgagcctctgcacgaacaccggactggcccggcacgcatagcacctgcgcaaacagagggaattttttttccatttttcattttttattttttaatatttacagaaatattgtaccgacgaaaatatttacagaaatagaccctaccgccctctctgagagtggcagggtgacgcgagggacggacaagttgaaaaaaaaaactagaaaatatatttttggtagggcgaaaattgcatttactcccttgcagcctttgtagagggcggcaaaggacctaagtgcaaaatgcgcacaccttgcagccctccacttggacggcaggggccattgtgtaaatattttggatggtataatatttctataaatattaaaaaaattaaaattaaaaatgaaaaaaattcctcaaacaggctcgtacaaggctccttccatctaccatctctttctatacgttccaggtggcgaaacgtaagagaaaaaggaaaaaaaaaaaagcaaaagccgtctccaagaaggcacagacgctatacataactccagcgttttccacttggcgcgggaacccgctcgagcggtcgagccggacggaccaacctcccaaaggaaaccaaaagaagatctcacgtcgtcgcacccaacccaccaaccacccgccgcacgaaacctgcgagcgaaccgagagagatcaccatccccccgcaccgttctggagacgtcccgtgcgcgcgccacaacacccgaaccctccacaagccttaagcccggccccgagccgaaaccgcctccgcctattcgcgccacccacatcacgcccctactcgaacattcgtgaacgccgcgccgctctgctcctatataagcaaatcccctccctttgcctttctcccccaccaaagtcgagagatcgaagcgaaaaaaaacagagcaaaatcgtcccagcgcgagcgaatcagaagagcaacaacacaactcgatcgttcatcagcggagagcttgatttgatttgatcggaagagaagaaagatggcgggcaacaagggagagggccctgcgatcggcatcgacctcggcacgacctactcgtgcgtcggcgtgtggcagcatgacagggtggagatcatcgccaacgaccagggcaaccgcaccacgccgtcgtacgtggccttcaccgacaccgagaggctcatcggcgacgccgccaagaaccaggtcgccatgaaccccaccaacaccgtctttggtaagtgccccgctcctttgcttccgccttcaattatttgatttttggtgtcaaaattatggaattagtttctttttctaatcaaatcaaacttggtaaatttaattaaatttattaaaaaatagcaacatctaaaacacaaaattatcactacatctaacacctaacattaagacctctattctctaccgttacattacggcttgtttggtaactcgagggaaagagattgagagtttacacgagaaaattgatgatgagattaaaatgggaatttgatttttaatcctatatcttgtttggtagaggcgatggaaattgatagggagtttagttggagattagatcattaataaaaatggatggatgagatttgcttagacaaaataaaggggatctcttccaattacctgcccctacgcaggtattaaaaaggagggagttccttcctcaattccccatcccatcccaccaaaatttccatgtctctcaaccaaacaaaacacttaatagcctcatccttctgaactcccaatcccttctaaaaactccctccaaccaaacgtgccaatgagggcttcaggccctagttaaaaaaaataaaaatctaaatctaacatgcaatgtactaaatattaaaatatatttgttcacatctatttatattattaaagaaatagaaaaaggagcctccacgtccgctctcatggcctcgttcgttctcatggcctagaaattctcacattaattggagaaaaagaaaaagcagagtacatatagaaatacaatttagaaatagctgaaatttggaattaaaaaataaggaatattagaaaaggagactagagtccatatagaaatacaatttagaaatagttgaaattcagaattaaaaaataaagaatattagaagaggagactagagtccatatagaaatacaattaggaaataactgaaattcggaattaaaaataaggaatattagatgtagagtatagagtccatatagaaatacaattaagaaaaaatagaaattcggaattaaaaaataaggaatattagaagtagagtatagaatccatatagcaatttaaaactaactaaaattaagaataaacataataaaattaaaattagagttttgagtccgtataaaaatacaatttacaaataactgaaattcgaaattaagaaaaacatgggaagaagagtttaaagtcaatataggaatcaattttggaagtaattgaaatttgaaattaaaaattgaagaatattgagagatgagtttagagtccacctagagatacaattagaaataataaaaattcagagataaaaataaatatattggaagaagagcctagagcctatatagaaatacaatttacagaaaattcggaattaaaaaaagaaatattaaaagacgagtctagagtagatataggaatatatataatttacaaataactaaaatttgatattaaaaataattaataactaacacgtatataaaatacaatatgaatactacatatttgtagttttgtaaacttattgcaaaatttaaaattatgatgttattctaatatatttgaataatataatgagaaaacatatatgctattacatgagaaaatatactgatgctagccgcgcaatctgcgcgggccaccatgctagttcaaaatatagctgtgttttttctataaacctgatcatttttttaaaaaaataaaatatttgattaaaacaatcaaaacaacagataatatgaaactgggaagtattcatgagccgtaggagttacacttgcaacacatcttgctctgtttcctctgttttggcggcagatgatgaggatcactagcatgaacttgtaatttaaattcacttcgattgccgcaacctgattactgtaagatcatgtagttgcgcacacgggggaattgaaaaataactcaaaaatccagttagtacaattttatatgggtaacaaaattttatatgggtaacaaaaataactcacaaatccagttagtacaattttatatgagtaacaataatgttcaaatgtcgtaacacgctgtgtgtgtcttgcagatgcaaagcggctgatcgggcggcgcttctcggacccgtcggtgcaggcggacatgaagatgtggccgttcaaggtggtgcctggcccagccgacaagccgatgatcgtggtgacgtacaagggcgaggagaagaagttctcggcggaggagatctcgtccatggtgctcaccaagatgaaggagatcgccgaggccttcctcagcaccaccatcaagaacgccgtcatcaccgtcccggcctacttcaacgactcccaacgccaggccaccaaggacgccggcgtcatctccggactcaacgtcatgcgcatcatcaacgagcccaccgccgccgccatcgcctacggcctcgacaagaaggccgccagcaccggcgagaagaatgtcctcatcttcgacctcggcggcggcaccttcgacgtctccatcctcaccatcgaggagggcatcttcgaggtcaaggccaccgccggcgacacccacctgggaggcgaggacttcgacaaccggatggtgaaccacttcgtgcaggagttcaagaggaagcacaagaaggacatcaccggcaacccgagggcgctccggcgctgangactgcgtgcgagagggcgaaaaggacgctgtcctccaccgnccagaccaccatcgagatcgactcgctctacgagggcatcgacttatacgccaccataacccgcgcccgcttcgaggagctcaacatggacctcttccgc

SEQ ID NO: 24243 - DNA, 1423 bp, Oryza sativa
cgaagaaggagcgatgcattctgggacgtcatcatcatctttagagtttcatgcggtcaagccgaataatgtcacgtgagttgttactggttgtgacagttatatcttgttaaggttctatgatccgatgtaggttgagagagatatatatatatatattattactactacggagtgataggtttagcggagtaaataagtgtgaactgtcatatgtggttctcttagtgatctggggtgctctgctttgaactcgggagttcagaagtataatgttcttttatacttcgttgcagtgtctatgattactccgtacttttatgattactccgtactttaatggtgtgtttggctaatacgaaatggggggtgtgattaggattgaaaaatgaatgataggtaaggattaaatggaagatgatgaatggatggctaggatatttaaaatgtcttttaatgtgtaggaaattatttttctatcctgtttagttccaaaatatttcttcaatcttccaactttttcatcacatcaaatcttttctacacacataaactttcaacttttctgtcacatcgctctaatttcaaccaaactttcaattttgacatgaacacacagggcctaaaaagtagtatgtcagaaacacgcagtaaatgcatgatgcttttgccattatcgggatatggattttcatccctcgaagggatatcccgtcgttacacacgcaataaatgcatgatgcttttgctattatcgggatatggattttcatcccttgaagggatatcccgccgttgtgttaccaattttttttaaaaaaaattgacataatagattaatatgaaatatatcaccccacaaatacaagaccaaatttgatttctacaagttgtaaaaaaagaaaaaaataaattaaaaatagttaaaatatttttctaaagtgttgtacttcaaattaaactatcttaaaaaattctttataaatatttatatgacatgcacaaaaacgagaagatatagagggataaaatcgctttcccctattatggcttcgtacctaccgtaatcagatgaaggcagaacgtcaactggaacaaaaaaaaactagaatattagagaaggatctaatatcaaataattaggaggggtgaggctttgaacccaggtcgtctagcccactaccttgtggagctagccagaaaacctctgggcatttctcacgtcaaccggaaccagatgaaagcaaaacaccaggttctcggtctctcttctgcactcttctctctttttctggctagcgctggccttcaatccgatcagccatctcacccagtgggcagtggaatatggaaaatttttacaccgcgcccagagctcagagcaagaccttccagaggaataagaagaggagggaaggaggca

SEQ ID NO: 24244 - DNA, 5746 bp, Oryza sativa
gatcatgaacatttatgttattatatgtacatcattatctaaaaaaaatgttattatgtacatatgggtggcatgtgctttagtttttttttttactaaatcacgcgggaggggggagcttccccacctgaatttgtcattgcatttgggggagaaaacaatgttcattacattatattacatggaattgagagattgtagaggggaagagaaaattgctttccatacaggtattacatgtcgatcgtcaatcttgaaaggttttctgccgaaagggcagcctcagcagcacaccgttgtaggcaaaagcaactcggactcggacccgtcgtcgtgcgcgtggccgccaagcaccagctgcaccgccttggagtcggcgccctcccgctcccgcgcgcgtggcttccgcgaggcaaagcgccgaacaggtcgcgggcatggaggaggaggagcagcaactttgcagcgccatcccgccgacgacatggccgtcgagaagactagcgatgaactgatggctggtatttggaggtgaatccaattgaaatccatggactccatccattttagacccaaaacttatgacaaaaaccaatccaatccaatccacctccatcccacatccaagccgctccagtccattagctatctcaacccgtttacacccataccaagtgaatctaaattgaaaaccaatccattagatccattccaatccaactcattggcaggcttagctgcggcctttggtccttttcagctgttcttcgtcattgtatacgtgaaagactgtacatttgtaaagactcaaatagtatcgtgatacagctgcacggactgtacatttgtacaacactacagtcaacagtagactattgttggcacgccaacttgccaagtcatgttgttactaccttgtctctgaaaacaagtcccgatgattctacttgtaccagactgcccgcaccagtgcattctggttcgcttctgcatgcgtctcgtctcatctcctcatctctaatcttccatccaaaacttgaggtccttattaggccacaccttcactgacttattagaatggtttagctatgtgtaatgtgttggagggtcagggtggcgtctcgtttcggctgtcccttccatggttgcattatactagcatatcactacagaagcttcggcaccaaatatttagaattccatcatctaccacatctcacatgcaggctgttgttggagtcctctcctgcttttcgggtcaaaatggaaaatgcatcaagcgtacaaagacgtagcagcagcaggcagcagcaaaacaatgggcagaacatcatgcatcatatttacgtggaaaccattgacactgcaatatgattactcggtagctgaaagcctgaaaggcatttcacagaacaatttaatagggttaaagactgagggccccagataacaaaaaggcgagagtatattccatacaggttcttcagcaaagaaacactcgtcgttatatccaagtttgatagtactaataaatcggattaggccggttctcgtctttcccagtcttacttaaaaaaaaaatcttttccaaggacaatacatcagcaagccaaaaaattgggtagagtactaatatgacgacattgtatatagacgaaagtgaccgtaaccaatttctgctgcaaaaagatcctttttggttctaattggtactataatcgccccaaaaacaatctcatacggtacggtacagatccagcgaaagcaaaatgcagtccatgagaaaatgcaggcacgccgacatgtcaatggcagcaaagctgataaggcaccaagaacatttatggtgggctggtgaatgtccaaaccataccaaaccaaaccaagaatctttttgcaagtctaataaaaacttttctcttgctcctttctccggtcacgagttatagttgctcgcacacaaggataaccagataacacaagctggacccttaattgcttatccagttcagacagcaaccaaagaaacaccaactactcctattatttatagacactagtgatcctgggcctcctggaaatggccctgtgcaaaagcgagctagtataagcggcgcttccacgatctgaaaacccagcttatcacaagagagagtaggatgtgatcatcatcatcataagaccgaggtcagggccccgttccgtcggcgagagcgagacacccgcggcatcacgccaacttgcgctacgatacgcggagcggagagcgtcctttgggcgagcgaaaggccggcttatcgaaacggtgagacgcagatacgtgggcaacggccaacggggccaaggtgccgcttcgcaatcgctttcagatttcagatcctctactactactactactccccatctctctatctcttgcaggtcaacaaggatcgaattaacaagggttatccgcttgtaagcatcgtgtgatcgtgtttatatcggataggagtagatagcggtgatgaacatgaagatcctcgagtgggaacgtcatggaaagggagggcttaaaatgatgaaggcttggagccagaaatgacgatgcttgcaccgtgttttgatcccaattttttcttcaaaatctcaactttttccatcacatcatacttttttactcacataaactttcaacttttctatcatatcgttccaatttcaacaaaacttccaattttgacatttcaactaaaattttaattttgatgtgaactaaacacagtggtgcattatgctcgtgagatcaatcagctgagatggtatcacaagaggcaagagaaatccagggtggccagctgtatggtatagccaggagccagatgtgaagtattccaaacaattgtcactttcaggaaaagcattactacaaagccgatgggtcagctttcacccagacatttcgttagggtaaacaatttgcaatgtgcttgtctgaaacatggtacaccgataataatcaaacctatccaaacggcgtttcgacacataaatatcgtaaggaaggcgtgagattcagtcaaacgatctaatccatgcaaactgttacgcattcgagagaaatattcaggcagaaattttctgaggttgaaccgaacaaccatactgaatgatatcagatgaaaactgaagtactcgtaactgataggtgctgatcatttctataatgataacatatataggcacattggcaccatcaatcacttacacttgccttccagcgattaatggaaaacgttcacaagtgctaaaaagctcccactaattccaactaaacattggcaaatcctagaaagcactgataagtactccttttcctagtttccatcaaataaatgagatgaaatttccaagaatgctcacaagaacaagcttctcacctatctatggaatgcctatacagttcttcaggagtcaattttgtagaatcaaaccgctcgagacaataatgcacatacggaagcacatcgagcgggcaacaaactatgcatacacagaaattctaatgaaaacaaaagataatacataaggtattcccaaacaaatatactgaaacgaagatcgaattaatccagatatgttccttgtgatatgtagcatggtcctacaaatgtttcaaatgccaaataccagaatgcttcaatcaattacgattgtttccctttccctttccaattagcaaaaatgagagcaattttcttgtatgctatgtctctgaacgtctccttgcgagctgagggttagcagacagcaaaacatcagtcaacagaagttgacaataatcgatttctaccagctacaagggcatgcaccacacaccttgaacatgttaagactggcaccatgacgaggggggcctcatggacacatgaacttcatgttcttcaggaccaacacggtattttggaacaataatctctaggcctgttcctgattcatcacagtatgcttctaaagtagcatcttccgggatccgagtagggagtggaatttcccgaataaactctcctggtggacaatgctcaggtgtaggatcgactaacttgaaggtccggtcatgtctcttcaagaatggcatccggccaacactagtgcatgataccttaactatcccatttgtaagagtattcttccatgaaaccttcaccctttgtatatcagcaaacggtaggctaatgatgatcaagtaccccttgctatcttcatagattgtttttgctgcagtcactggaccagaagcatggcgcatcacaccagtgaagtcattcatccatgacggctcgaacgtgtggctcacttccatgtcctggaccttgtctgaatttgaattgctgcaatcttcttccatcgctgtgggggaggaatccttccggcgcttgttgcaaatatttgggatgtccagaccatccccagagctgtgattcgatggctgtgttgacaggttaaggccagaaccgttgagcaacttcttgtgatggccatgtgagctagtcttcgtggcagcagtagttgctggcctctcaagctcaaaatctgtgctaggaagatttctccatgactcataatcactcgcctcagcatcaatcgagaagttagcgtcccttccggtgagctctgtccacctcttcaaatcagcttcgggcacaccagccaagtttggtgcccggacgatctcgatcccgtgcaggcactgcgggttggacagcccccggtagtgcttgcgctgcatgcggtgtgagcgcacgaaccctttctccgcgctgaacgggaactgaggctccccaaggcgcgagtgcccgttcatgaagctccttagctgcatcttccccagggcattctctggccgctccttgaacacccacatgtacatgttctccatgtcgtgctgcactaggaaagcatccagcgtagcattattaccgttcccaccggcggtgggggccttcgccttgccgttcttgtcagccgacatgaccggcttgaagtagtgggtgaagaagaaccacgcgccccatatggtatcgttcctcttcacgcacttgcgggcagcgctggaattggagcccttggcatgtgatacggcgaccgtggtggtcgcggcggccggggcaggggacacgccggtggtggcagcaggtgagtccgagtcgtaaagctgcgggccgccgaggccgacatcaagcatgtcgacgttggggtcgtggagggcgccggactgcagagccggaggcggaggggaggggtcggcgtcgagggggaggttgatgtcagggggggcggcggccgcggcatggaggcagcggcggaacggccccggcggcggcgggaggaagaggtcgaagtcgtcgtgggaggcggtgtccatggagaggaacgtggaggggccctggtgcgggtggtgggccgtggtggtgtccatggagagcgcggtgagcagcgactcccccatgacggcgtcggccggcggcggaggcggagggggaggagcagccctcttcctgccctcgtcgcccgccggttgctcgtcgtccgtcgctgctgcgcttctcgccaactcgtcgccgcttccgcctccaccgcctcctcaccgcgcgctcctctcctccgaatctctccacgagcatcagcgactgggcttcacacctccctcgcgtccatcacacagccgtcgggttgatacgaaaaacgaaaatctctcctcctgcac

SEQ ID NO: 24245 - DNA, 9917 bp, Oryza sativa
gtgttaaaggcgaccacccacgggggggggcgcaggcgccctcccccagaagcgccctggacgagggggggtggggtggggggccgttacttgacggtgacgcccccctccccctgcgtcgtggtggtggtggtggtggattggcacggcccggatcgcccggccgcgcacgcggcggtagaggcagtgtgcacacgataaatctcgccgcgcggaggcggtggtagattgatggacggacggatctcctctcctcgggaggattctcgggaggattcgacctgtttggcagctccacagttcaaccacgtagtttcagtttcatctaaaatggaagcatgatcagatagagcgctctcataaataaattagagatgtggagctgggtttagacaactccacaaattcactcaagatctaactcttagggcgtgtttggataatgggttaggagaaatgggattgggaaatggaaatgaatggagggataggatgaaatggagtgagaagaatggatggctaggattgaaacttactctttgaggggtgggaaatcatatcccaaacccattatccaaacacttccttagagttaaattcaggagttttaagctctatcaaacaggtcctaaactctcgaggagatattccctcgttatttacatgctatcagaataattatgaaaaaaattaactagatatattaatatatgatagattactccgcaaacatataagttaaaataagttgtaaaaatacctaattaaattataactagttaatgtctattcacaatagttaaatttgtttttagttgcaacatgtagaagttaaatttaatcttgcatatttgtgaagtaatttataacatggttcatccgtttcatgttataagatattttgattttggtcaaaatcaagttgtttcaagttcaattaagtttatggacaaatatagtcatatttataatactaaattagtttcatcaaatcaatgattgaatatattttcataataaatttatctttggttgaaaatattactattttttttacaaacttaatcaaacttaaaagaagtttaactttgacaaagttaaaacgtctcataacattaaacggagggagtattaatctatcttattaagttttattaaaaaaaattataaccacttaaacaacgaaagcgtctcaccttcagagtttagaatagttatctgttctcctccctcccccggtcttgctctggccgcctccccctgcaactttcccctttttgttttgtttactcgctttgttttctctgtgtgccagcgagccatctctctgcttccgggtttctttgggagttggggataaaataagagggggtgattctcaactctgcatgggcagcagcaaagaagaattggttttgtgtgggggaattattatatcatcacaactgtcagtactagtaatacagtagagttttatcatataatactgctgttttggaaatgagagtacattaagtactcttacatgtaggccgtgtttagttttattttatttttttaagtatacaaacacatatttaaagtattaaatataaactaataacaaaacaaattatagatttcgcatgtaaactgcgagacaaatctattaagcctaatcaatctatcattagcaaatatttactgtagcaccatattatcagatcatgacgtaattaggctcaaaagattcatctcgcaatttacacgtaatttgtgcaattgattttttttatctatatttaatgctatgtgcatgtgttcaaatacttgatgtgatggaaaagttgaaagttttaagtgaactaaaacagccgtactcataataggagtaatagtagtacttaacccggggtatggtggttgtttgaccaaaaattcgtgactttcccatcacggctttgcaagtagcatgatgaaatgctactatcatattcagatttgcacgataacttatacaagtagtatagctggtttagcctctcgttcaggtttctgaggcctttaacaatatacaagtagtgccggaatatatcatatgcacacgatatttttcatgtatactatatgcataccaactatctaatatcacagaaacttttagaaaaaattaaacacatacttctaatagtattacacatacatatgtaattttatctttaaatccattatattttagctgtaaaaaaaacaaaattctgacagaattttacactttaaactgtcaattttttcgttttttattacggttaaaatataataaatttaaatatgagattttgcagatacgtgtaatactattaggagtaaatgtctatttttttttagattttttcgtgatttgctagttgatgtgtatgaagtgtgcataggaaactcgtatgtatacgatatattcccttacgccaccaaactaacggccccagcggcggattcaccctctggttagtatggataattgcccgggctctactgcatgatccatttaagtctactgatttcgttgtaaaagtccacccatttactaatttccaacaaagttaacatgctaaactcttaattagaagccttgaaacatccatgcttcactatgactaacgtgattgactttgagtaccaaaatcgtccatttttattataaatcattaggtttgaactgtgaaaattttgcatgcatgttaaactatgcttttactagaaaaactgttacgtgtttaatttggtatataaacgtttaataaatggataatggttttatacaatttatatggctgcgttcggagcatggtttgggaacccatccatacacgcaaaacaaagtgatcatgtaatttatgattaattaaatattagctaaaaaattttaaaacattgattaatataatttttaaagcaactctcgtatagaaaaattttataaaaacacaacttttattagtttaaaaagcgcacataaaaaaacaatggaggtgaggccatgtttagatcccaccgtaaaatttttcatcctatcacatcgaacgtttaaacacctgcataaagtattaaatataggctaaaaaaataaataattgcacagattgcgactaattcgcgagacgaatcttttaagcttaattgctccataataatgtggtgctatagtaaaatatttgctaatgacagattaattatgcttaataaattcgtctcacggtttacttacggattatgtaattagttatttttaagtgcccaaacaccccattggacaccatatataatacccgatatgacatgtcaaaactttacaccatggatataaacacccttgagttagaaaagttagggaaagaaatcagccttattaacttcttagggcccgtttagttcccaaaattttttttcccaaaaacatcacatcgaatctttgacacatgcatgaagcattaaatatagataaaaagaaaaactaattgcatagttatgggggaaatcgcgagacgaatcttttaagactaattagtccgtgattagtcataaatgctacagtaacccacatgtgctaatgacagcttaattagtctcaaaagattcgtctcgcggtttccaggcgagttctgaaattagttttttcattcgtatccgaaaaccccttccgacatccagtcaaacgttcgatgtgacacctaaaaatttcctttttcaccaactaaacacacccttattaacttgttcaggcttcacaaaatttctaacaccaccgcaccacgaccctactttgcatatcctgtaacggccacatgacgcgccctgccaacaccgcctgcacggaaaggaacatctcctccgccctgctgcactcaccccgtttttccgcccccaccccccccccccccccctgggccgtcacgtcgccccattcacgtgaatttatcctactaacgtgatacaccatgcgccctatcggtctcgcctcccccgttcctcactatcagccgcgctgatgccgcggtgttttccgcgtgatccagcgcccgcgggacgggaggctggccggtgacgcgaacgttgctggaaaaacccgcgcggtgcgccggtgtcgcggtcgcggccgaacgaacgaacgtgtggccgcgcgcgacgcagtgagagccagtcgtggcttctactcgcggtacacgaatacgaggagggatttctctcgcgtgtggcttggctggcagcgaggtgacagtcacacgggatgggaggagaaggagaggcgcgcgcgagcgatgggcctctgtttgtgtttatttacgcggagataaggtctcggtcctctcggatcgaacccaactcggggaggcgtatctgataggaggaggaggtgctaccttctcgcttcacgacagggacggataagagcaggtacaatagcatgctataagccaactataaacatattttaaggctacatatctgtagctagctgtagaacggactccaaaacgtaatgtgtgaatgatatatgggacaatgtattaatagtatagtaagcaactattatatgaattagctgttacattagctatagttgatttggagtcagtagtgggctacactattaaacttctctaataaacgcctcgtcaggcgtggctggaggtttaaaggcaggggagtaataaagtggatcaggttgctgacgccgcggaatataccgagaggacgctaagctctctctgtgtgtgggggtgattaggacgtgaggattgcccgtgatctttcgccgtaagctcggaacggctagttggccacgcatgtcagcatcgtatgattttatactgttttttttttctggttctattataaattggggatctgtggacttgtggatactccctgtctagacaagccggaacggtgttgcttctgccggatggatacgtcgatacatctacatggcgctcgtggtctcgtagaacataggggtgggttttatgatgatgattagtgacaggtcgttcgtttctgcagttgcacggctgagattgcaccaatcatggtttacttttccactaaccgaattccacggtgtcaattgtaccacactacccattaaataaaacaagaactgtaccacgctacattttcagctgttttgagtaggacttgtgagtttgagcgttgagactgctccgatcaacaggccaatgatatcgttttggcgacaaatcgccgtcatattataaattttctaacccaaaaggagcgcgatactgcaacgagcaagtttgacccggctaaaaaaaattaacgatcttgctatatttttgtcaataaatttaaattttgacagatgtaaatatagttcaatcacattataattatattataacttgtatgtaactgcaatataattttaaatcattcaatttgctttaaaatttgtgcgagggaggtaagaaaatacttaaacccacacacatgtgaggggattcgataccattataccttctttttggcaaaatagcatgttgtcatggttatggatatcacgtacctaatagtagttgactaaatctcggcaggacccaccacataccatgtcctatacggaaactgacttcagatatggaggaagttcaggataaggaaagacaaccagagttctacatggaaacgacaagaactactcggattgtatccatattggtttccttagttctacttggataaggggacacctatgggtataaatacaagcccccctaggaggagaggggggacacccaacatgagaccatggaagacacccatgacaatcaacacacacccaccagaagccacaacatacaagccaacatacgccaagacacgccgccggatatcgacttcaggataggcatggctattcccctacggatcctccggataccgtcaggagatacgaaagcgctatctctgatctcgccgggcacggatttgaggaggaagactaccctgttgtcgactacgagtcagaccttcagaccgccatgtcgacaacagttagataggctacccacatattgtactggtgtaattatggtgaataagagcaataccggtttcggccaacaggatgtagggttattaccttactactcaggggcccgaacctgtataaaaatccctgtctccatctcttttacctcagtctcgcgtatatcctagcaccaacgatcccatactgtccaaataccgtagtcgagacatcaaacgtcgacacatgtcacctaggatttttaaaaaaatacatacaaattatactatagttacatgcatcttacaatataattatatttcaattttactttatctgtttcacaatgtaagtcattctagcatttccaatattcatattaatgttaatgaatatagacataacatcaatatgaatgtggaaaatgttagaatgacttacattgtgaaacatagggagtactatatttacatttgctaaatctttttaagttaaaatttaacgataaatgtatagttagtcctaaaattaagcgagattagacggccagggtcactaaattagctcccattttctggcccaaaatagtctacacgaatcggccctggtaatgatgtggcccacggagcgagccggcccaccaccgcgcgcgagggagccggaggaccacgcgtcgcgcgcgccgcggcgccgcgcgcatcggcctcgacgacatcttcgcgggggaagcagcgagcgaccgatgcggcgatgcctctgcgctgcgcgcgcttgtcccgaccaccacctccatatataccggcgaggcgggaggcagggatcgaacgcccagcgagcggaggagaggagaggagatcagggggaggaagggtggccggcgcagcagatcggggcgggcggatttaggggaggagcgcgctagccgggagcggcggcgatggatgaggagtacgacgtgatcgtgctggggacggggctcaaggagtgcatcatcagcggcctcctctccgtcgatggcctcaaggtgaccgaatcccatctccaatctctcgaatgcaccctctgattgcaactcgacaatgcgttctactgctgctggtgcgtgcgtccgcattagtagatctcacggtgctgaaagtgagattttgtttcgtgctgctggaaaatttggatggttttacgcgtacgaatgtgaaatgtgtacctagactggatggcattgctgttgttcaggaacacaaatggcaagatcagagaaatattaggatttgctttctttctctttaaagaagaaaaactcgcacatatcttctacagattctcaacataaatctcgaccccagttaaaattataaaaaaaatggaatgatctcataagatcctactagtatattttagtggctgcccttttagacaaaaggaacaatgtacagttgtacactatcaagtcactgtttttgtctcgttcttgtgtatatacaggtccttcacatggacaggaacgattactatggaggagaatctacatcccttaatctcactaaggtgtgataacgtgatcatcttgccaacatttctttctctgtgcagtatataggaagaactgcaaagaccatgtaattttttcagcaaatctgatgttgtgttatctaatatttttctccgttcatatgatatgtatagctctggaagagattcaaaggcaacgagaccgctcctgaacatctgggtgtcagcaaggagtacaatgttgacatggttcccaaggtccgtcatcactggagcgttctctatcttccctgaatttttgcttacacgcaacttgctacaaattattcgtctgcagttcatgatggccaacggtgcactggtccgtgtactcatccacacgagtgtgacaaagtatctgaatttcaaggctgtcgacggcagcttcgtgtacaacaatggcaaggtgtggatctgatattcatatgttatgcaactgtcaaacattggtgcattttctgaattactgagtcacctttatttgtttggcgataccgacagatccacaaagttcctgcaactgatgtcgaggccttgaaatctaatctaatgggcctttttgaaaagcgccgtgctaggaaattcttcatatacgtgcaggattacgaagaggatgatccaaagtcacacgaaggcctggatctgcacaaggtcacgacgagagaagtcatctcgtaagttgactaagttgctgactgttaacaaacagaaaacaagttgtattttgccaccatttcttatgcaggcgttatgatgtttgcttgtcagcaagtatggcctcgaggatgacacagtggactttattgggcatgcattggcacttcatcgagatgataactatctcgatgaacctgcaattgacactgtgaaaaggatgaaggtactatatgccccctaactcaagaaaacatttgagtctgcgtatattctgctcactgttgaaaacaacgatgctttgatcaattctctatgcaccacaactatatagtcaaaaaaaatccgagtgttatgcacttatgctgttgatttagttaatggttagttgttcttaacctcgtggccagatgaagtgattgggtgcccttatgataatgttcagtctattttatggaataaaaaatatatgattccacatggcagatgattgcaaatatatcatcagcttatattgccgtgcatgtggaaggtggaattaacatccgatcctcacatttgtatctgtttcaatagctttacgcagaatcactcgctcgttttcaaggaggatcaccttatatctaccctctgtatgggctagcagagctccctcaggtatgctcagttcaaataatctggattctccacacagcttcagcttcattccagctgaaactctgcatattgtaataggcctttgctcgtttgagtgctgtttatggtggcacatacatgctaaacaaagcagaatgcaaggtaaccgaagcattgctcagatgctactttggtactttccaactatccagatgaatgcttataattctacggtcgttggcaggttgagtttgatgaaaatgggaaagcatacggtgtcacttccgagggggagactgcaaaatgcaagaaggttgtctgtgacccttcatacttgcctgacaaggtatttataccatttagactcattttgagatattcaggttcaatttatggtagtatatctacttaaattcctgtcaacaaatgaacaggtgaagaaggttggaagggtggcgcgtgcaatatgcataatgaagcatccgattcctgacaccaaggattctcattccgtgcagatcatcctcccaaagaaacagctgaagcgcaaatcagacatgtaagcaatttactcgtccctcagttcttgctgcaacgacagccatcaaagtctattgctccatttctgagaacttatagcgttcagatattgcataattcacactattgcatatgtttcatgtttggtttcaggtacgtgttctgttgctcatatgctcacaacgttgcaccaaaaggcaagttcatcgcctttgttctacggaagcagaggctgacaagcctgagatcgagctgaaacctgggatcgatctgctcggacctgtagaggaaacattttttgacatctatgaccgatacgaacctactaataccgctgacgaggacaactgcttcgtgacaaatgtaagttcagcaaatcagcaatttctctactcggccacactgcagtattgttgatgagcaccttcggttcttacagagttacgatgcaactactcattttgagacaacggtgaaggatgtgcttgcattgtacagcaagatcactggg

SEQ ID NO: 24246 - DNA, 1205 bp, Oryza sativa
taagtgtaattcggggcagaattggtaaagagagtcgtgtaaaatatcgagttcgcacatcttgttgtctgattatgatttttcgcgaaaccatttgatcatatgacaagatgtgtatccaccttaacttaatgatttttaccaaaatcattaggggattcatcagagctgagtccccatattttatcccttcttctagcttctatttgctctcatcagaagtcagaagatacatttttgttcaagtttactacatgcgcaagaacaaataggaaaaactgttctatgttttgatgtcataaaaaccaatatcattacatgcgaatggcatcagacaactattttataccttgagaaattctccgtcaagctctctcaggaactcctgaacctgcacgaattatgcatttcaggtaagcttatcgaacattcagaacaacaagaagcacacacaccaaacatacaaatcaatgcaccatatgtctggtaatttcagacaaacaggaccgttctgttctgcgtgaacagttcattgactgcgtatttaccttgttggtttcgccttcctcgaatccgatgagcaacagcgcctgacgaacacaaccaattcagatggagatcagcacagaagcagcaaatagcaaggaagaggagccgcagctagcaactcaccggcggtccgtacatgggatcctcggcgttcagcggcacgaacttggagtcctcctcctcctccatgagttcgccggggacccctgcggcggacgtccatcagatcaacgcaaccaaaccaatcagctaaccgtggatgcatccgcaccttcgggaggcggcgacgatcggagcagccgccaccttctccccctcctccgctgcggcgccaagacgcaagcggaggcgcgcggagatcgagatcgagggagtaagatggtggcggaacggcggaggaggaggagtacgggggtggctgcggccatggccatcgtcgccggcgccggcggtgaggacgacgacgaggggagctatcctcctctgtgtggtctccgcttcgtcggcgttttcccgccaccaccacgcaatctcagccgtccgatcaccatcctgcgtctgagagtggaggaggcagagcctgcgagaaatcgcgcggttcgtgttgggcttcgcgccccgctcccaaatgggcccggcccgacccatcgcttctg

SEQ ID NO: 24247 - DNA, 4021 bp, Oryza sativa
aggccgcgcgcgtcgagctccccatccccggcgtcgccgtccccgccgccgccgtccgcgtcgcaccccgcccctccgtcccctcccctcgccgtatctcccgccggcgccggtaaggtcgggaagaagaaggccggggcgcgcctctggatgcggctcgaccggtggggcgtctccgaaaccctccatctcgacaagggctccatcatccgacgcgccggcctgccgccgcgggacctccggatcctcggccccgtcttctccgactcctccagcatcctcggtgagctcgaccacgcccccattagtatcgattgctgcttagggggtcgcttttgttgtgacaatacacaatgtttaattgtgcagctagagagaaggcgatggtgatcaacctagaattcatcagggcgatcgttacggccgatgagatccttctactggatcctctcacgatcgatgtgatcccttttgttgagcaattgacacatcatctccctctcaagaacctggtgtgtgggaatggtcaacctggtggtgatgaccatggggaaaagcatgatgactcgcatggagatcaggtgccccgccttaacgaggccaccggagcagagcacgagttgccatttgaattccaggtgctggagctcgcactcgagaccgtgtgctcatcattcgacgttaacgtgtctggtcttgaaaggcgcgccactccggtacttgaggaactgaccaagaatgtcagcacaaggaatctcgatcgtgtgcgaactctcaagagtgatcttacccgtttgcttgcccatgtgcagaaggtactattagagatagagtagtgcgtgcctttggtctggcaaagttcaaagttttcatccctgtttgactgtctttattattgcatattaatttgactgatcaaaagctatattcatagtatgttctagctgttcttttctgtggttaaagtttaattgcactaaggggcatggatgatccaaacaggccctaagacaataatatttcttctttggagctatgtggatataactgaacttaaaagcagtaccgaatatttgttcaaaagaatagtgtgcctgacatagccagtataattttaccatctcaaacttataatagttatggttcaccgtggaccaatcaccaactgaagtctgctgtgccgtggtcctgtgtgcacgggggaacaattgtttcatgtacatagagatgttgtagtgcatgtgttgaaagagccaaagtcttcaggtgtatatactttggattatcaaaatacatgtttatataattttagttcttactgtatggttggaacttggggcatataaaacaaaaggtggttataaacaactgattttttttttgttcgtgatgttctatgtacctacctattcatttctttttaaagcttgttgattttattttatatgcagtattgctgctgggtagtttggctgtacttttgagaaccttgatggttacatgcatgctgctctaaacaagggtttcttctgaagatatgtatcttaaccctcatatcatttcaggtcagagatgaaatagaacatcttctggatgataatgaagacatggcacatctgtatctaacaaggaagcaattacaaaaccagcaagttgaggctttaatatcatcggctgcttccaatagcattgttcctggaggaacaagtctgtccaggttgaacaatagttttcggcgcagcgtgagcatcgctacaagcatgcatttggataatgacgtggaagacctagaaatgttgcttgaggcttacttcatgcaattggatggaattcgcaacagaattttgtcggttagtccttttacccatattgaaatggggtagttgcagttttacttggatctacttaatgctatatgacttatcctagtgttcatttggacttattctctgctgacttatcataatgaatataactgtaagttcttgttggagataaattgtaaagatacacagccacgtcttgttcctaaacatatatttgagttagtattcaagttagcatagatgttgaattctttaactactagaagttgctaaacatatatttgagttagtattcaagtttgcaatagatgttgaattctttaactactactagactagaagtagaagttgctaaacatagatttgagttagcaatagatgttgaattctttaactactagaagcacatctctcttttctgatgaagaaacaaggaaagtatatcacttttctgtataattctttggcgcccttatgctatatcttggcgtgacataatttctcgtttgggaattaaacaggttcgagagtatattgatgatacagaagactatgtcaatattcaacttgacaaccagcgtaatgaacttattcagcttcagcttacactgactattgcatccttcggcatagctgtcaacaccttcatagctggggcttttgcgatgaacatccagagcaaattgtacagcattgatgatggtagcttcttttggccatttgttgggggcacctcatcgggctgcttcatgatctgcatcgtcttattatggtatgcccggtggaagaagttgctcggtccttgaacacaatgtaacaagtcacgactcatgagaactgtctcgctgtaaagggcatgcattttgacttgtaacgtctgcagaaaggagcagtcatttgaaacataaaagagaatcctaggattagggagaaactctaatgcatttatgtttcactggtaaataagatacattttctgtagttttcccttggtaaaaatatagtatactaacatgttatgatcatcagcacccttgaattgattgtggatttgtgggttataggggatccaatcatcctgaggcagcagtatgtcttctttgcagagagatagctgatgaatcactgaactttatggacaatactgaatagtatatcggtatgtcattaactcattatattccagttaaaccatatttagacaaatattggttatggccaattgaagctttcttccatggccctgtgtacatgaaggattgacggggttgtttggttctacaccattcttaacattaccaaataattggcattgctcaaatttgtcccttatttggcttggttaagtttggcactagcccagccctaaattttttgccttgccaaatcttgccaaataaaatggcaaggctaggaatggtagagaaccaaacaaacctgaaataacccagcgaaatttgttgagggaacccagacatttgtggagagtgacgtgcatttttgcttgagacgtctgtactctgtagaacgggagcatgcattttcacgtttgaagggtaaaagaaaaccgtagagactatagtgagagactctgatgttctacgtttcacgagcagtaaacaacacaaatccattatataatataaactcattttatcctgctccaatgcaatcctgtcaattcatgacacggtttttgcattagttctaaattcattcctgtgacacgattacgaaaatgacacgccaaaagaaacacatacttctgagaaacgatcaaaccaacaaacataaacaaatctctcaaaccccctgaagaaatattccaccaagacatcctaaattatttattttcccggtaatctgatcatgctagttggttattcagatttcatagtttcgctaccgagcgttggtacgcacgctgagcagcgcaggaaccagttaaccacgtgccgcaccaaactagcaacagatgcatcaactgaaaaggtgaacacaaaatgcatgcaatcacaacggcttcaccgtttcatgctgcccccaattttggttgacatctgtcataatcatgtaaacagcatgatgctgacaaaggctgagttcaacagatttttgcaatcatcatcttcacaggccacttttgattcatcattgaattcatggtggctggaaactattatcatgaaagcaac

SEQ ID NO: 24248 - DNA, 8098 bp, Oryza sativa
ttttttttcttttttggtcttcttgcattcttaaattcggtgctgtttttaaaaagagcttcttagctatgtaggaactgagaatggagcaagggaatttgcagggagagtaacaccaccccctcgaagagaaactgaaggtcggctccagttagcagtggttatggcattcgaatcaaagaacaccacaacaactgttatatcatcatggaagtgccgccttaccccacgatcaattttcttcagatctgaatacctcatctccctcttttttgctgcctgctgcattgcagcctttactagtcttctagcaatcccctgatacgcaggaagttatagtagcattagtaagataagcaattaattgttatctgtaagatgaataaaagcacaaaaaaatagagaacaagatttcatttgatgaggctgggttgcactacatgatctggaactaataagtttagaaaaccatttaagatggatccgtagtgagcatcttgaggtggacagatatagtgtgtgaagttgcaaggaatatgaacaaattagcaacgtaacagctcatcagtattgatcttcatgtatagtgcatatattaataggatccatatcatatcaacaattgaagaatttcagtgcaaacaatttaactatttaagtgacacatgtattttcatgaatcgaattcattcaaggattaagaatcaaataaagtgataggaaaaggattatacagcgtaaagaaagaacctgctagattatcaggggcataggattggatggggaaaaattacagaattcggaccaaatacagtgcagttgtctcaaacaacattaacaaattgatcatacccctaatagcagatcccgtacaaatctgaattcctaaaacacctacagggctacaaccaataaacagctacaatcctaaaggctttctaaactcacaatgtaaaggtgccttcataatttcatatggtatcgtattaacatatacctaacaagttctttctgaatatttgttacatttaaaagaaacttagaacagcaagttctaaagatattcaacatgatcttctctactttctcagacaattgacatccaatcatctatttaccctaatgataataacaatcaaagcatgtaactattacaaaaacgtatcaagatttcttttattggacaagcaataatatgaacaagcacttcgccattgaaataattaatttacataagataagaacacatacattgcggggattatgttggacaagatcaactgcttcctgattactaatatgctcccatagtccatcagatgcaaaaatgatgaactgatcagttgtctgtaattggtgtacaacaatagctggttcagaactaagaagaggcctcctgaaagtttcttgaagccgaaatttgctatgcaaaggttctctgttgaactccggtttcttcagatacacatctccaatggatcttgttatctggaacacaccatcacaccacgtaagatgtgctgtgggaacgcagcagtctaaacaaaatatcacggcacctcttatacacactaattaccagaagcaatcagaataattgttccttcagggagattgcaattgaattcaagaactttacatcatattggtcttggtccataacagcagtgtcatgttattgcagttgcattagttttagagataaaaagatcgattcatggttattgaaacttgaaaagaagcataattatcgaatcacttatatttatttagctgtgataaatgagattttcctcttaccaaacaaagaaacaaaagacactaaattctgcagaagttgccatcacatagcatgttctaaagggtttgaaattaccagattaattgggaaaaagagaaacatgtacacttattttatgaaggcaggtccagattataacagtacagatggatggcgtacataatagagcattactccatccgtatcagagaagtacaattctaattttggacataaacctaagagtggcacagcaaacacaattatgctttcagttggctgactataatctagtcccgtgccaatcgcatgggaaagtctgcgagttattattagaacaagacgtcaagattctacaaaataattagatgagtcaaaatgaatagacaacaaatagcaaaataattaagatgtccagatatgtacctggataatacccttcacacgccaaacattgtgctttagaaccacaatatggggatcatcaggatgtgctgcctgcagctctcgcctgacctcttcaaaggatgcattgtgttctgctgacaactgcatagccagaacctccccagttcccttcacaagtctaccgagaacagcacgggaatcgccaaggtttgcaatatatagatttccagcacagatcacaccaaccagacagcaagagcctactgccgctaattgaggcctcatcgaccattgactactaactacagaaaagaatccctcctcagttgctcgaaacgccttccgaatcacatccgctgacatgcacttgtgctcagaagcaaatcctgaaaaaggaaggtaatcatgggcatgcacaactgatgattagcaagtaattaaagctatagagatgcacaggcagaaatgattattagcagttacttgtaaacaaataattatacaatcagatgtaactagaagatgccatgctttatattcataaaaaaattcttgcagtcagtttctaaactggcatgtgatgtgtttaattacattccagaaaatcatctatgggtcaaaattagggcaatcctggcccctggtctaatagtagatgcattcaaatacgcgcgcgctttttcgcggtaatatgcgcagaaccacatctcatgcaatgatgcaatgcagcttataacagatatctactcaactgaaaaccattttcgctcaacaactatcaatatcaaacacatctacacttgcagcacatcataaacaattggaccaatcacctattaatcagatagcatagcgagatcggcattggatcaaagggtgaagattttcagcagcagtagtcagtagaggcctcacccctcagatggttgaagagatggtcattgatgtagcgcgccgtctccgggcctccatgcccatcatagacgcccacaagagtgccctgcaggttgggatccgtggtgctcagtggcccggattccacctggctgtggtcctcgagcaggttgttggcctggaccacggccatcgagaactcgccggcgacgagctggccggcgtccttgtaccacagcagcccatcctgccgccccgccgcatccgatcctttgcgggggcgcccggccggcgacgacgccgggccccagcaagatctcaagtattccatcgcagcagatagcatccttcatctccgacacctccccatcgcccacttcctcacaaagcccattcctttaccttccctctcctcctctcgtttcttcgcgaaacctgcaattgcatccaaacaaacacgcatccaggatcaagaaccacaaaccatatgatcatcagagggagaaggatcaacgagacaaccctactctacttgcattttggaacataaggagaaagaagcgaaaaataactcgccttttttttctctctttctttctaggattagcttcgagattcctgcgcgatcgatctcgcagccgaaaggggtggccttagatctggaaggaaccaatcgatctcaagctcggaggaagcagcaaggattgggtttttggtggagaaacggtgggctcctcctctcctctccaggatccaaaagaagcaaccaggaaactgaaccaagacgactaaaaaaagatgcgctttttcgcttctccccccctgcctacctctcctgccaaatcttgcagacagcctcgatgaacagatagatcagggtatcttttttatctcctcctccactacacaaacaaactgcacaacacaatcaagagaggaggaagggaaaaaaaaaactgcaaaagaagcaaccaggaagagagagaggttcagggccagcaaggcaggggctcagagatgggctctacaagtcctaatttctgagagggatttgggagtggtggtggtgactgtttttgtgcccttttgttccattttaaatctctttttttcttcttcttttcttgctctctacacctttcttacctagaaagaaaagaaaaagggacatttatgtatgtagctctactatactagtactactctttttttcctttcctctctatctcttttcttttcctcctccttgtcaatatgcatgacgtgctgttttgtatctttgctggtctcacatggtttgacctgttttgtttcttcatcgctactcttcagatttcagatgtacttgaaaaaaaatatatctttcatgtacaaatatcagtgaaaattaactgcaaaaatgcaggactattcgtataagtatttgatctgaaacttaatagagtattgtaccagctacagtgcatttaattggagatttgtcaagtactctgaaatctcacataatacatagaaatcattcaatgtaatttcatgccatctttatgacatgttcaaaacatattaatcgtattattgtcgtataatatctatttttattattacaataaattaaatgttttaacaaataaacctaacaaatagtttagaattagtgggctaagcactgtattagaagaaattttgaaaaaaaaaacatactttgtatagatgtggagtaaataagccaaccatccgataaaatagctgaaaataactattgtataataacttagggtgtgtccgtatatgctggtttccaacccgaaaataacattgaaaacggagcaatcccattaacacgtgattaattaagtatttgctattttttaaaaaatggattaatatattttttaagcaactttcgtatagaaactttttataaaaaatacaccgtttaatagtttgaaaagcgtgcgcgcgaaaaacaagaaatatgggatgggaaaaaggggtgctgaacacgcccttagtgatgcgccttgcttaactgacagtggctaattaacttatttaaaccaccagccaagctccatgcacggatggatcgatcgaacatggcgtccaaattggcgcggcgacgttcggagaaatttcatgggatttggacgctagccgagccgaggagcaggaggagaagatttatcgattaaacaatggtgacccaacgcattcagcctgcctgccaattgtatgaggtgacgcggacgaaacgcaactcggcgcggcgcgcgacacacatggcgttgccgtggcggcgagcgcgatgccacggcgaacgcggcgcgcatgcgtgcgccacgccacgccacggcgatcggcgccgacgacgacttctctcgctcgtcgctacggaacaacggatatgatgacatgtactagtactatctgcattctgtgcttcagcctgaagactcccatttgggcctccggatggattcacattctcgtggtgttcgaatggcagggtttacattaccggttgagcactaaattttgagccccgtcggtattacggttttcgataaatttcgactaatttactatttaacctttgaaattctaatcgaaaactaattccgagctcgaaaaccgaccggctttcgtcggctctgttaaccctgtcgtatgatacatttatgctgagttgtaaactttgatttcaatgtacaaccttactgtgtttcagtccaaaacggttaaacggtgtgttttgtaaaaaaaattatatagtatattttaaaaaaacaaataaatatacttttacaaatttaatagttaatatttaattaattatatgctaatgagtcatcctattttacttatagttaacacgcttctccaataaagagtttcaaacggggtcttagagatttaatcaaagaggaaaaacgtaattttggttgtgtgtcatttcgtggacgggtcaagagatacgaggaatggaacggacggtggtgccattacgcgttttagtgactagtgagtatatcttggcatggggtttgggctgtgtttagatccaaattttaaatccaaactttagtactttttcatcacatcaacctgtcatacactcacaacttttcagtcacatcatcttcagttttaaccaaaatccaaactttgtcatcaactaaacacagccttggtaatttgtatttggtcggtggtacggataagttcatcatagcttggatgccggatatttgacatggagagataacagtgcgccgatatttaaaagtgatgtttaaaatagcacgaactgaacttttatttattttcaaactaaaagatatactaccttcttcttaaaatatatatcattgagcttttacgtaacatttaatcatttgtcttattaaagaattagtataaatatataaaaatattagttaaaagcatatttatttaataataataaaattaaatagaataaataacatatataattttttaaaaataaaatatatagtcaaacgttatgctgaaaataaacggcgacaggcaggtgagcatcgagcactgggccggcaggctgtggcctcgctggccgccactccggccgcggcagctggggccgtgggccctgctccaacgcatcttgagccgtccgatcaaaatcctgcgtctcctgtgcatgggcccaacggcgacaggttaatcaatggctagcttctcctgtgctctctgcgtcgcccggtccccggtcagaaaaatcatataattgtacagtaaacttgcatcactatcacgtgcggaactctattatttctgagaattcttcgtggattcgtgcatgtgtgagagcctcgcgaaatcccagatactatcttcatcctataaaaaacctaaatatagacacatctctatctagatttattgtattaaaatatgttatatctaatttttgatttttttttcaggacaaagggtgtgtttgatttggttgacataatttctatgaaaactagtaccagtactaacattttccccgtgaaaagatctgcgaatttgattttactgaaagtataaagcagctggtaccgtaaattcgcgagaagaatcgaaaattcggaaccgaagatttccatgacagagagaggctggatatatatgcagcgactaaagatctgcatagtaaaatctctagtttttttttcctttactacaaaatctgcatctgtcacgtacatatgctcggttacttttaagctttcaattaacagatggattaattaatttaaggatacttaactaacagcaaacaaaacgagaaggcaacagcaataattgagacgcgctttacaaaagctacacaaaccaaattccagttcctccgattaatcacaaattcgcaattcacacacacacacatcaagaacgtacgatcgaagatcaatcacgcactccatcgacgaaagccgttgcgaccttttaccagttcgatccattgcacatgatatgagcgatgcagattaattaactaaagttagctgcaaatcatcacacatatgcgatcgagaattaagagattaattgatcggtgtcaatcgcaattatgcaaagccgagggataatcgcctacatccatgcaaaaaggtgtactattgatcgatgatctgcgctgcaagtgggcagaggccatgcaaacgtaattaagctcgatctggatgtgacatctcgaaccttggcatgtgatccatccagcttgagcttgaagaaataactagctagctcggctcatttccttataattaattattcatggaattattaaaataaaatatttacttcatatgttaaaaaaataagttttttttataaaagttcttctactaggatcatttgttctaagctatgtgttaaatttatgtatcaaaataatacttaatttgttcttgtaataaatagataatccgtgtcaataattcgcttcatataatctaaaccaaaccattaagaatgctctca

SEQ ID NO: 24249 - DNA, 9218 bp, Oryza sativa
aagcggtcaaagtggccgggtgatttcttggagtgtaatttacggcaggaactacgaaggattaatactcactgacccggttggagtcaagcggcaaaattctacggtgacgatgctgatgatggcgtaaacgttatgtacatatgcatatgcaatgagcagttactgattaattaagtacagtactacagtgttgtattgttcgtgcatatgcatatatacgcaatgatcagttacatgttcataaactgaatgaatttaactgaagaattatacgcatgtttacttatcgggacgaccaatacatatttaacacaaaaccctctactaaaatcttacgaattttggatcattcgatcaagatcgaacaccccacaacccaccccacaacggcacagccttccccctttccttcttcagatcttcctcttagctcgcgaagcatgctgctgccctctacccttaatttatttatgagctccaacgatccctccattagtaggtgccaataccccaccctcctcctctatccctgacaatctctatcatcgaatccgtcattatcattcgctaccacctatctagttagccaatatttttccacctcataccccttttccatctcatcgacgtcgctctgcgccttctaacctcttcgctttgcccctaccccctatcctgcccattgctaacctccctctaaggcatgaaactcctctggcttccacctctcccaacccctctttcaccttaactctaacacccaaacctacatggatgttaggccaacaccatcacaccgaagtaactcgtcggagctaaaggagaagaaggttgggcaggatgcgatgatccaaaatccgtaagatttgggattctgtttttgtcgcatgtaggactttttttattgtttatatagatgtggattttataactatatatatagtgccatgagcagtataatactccttttaatttcttagagtcgtataacctgccagaaaaatgctctagtacgtgcacgtacggccggccgccctctctagttgacctggtaatttaattagtttgtatgctggatctaataatggctgagtcggattagcatcatcagctggatgctacgtgcaatctaaattatgaatgttgtgcttgccttgaccatcgatcgatggaatgggtatccgatggcatgcaaatgcacgcttgcaccctccattattcttcccaagggtgatcatcatgatatttgacctatcatgatagcatgttattaattagttttgtatgggtttaattagagagtccggctagctaggtagctgactcggatcaacatcagctcaaatgttctctcaaactctgctgctcgacgtgattctcggccatactgttcaaaaaagacttcaattttaatatatcttatattacctccatcctgaaaaaaatatttttatacgactcatttttatacatgtagatgtagataagagtgaaacgtaccaacgtaaagctaaaatgactaaaccttacatttttttttcttaaactccaatacatttattcccccattttctcaaacttcaatgaaattgtccttcattttctcaaattataatatttgttttaaagataaaagtatttgcaggataaataaagaggaaacaaaataaagcccgtgtagggcggagggagtagcaaattcagcgagcacaatcggcaatcatgctttgtttttttttcttcctttgtttttattgcgatacgatgcatcagaagttaaaattaaacagaggcacgcgtccgatgactcgatgagtacgatgaggccacctgctgtgacgtactccttcgtttcaaaataaatcgatctcttaccgcatataatataatgaatctgatatttagattcattgtattatgatgcattatatttcgtatgggattgatttattttgtaatggaggcagcagtatagacgatgttggtattaaagttaatgattaaattggtaataattttcaaacccataaaggtcttaggcaagggggaattatcttcaattctttttaatatagtggctgatatgcttgctttactgattaagattaagagggctaaagatgctagttctataaatggtgtaattcctcatttggtagatgatggtttatctatattgcagtatgcagataatactatcatttttctagagcataatttacagcaagcaaataatctaaaattgattttatccgtatttgaaaagctctctggtctgaaaattaattttcacaaaagtgaattgttttgcttcggtcaagcgaaggatcattacgatcaatattctaatatgagtaaaatgcaccagcgatccttaaacttgtcaggagatttcacttcggtccacgaacttgcaaagcgcatattaaggcccctaaacttggtttattgtatcatctcggtccaaagccgcgtttgaccgtggtcttgcctacatggcacgtgtcacgcccagaaatttaacccaaatttctagactattttgcgtattaaatccctgtccaggaccagccagggtacacaaaacgacaagtaatatacagttccaaacgtaaataaagcgtaaaatacttacgaaagaggcacttagtcctcacaccgaaacagaacgacagcagcggaaaaaggcgatcctagcggggcttcagctccactccacaggcaaaactcaactggggtctgagccttggtcctctaactccatcttcagctcagaagcactacacttctgaaaagggggaataaaagcaagactgagtacaaccaccgtactcagcaagccacactaacgatgcagatgtgcaaggggatacaaggatggtttgtgactatttgcataaaggcggttgtaaaacattttattgagcaaaacagtaaaactgttgagtaattaaagtaacattaaatctccattgatcaacgctacaccacgttgaacaggcccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacagccccacaacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatctggaagcgacagaggccgtcgcagggcccgccccgctccatcacgcccacccttgcctggatgcgtcgactagaggaaagctacactacaagcccagccgttgtccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccagatgtctcgagcacgcagctcattctgatactaaaaggtctaatacggtaattatcccatcaactgagctaatggtaattaagcatggctaagcatatagttctagctaggtcacataagtaacatgagctagtcgatttattacccaatgttgacaaaggacatatatcaagtaaatatggcacaagcgagcagataggtaaaaccctgaccccatgtaattagcaaaatatgcatatttatttgcaaacagtaaaacatttgcaaattgggatcaacatgctcaaggggaatgtgtgacttgccttgcttcttcaaacaatcttccgaactcttatcctgcgaccgtgatcttccgaaacgacggattctacacgcaggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaagttttgagccatttaaatgaatttctagaattattaacgaattattgtgcaattgttaattattttatcaaaggaaaaggctcctgctggcgtcatcaaagggcagcggcgccgacaggcgggccccacacgacagcgggcaagggagtggtccaccgtggactgggaccacggggtggtccatcgccggtccacgggaaccgacggcccagatcagcccgagctgatcgggctgccacggggtggcgcggctgagcacgagcacggctcaggccggcccggctgagcgacggctcacggcggcgcggcctcctgcggcgacggccgacgcacgcgggaaagcggcggtgcggcgcggcaaggggatccgggcggcctaggcgagcggggcggcgacaagccggccggccgacctaacggcggcggcgcacggcccggtggtcgccggcggcggccaccggcgcggcagcacgcacgggagacagaggagggaggcaaggagggagaggaggagctcaccaaggacgcgacgacgaggggcggggaaaggcggggaagctcggcgtcagcgctcctcgggacgaaggcggaacggcggcccggcggcgtagggtggaggtggcttgggatgcacggtggaagggtggttgcggcgattaaatggggaaacggagcagaggccggggtgcggcgaggcacggagaagccggcggtgcaaacggcgcggcgcggcagtggctagggcggcggctagaggtggctggagctcgccggggaccgatggagagagggagcacggtggagaggtggttcgcgtggtggaaggggaggaagaaacggcggccgagcgtgcccttgaggtggcaaagccagcggtggcggtggagcagtgcggcggcgaccctagcgacgggaaaccgcggccggagttcgccggagtgtggcggcgcgcgggggcggcgtggggagagcgagggagagagtgccgggcccgggaaacaaggggaaatggacgaggggagcacgggggcgctttttatgggctcgggaaggcgggatcgaggccggacgtggcggaatcggccgacgaagtggggcgccgacgtggggtggtggaggggttaactgtggacccccgtttttataacaggaatcattcgtgtaaacagtaccatttccctggatcaagtagtctggtacacacgagtttatagctgaaataccaaaagcacatacacgagagtctaatgctaattattacatcataagcccgcaggcattgtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaagcttcatctcccgcttctgattaattttatatttgcaaagggtgagtaccaaccgtactcagcaagtcaacacagcaacaatgcatatgaaaggggtatttcaaaggatggctatggctcttttgcgctaagccagttttgtaattcttttcacaaacctaagacctagcattgactgatcaaattttagtaccagtgtttgtatttaaacaacgacggttctgtccaccatccattgtgatcccaaggatagcttcccgccattgagtcgttatggttttctgaggacgcccaccttcccccttctcaggaagtggctccaacagcataaaaattcgtcatgcaacaacccatcccacataagttaagaatttagaaactagccaagtgtaatacatgtcccggtgctcaataaccgcgagcagggctattcgaatagatttggtttactcacactgcagtggatgtacactttacccgcactccgcgactgcccaacacatgagtctcgtctcaacacatgaggcgcgtcacggcaaagcttttcgataacctcgcattggcagtacccgctccatgaacttaaatcctcatgcactctaggcgtccatgtttctagcagtgagaggagttttggcgctcccgggaaagagaagtctcacacacatattaaattatggttcaagttaagttctctctcacacactcatggcagtcctaccaatggcgacaccgatgtagggcacggttctcggccctacctcaacggctgtcccatcgtagcgcacctgcctcactcaggggtgaaccatctatgcagggatactgcctccgctcggctatctaatccgctaggtctatacccattcgagaagtacggttgtacggggttgtttcatgcttaacttcatggctcggtccttaattgactggggacggtactagccttttccagataccacccaaatcatccgtccgccccagtcgaaaacagttgttttcgctttattttcctttcacaaatcatgttatcaatttcatggcaatgtggcgctcatgtctccacatgccgcatctcaattaccttcccaaaggtaattgcccaagcatttagcatttgataaatatgagtatgcatgatcctagaatagcatttctaagcaattgtcataattgactagggactcatacgtaaacatgattacgaaggaataagggataaacaataatcaaggcatggcataatcacaagtaggatgttcatcattgcatgcaattttatttataaacaaaataatttcgcaattgggatcaacatgttcaaggaatagtgatgacttgccttgctcaaggtcttgcgggtcttggccttcacccggatccgcggctccctcggtctctataattatgtgcgaaagaacaatttgaattcgattagaattcaaacaaaatccaaataaatccaaatgaaagtcgaatgcgaaagtcgattcctttattttaactttattattcgcgaactaaggcaaacccaatttcgattcaaactattttacgggtataaatgttttgttgtcataagtttttaatttaatctacctgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcatctatttgtttagttattaattacatctaaattactacagcgaattgatttcttatagaaattaccaagaataatccataatttatattaaattttgcaattctacgactatagttaatctataattaaattctaattattttaaattttctaaacttccctaatctccctctaatttcctatttatttccttttcctttttctccctttccttttttttctttcctttctttttcttttctttttctctttttctctcctttccttttcttttcttttcccctccctcccggcttctttctctcttcctcggcttctccctccctctctctcggctccctgctacctggggcggcgacggcgaccgagcaagggaaggaggcggcggcttaccgacggcggtggcggcgacggggcgagacgacgggcgagcggcgatgggacgggcgggcggctcggggcgcgaggcagcgcagcacggggcgcgtcgcggggcgacggggcggcgcgcgacgcggggcgcaaggccggctagggcggcgcggcagcgatggcgacggcaacaggcggcgatggcgacgtcggcgcggcggcaggcgacggcgcgacgggatggtgacggcgacggcgcggcagcggcggcgcggggctcggggcatggctgggcgcgtgacagagaagggtctagggctagggaccgaaatcgaacacctatgaggcaatgaacagtgacttttcctatttatcccgattttagtgtattttccatataaatttgattccacaattcctaattttacatatatgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttatttctatccacacctaatctttattttaatttgtatttattttaccaatttgtttttaaggtttattcctaattaactattctttactcacgattaataatcttcgagatcaaatccagataaaatagacgaataagatcggcatgatgcaattaatttaaaaagtttttgaaaatccgtatttttagagttttgattttgtcggtcgaattttcagggtgttacattaaccggcgccgattttcgcggggagagtgggggggaaaggtggaggaggtggaggggatcgatttcacgtgctcgtggggcggggtggagcgcgggagccgcagcgtcgtgggggcgaaaccggcggccatggcggcagttggggcgacgggaggttggggaagaagatgacaggtggggcctcgggtcccacctgtcggggagagagagagaggaaaacgggcgagggaagtaaagcagacttgaggaagagagagagccgagcgggccgagggaggaggccggctcgagagggagagaaaaggggcgcgcgggccacgggagagaaggaagacttgggccgaaaatagcccaaagagaggaagggggattttaattgtttttctttttatttagttggttaaaatgaacttggtgcttttaaaattatttcttgagctccgaaaattcacggaaaattctagagagtacattagggcacaaagaatattacagaatattctcggccaatgatttttaaaggaaattttaatttactccataattccacttgattaaattggtttaacttttatttaatttctagaaaatgcattattaaatgatttttaatcccgaacgaaaatcgggcgttacagcacg

SEQ ID NO: 24250 - DNA, 1301 bp, Oryza sativa
  unsure (1)..(1301): unsure at all n locations
ttcataaaagagaaaagagaaggaagaagggagaaaaataaaaaaaatccatgtcatcgtccacgtggcatgccacgtaaataagaccacggtcaaacgcggctttggaccgggatgatacaataaaccaagtttagatatctcaatgtgcgctttgcaagttcgtggacctaagtaaaatctgctgacaagtttaaggaccgctggtgcattttactcttctaatatctttggttgtaagttaggctttcttcctgtcaaatatcttggtattccaatacattttagaaagctaggtaacaaagactggaaggttattgaataaagaattgagaaaaaacttagtagttggaaaggtaagtatatgtctgtgggtggtagattggtgttgattaattctgtactttcaagtttagctatgtttatgatttccttttttagataccgaaagggatacttcaaataattgattattataaatctcgctttttttacaaggatatgatcataagaaaaggtacagacttactagatgggatatcatttgccggcccaaagatcagggtggtttaggggttcataatttggaaatacaaaataaatgtcttttgagcaaatggttgtttaagttaattaatgaacaaggggtttggcaagacttattgaggaggaaatatcttcataataagtctattactcaagttgataagaagcaaggtaactctcatttttggtcaggtctcatgaaagttaaggatactttcttaaacatgggttccatgattgtgaatagtggggaacaaactagattttgggaagataaatggttaggtaacttagcctttaaagataagtatccctctttatatgccattgtccgaaggaaatgttcttcaattactagtgttatgagatctgttccacttaatgtttcttttaggagaactttagttggtcagaatcttattttttggtatgagttgtgtgcttctattatacatatccagctaaatcattcttccgattgttttagatggaactttaataagaatggaaggttctcggttaggttaatgtatcttgctttaattaataatggttatattgagagaaataaaatgattgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24251 - DNA, 601 bp, Oryza sativa
tcaaaaatcaaaacaactcaaccaaaatattgcattagaatatgtaaaattatggaaagataagcctaattaacttacatctcttttattctcaaaacaggtaattcttggtgatatattatgtacggttcaacttacagcatatttgacagttgccaactgccagctccatacacaaaatagagtttaaactgttaacatttgacatctttatacataaaagtttgttcagttgtaagattctggatgcttttattgttgttgttatttcaacttcctaaactattatttctcagttcggctttgcaattttttatgatggtttacaattttacaagtgctggcctgctgggccttgtaagtgattgtctctcagttcataactttcaatctagacatatggcattatcaaaattttaagaacagaagttacctttactcctgggcaaaagctcattatagtataatatgagcacatcaatgaaaacaaactctgaaaggttcttaataagcagggccggagcttgggctcaggaacttgagcacaaagatcactatatgtaaatctggaaaggaaacgagaacagattagagagagaca

SEQ ID NO: 24252 - DNA, 5650 bp, Oryza sativa
cacttggaggaggacttagagccatggaagatcatcgaggacgtccaagtcaaggtggaggcccaaaccaagtcgacgtcgggtgcaattcggagtccaggaccagtctgcactaaaacgggtgcccaggtcgcatacatgctcggattggggcgttctttatatggatggaaagctaagaagatacctttccaatggttttggtcccacgtccaaattctttccgagtcaatgggaattgaccgaacaagttggcgtccagaatctgtcccagtgctgcgtcaccgtatttgggcctttggcccgtgtatcgtgttggaacccattagggttgcgtcgagaggggtttgcacgaccctaaactctatatatcagtacccgccaccatctttaggtttttgggttttgcttagattaatctgtcgagaacagtttcgcagctagatcggtttgtaagaccccaactcgtgagcttaatcattcatctgcaattttggttgttttctatctcgttcttgtttgtgttcttcgattggcaaacagggattagccttctcggcgaggtcatctgcgtttcgacacgggtgataaccagaggagacatggtgctgcgattgcggggctcaagagcgtgcgcgttcaagaagccggatcgatttgtgtcgctactccgcccaaatcgttgtttatcagaacctttcggaagatcgggaaccctagtgcacatcagtatgttatactagttctagagcacaacataaaacactattctggtgcagaatctggatcataattcaagaagggctacttacaaccttggaggagatactcaaaagaagcggtactatattaccaaatactaaaacaacacaaaatcaaatcatattagacaaggccactgcataatcctttgaatgtatgaatgaaaatttctttagcaaacagaatgttgtaaaaactactccaaatagctttaaacaaccaaagtaccaaaatagagtaaaactgttaatcaccaaatgacagaaatttcaccgcagataaaaatttctcactttcaattgaagaccagtggtaaactctatctggtgcgcatttccaaaacactagaaatttcttgtctagagatggtgcaatcaacatctcacacaaacagataccaaaacaagtgtaagttcaagaagaaattaatgattagtcgatagcacataaaaaggaacaagaaaaaacaaggaattgtaagaaaacggctagccatgtgaattatacaagaagatttcagaagccacaacaagcgttggtttgttttcataattattaagaagcctagagatcagtagttaatctgcaaggaaagcggtagttaatctgttatactagttccagctacacaacatggaatactactccaatatggaatcatgatcctcggcactttgatttgaaaagtggcatctgtaatctgtttactccttccgagaagctacacaacgagaagtatactagtactcctatacaacactaatactaaatactaaacacaaaatctattgacattgctttgcaagacagtaccgttgtacaatcctatccaaatcaaaacgcaaaaaagcttcctccacgaatatgagaaactaaataacgacttcaaacagcttaaaacaaccaaatcacaaaactacagaaaattcaccccaaatgtatgtttctacaactttcaagtaaagatcagaggcattttttgggtgggcgtcaaagtatcttgtttatctccaaaaccctagaaatccatgataccctatgaaactaagtacataagaatatcttatccctaactcaaaattaccgcttaacacatgattgaatggtccatatccttcagaaaactctaaaacacaagcacataattcacatgaaaatttgcaggctaaatccaataccgatgatttcaccgaactatagaatactcactttgccattcgctcaggaaacaccgtaaaatccacagatcctgaattgagagagagggcgaggggaggtagagcaccttccagagcgcgtcctaggcggtggaaaacccggaaccgaagaggaactcggatacctcggcgacgagcccctttctcgcatagcacgtgcctggaaacggcgtggtcgcggacgacgacgaaaccgcgcggccccactcgaggagagggaggagggagaacgcgccgccgaggaggtcaccgcacgccgtcgagctcgaccgacgcgatgtcacccccacaccttatgcggccgtccaccgacaggagaagcgccatgatccggtcgccgccgccgccgcctctggcactggcacaccgctcctcggtgggggaggcatgcaaggggcggaggcggccgtcgccgccgcagccgcgtggaggtggccatcgcggtggccgccgcgggctagggtttggttgatttgggattcgcccgatttgggggaagagacgaggcaagaagagattgagagaggaagcggaagggaagggattgcagtgcggagtgggacccacctgtaagcggcggaagcgcatggcacagggcgcgagttttgaatgctacggggggcaacgcggaatcccgttctagaagctaggaagcatatgggccgaaacctatctaaagggctaaagggaggtgttatttcggcccatagatatgttagttgaaagtttttgggattttggattgaatgaacttttttatagttcaatatgaatgtttgaggacgcaattgaaagtttcatatgatcttgagttaaaagttgtatgatttgattataaagttttgtagctttcaagttaaagtttcgaattttgaattgaaccttttgtaaattgtaattcaagatgaaagttttttaggctatggcgtgtatgatgtgagttgaaagttctgtgaaaatactactaaaagaaagaacaaaaaaaagtgtgcgctacgaggtgagtgtagctcaactgattaggtttcttgtgatggaaccagcctatcagagtatgcgaggtgtgcgtgtgtgcattcataggggtaagtgcgtgcgatttgtgggccctacgtttgtattgtgtttcaaaaaaagagtgcgcgctaaggtaacatgtgcattagtttgcaatctccgatatcatgaggccataatgaatagagtatataataaagtctttcttgtaggggtgtatttacattaagatggacaagagtaaaacaacagagaaaacatatgtatagagagaaaaaaaagaaaacaagctggagaagatcatgaaagtgccttctggaccatatataaaaaaaagattcaaaggatttagtattaaaccttagcactccactactcttctctatagaattctgagattccatacgtccactggagtattttagatatgccagcgacaacgacatgtcagttcatcatgatcacgcataaaagtagagtcagagtcaagagaaaaatgtcttaagttatcaattgttgaatgcctaatggaatctccacttcaagtaaccaagatcaagttaattagaccaagatgttaacataaactttgttttagtttacgatgtgcagagaccagaagttatcacttccatcgcgtcaaaaggaaattgaactggcctttcgaaaaataaatttgaacgtctcattcaggtgtgcgtgcggccgtgtaaagtccttgtccagcttgtgaacacatcatcgaaaaaaggaggaggaaaagaaccacgtcgcattcgaacgatggattttttacatcaaaatacaaaaacttgacatggaagctgatgtgtatgtcagtgtttctacctccttttttttcttctttttgttctttgttctaactagaaccaatgcagcaaagcttgtgtatatatccatcgccttcgcgtttttgatttgtaggtggggtggcaacgtttcattccattgcagaggtcagaggtggataaaggcacgccgctgttgacagtgctacctgggcccagtggcagtcgcacacccatggctctccattgcttgggcccacagagaacgcgagtgaaggctgatgccctagttttttggttgataaagtgatagccagggtttacaatcccgaccaaaaccagtcgaattctacgaattttcgatgtttcaacatggctcggtattaagtttcgattgtaatttcgaatgttaaatagtagatttgggttgtgtttagtttccttcaaacttccaaaaattctgtcacatcaaatgtttggacacatacatgtagcattaaatgtggacaaaaaaccaattgcacaatttacatgtaaattgcgagatgaatcttttgagcctaattacgccatgatttgacaatgtggtgctatagtaaacatttgctaatgacgaattaattaggcttaatagattcgtcttgcagtttacgggcggaatctgtaatttgttttgttattagtctacatttaatacttcaaatgtgtgtccgtatacttcaaaatttttacacctaaacaactaaacacggcattggtcaaaattcagtcgaaatttatcgaaaaccgtgataccgatggagctcgaaatttagtggtcaaccgataatgtaaaccctggtgatagctatgccaagatttacaagcaagctaataaatagcgttagcggccttttgtaggatcgagatgtcaactagagggggggggggtgaataggcgatttaaaactaaatgacacctaatcaaaactaacctaagttgctaggcttggtgagggtcaactctaactaagcaactaagttatgttttgcaaacctagggtgatagtggctcaattatatctctaggaaagtaaatcacactcctatgtcaatgtttagcaatcctagggtgatatgatctcaagtttgtctctagaaatgtaaattgcacaaatataaatgcgacaatcaaatgagactaggagacaagagatttttcaccgaggttcggaaactcgccggtttcctacttcctgttgaggcgagcccaactccaccactcaaccacgaagctaccgcacgcccccttcgtcaaggggtgggcaaggcgggagccggcccacggagaggactacccaagcctcgatcactagggtagttcttccttcactccgaaggtggtgaactccaaaccactcacaaaccggcgccgggcctcctccacaatcttctcagagaggtcaccgggcaactcctccacaagccgtctagaaggcggcaacttccaagagtaataagcaatgacccggcatggagatgatcaatcaagtgccacactagctctacaatggaagcaatgcacttgactcttggctagatcaaacctctaacacactagatggatgaacacaaagctcaagtgggtgtgagagaggtgcaaggggtgtatgcaattgaattgggtgccaagagagcccctttgctgctggagggggagtatttatactcccaccaaccaaaactagccgttgggggcgaaatcctccaactttgtgttctgccggtctgaccgggggtatgcggccggccagaccgtgctactctacaacggctagcgctgtcagagggccccatcgggctggc

SEQ ID NO: 24253 - DNA, 4218 bp, Oryza sativa
ctttgtatcggccactccgagcagcaccatcccggcctccagggggccggtctgaccgcgcatgtgccgccggtcagatcggccttatgcgccggtcagaccgccgttgtggcgccggtcagaccgccacaatgtggccggtctgaccgcccttggtcaggccgagcccagtgaaagggcaaatgattgtgtgtgtgtgatgaaaaagatagcaaagtgaaaatgcaatgacctaatgtggcaatttaatcatctctttgctaggtcattaccccccttgatagtacggcgaaactaacaaataaactagcaaatttgatcgccctacacctcgatcaattctaaattaaagcactagttttaccgtcttctttctctttgctttgcgccgtcaattttaatccattgataatcatccatgcgcacatatgacttggtcctaacttaaaatatatagctcaaagacaatagttaatccacaattagtgcttgtcattaattaccaaaattaacaatgggggcctagatgcttcacctttgccgctaccgctacaagagagcagatcgaagatagcgtgttcgaacttagaggctgttacaacgtttcaccactgcaatagcatctcgctatagcgcttcagtataaattataaatttttagttaaacttgatgtacaatgtaaatttatagttatttgaaaaaaatccgctattggaatttagtgcccgctatccgcaatccgctaactagacactaattcgctactaaccggctatatgctagtatttatcacaagatatttcaattttatttcaaatcagtacaagttaatattcaacacgtgaactggcatcacaattcgtaatacaaagtcaattattagatcctggatagtagacgtatagtcgaaaaccaagcagcaaagctacaaacgagttggatttgtcgacaaactcatgcacaccgacattggttaaaaagatttggaaatttggaaaataaattacacatgtaattattttagtattttcttgtctaccctacaacagtatcctacgttgaatttcataccaattgacttatggccagctggtaacgtaaacttcttcatgcaagtcatgtcactacctccaatagtatctacaatgccttgataagttgcaaaacttgccgtttgatcttccgttaacaagttagaaagtcaaatttgatgattcgtgtctctttgctactactacatgccatcccctgacaataacacgtaggatcctcgagtgaacgacatcaaaatcagaatgacagatcatcaaatctccgtagtgagtgacaaatcatcaaattgagacgattttcacgttaagacgaaaactagaccaagatcattattgagcgatataatatggaacttttccgaatatgaaacaatatttttacgagaaatagtctcttcagtagttttgtcgttgtaatcaagccgtgaatatatattccgcattcattcgtcctgtaacttttgtgataactgggtataacttctttgaaacaaaagtcggaataagtttcattatctaagaaaaatatatcgctataacttctttaaaatagaggccaagataagtttcattatctaaaaagaaattattagaattttgcttcaattcaaatttgcatggttagcaaatgccacaagcaaaacgaggctatcaactgcgcaaatgccacctatacccaagataaaaactctcctccgcctcctcgcattcccaaagcccaaacgcccgcaggaagctgcacccagagcgcgtcggcgtcgcgcacacagggcggccagagcatggccacggcgccgcgcgcgaggcgcctggccgccgccgacgtgcagccggccacgccggcggtcggcccagcgtccggcgggcggccccagttcaacctctcgtcgggcgcggccaccgccgtggtattcgtctccatcgtcctctgcttcatcctgctctgcacctactgccgctgcgccaggcagcgcgccatcgccggcgcgcgcagccgcgtcatgcgcgagatccgggagcgcgtcccgggcgtcctcctcctccgccccgccgccgccgccgccgcgctgcccgtcctcccctactccgccgccgccgccgccgcgggcgccaagaaggggccgctcgtcgaggactgccccgtctgcctcgaggccttcgccggcgacgacggcgtcaaggtcgtccccgcgtgcggccacgtgttccacgccgcctgcatcgaccagtggctcgccgtgcggaactcctgccccgtctgccgctgcgccgtcgtctgctactacgccgaccgcgcgagggacacggcggtggtggtcgacgacgacgacgacgaccaggaggtcgtcctggagcgcgtggttgcgatgatcgaggcgatacgagaagaacagagggaagaggaggcggcggcgaggcgcgcgccggcgagcgatggcgggggaggcgaggggttgatgacgtcatgatgacgcacgcatccctgggttgtgcaggtgcagctaacttcactaggtgagttcggtttgtagctttggtgtggcacactgacattagagagatagaagggattaaaattaccccatgtttttgcagcatttttgtgctggtttgtgtaaattcgttttgaaatatatccaaatgctccttataatcaaaattctgcagcaagaacaacttggctctttgatcaagaaatggttgcgaggcatcttgttatttcatttctctaaaacacgccttgcacgttgttaattccagcatggtaggttaagaggcaaaattagagggaagcatcagaaaaagggatcaaatttaaaacttcgttgtaatcaagctgggggaatataatcaaccaccaactttagctggagaaattataagtccagctaagtattattcccaagtacatcatcattaggatttgtctatatatatgacacaaatatgcagttagagacagcaaacctgaaattgagaaagaagtctcctcctctggtggcaaaagggggcaagaatcattgccttcttccccacctgcccctccagattataatataatcaaattgtcaagttaattggatagagggtttggtggttgattggattactacatttccataacatcacaagtccagttataggatttgccaatttgtcatttgcaaaatattcaagatggtggacagtgacagctccaatggaagcaaacccaatttctgggctgccctctctccccctcgtggcagctggctctaggattggtggtcatcctccagggtatgtttacctgagcacctccgcagcggcttcgactccttggtactcctagtctcctggcagctgtggaaggaacggaactccaggattttcaactccgcgctcgctttgatcgcagtggttctggagtccatccgctcggagggccagctgtggtctttagccggcgttactttttttgggatttcttgggagtgtagcgtggctctgccccgtcccgctatttggagttgcgtttttaaccgtcgtagtagttcctagcttcaagttccccaccccctttaggcataagccagtctggctgattgctttgtgcaacaaaaactcttttcctgataatatattgacgtgcaattcttttgcgcgttcgcaaaaaaaaggaagcaaacccaatttgagccatcttatttcatctttcgtcacttacacgaccgattcatcttcagtttcatgtatttcctgtctccgtcaaaaatgatttgtgtattataaccaccatctgttaaacgtcaagcttttgcaagatcaatgctagaggctccactatttcattgcaaaatgtagcagtgggcaaagtatcaaggcttttatcatctgattattggcttatcagctgtagccaaaattcaaattttgaaacataattttagagtaagttttacccacaaattgtttcggttgcttaaatgagcctacctacagcctggaggctggagtttagcgtactaggcacgatgacacgacctaccaacaaaccaccgttccctaccttgctcgtcatgttgctgttcaatgttgatatgcaaaaggaggcaaaacatccatgtgcatttaaggtccatacaaccgttaaatgtcatcaaatgtatattgaaattgaggcag

SEQ ID NO: 24254 - DNA, 8713 bp, Oryza sativa
  unsure (1)..(8713): unsure at all n locations
aaagcagcttcccctccagagcaacagaaaaggctctagctgaaagccttttttctcctaaaatttgtgcaaaagctgaaaccattgtgcttgggtcatcagcattaaaaaggaagccatgggtgccatcagtgatctgaaaacaatgatatattgttaaacatagaagaatcattcaaacattggcaaaacaaataacagctcatggactggatgaagagacatacatattttgttataacagttagatttggcacaatgatgggaatttcagaggccatggaccgcaatagcaaaggagggaaaacaggttcttgtcttgaagaaccatagagaacaatatcagcaaacactaacagattcctaatatcatgagtcagggagaaatgctttacggaaccaagaggaaatcccatatgagaagcaagttcctgcagaagaaattaagatggtcagtgaagccaaatggtgagggaaaaacatttactaccaaccagagacagcacatatttatggaaataaaatagagcacatattcatgacctaacaccagtcatcaaacctccctagtctaacatgctacgatacctagcagttcaaatgctgttgaatagaaattgttgttttctgaagaaaaacataaggaatctcaggtatgttctccagatggcaaatcacagtgacacaagggcttccccaatggatcttgatagaaagtttgaaactagcgaataattattacctggaaagcagagttataggcgtcagtgtcatttccgcagaaaaaaatgaattgcacacccaaatttttagtttttgccatgtccataatgtgtggggctgatgcacgcaaaactgttgcaaaatcccatggtaattcatcaaagaacaggtagctcccaacaaccaaaacaacaacatcatcttctttgctcccatactgattccttgcactttcttgagtatgtgatgagctgtatctttttgttgccaagatatcaactggtgaaccagaaataaccaagaagttcccagtatcaagggccgaatgtaacaactgaaataagatatttaagagtcagagaagcaaatgtttcttcttgatttaattattccagaatctaaaactgacagtcacacgtacaggaaggtagctatctggaaacacgacataagtgcatgcattaaaatgagttctccaatcttcaatatgattaggaatggactggtgcagttcgggatttctaaggaactgcccaagagcatcttcatgaataagccagaccacaggtagaaattggaaaggttcctgcataagactgaacacgatatgaatgtgcagcactgcagaccgaacaaatgatgtgataaagggaaaagaaacacttgggatggaaaactaggaacaatataataacacctgtcctttccatacaaattggatcttttgtcataaccgaatttatactattttgggaaaacttagttctgaaacgttatagctgctcaacactcaacagtcaaatagaaatgatgccaaaagaaagttccagttttataaaacaaacagcaatacaagatagaatgggaagaagaatacaagaccctacatgactatacagaagtaggtctaactgttctctagatttaatatttcaacttctgataacaaaaaaatcaactgaacggaatcaacagtccataaatgccgcattaaactaaattagctgatattttgtagaaccggtgtatgacagttactagcatttgcaaatggtgggttaatacttaacattggataagatcatatggtactggtagttaaaggggcaataaaagagtgggctgttgtccttctatatcctcctatgctatttttactaaatagcaaggcatgaagtagcagagaacacaactacgtaagtatccaagcagttgaagataggtaggttaaaattaacactcacattgaaacgaccattttcccttccagagagcttagaagcacagcattgtatctgtaaaatcaaatagaagtcaaaatcttaaaccaaatcaagtaaaagcaaaagcaaaatatcctattgtaagtttccagcacttactttgaccaatcaatgtacttcaagctcggagggctgacaacatttacatgacaaatattttccaaaatatcgttagctttcccatccgcaaatgctaaaacctgttccatagcaactgaatgaattactggaacaagaagtgttattgacacaagcatttccttttgtatggtgcttaacatataggagttggagtacgataatgaccgccaaacagtcacatgttaaaaatggcaacacaatttctagtacgctattcaatgaccattttagcaaagcaactcacctcaacctcgtaacccagattcttaagactttttgccaaagtagcaaccatcagggactgtgcatttatgttcatggttcccacaaactgaaataatacagagccaaagtcaactctccagcatgtagtttcagtattaaaaattcataagcacaagattaaaacgtgcatctgtctaggtaagcatgtctgttccttccgtttaataatgtgaccagtacagataaataatagtatcgtgcacgcaattaaactattccacatttcatccataatccaaccccgagttccagtggatcatttacaaagctagcatttctcacttggaaacaaaatgtgcaaacaaatgcagtgaaaccactatgcagcgagtgatccattagggtttatataagcgagcactcacgagtgccagcctcacgggcgcaaggccgggccaccaccgccgctcggatctcgcggcctcgagccggctctcgccgtggaactcccgcagcgccacgctcgaggccgagaaccgcatgaccccacctcccccgccgccgccgggccgcggcagaccctcgaccccctcctccgccttgccgccgtcgccgatggggagcagctgccacacgacgagcagggacgccgtgaagagcgcgacgaggagcgcgaagaacaggtggctcggcctgcacgacagccccggccgccgccgcctccgcgacgcagctcctcctccgcccgcggacgacgaggccgcccacccgccaccgcccgcggcggcggcggtggggaggtggtaggcggcgtccgagtgggacccgcgccgccacattggagcccccccacctcgccccccgcgaacggccgcgtcagtgtgcgctcctccgcctccgcgcggccgcgctcgacatggacgggagacggccgatcgggggcgcggcgagggtcgcgtacgggaatccggcggtggcggcggcggcgcgaggtaggagaggaggcggggtagggatcaggagcaaccgccgccgcggcgccgggggggagggaaggaggcaacgaatctgcgtgcgggccgcgtgggtgggggagaggagtgaggcagctgaagctagaataccggagctgaagcgggagccgtatatatccgtatcgaatactaccgtactgtatacggtggggggaatataatactggttgtatttcatacagggcagagctttttttttcaaagaaaaatacagcagactggttagtggagagatgccgactgaaataatgtcaaacagtgttatacagtgatttgatgggttggttgtgcatgtcgatgtggttgaaacttaatctcctgaaaacatactacctccgtcctataaaaaaacgaatctagaaccggatataatatattctaatacgataaatcatacgtatatctaaattcgcaatactagaatgtgtcacatctgatactacgttgatttttatgggacgaatggagtattagatataaagtacaataaatctagatagaatgttagtcaagattcgttatactatgaaatgtcttatccagtattagattattgtattatgagcggagggtggatgaaaattttgtactagtacacaaaaatctataatttttaaccaatcagaggctttcgaagaaatctaaacattttgaatctaacactaatgtggctaaaagaacttttcctttgaactaaaaacgtacaagtgcaaaataatattagtatttgttttattttttggacaaatggaaggactgtatatgaacttatagtacaaaatgattggataatattgcgcatgatggtggcatgtgtaattgtttttttgcatacgtgatatgtgttatgctttgtattaccaggtacttcctccgtttcacaatgtaagtcattttagcattttccacattcatattaatgttaataaatctagatatattgtgaaacggagggagtacttctttggttagtactattttgtattgacatcttgcaaatgccataatcggtattgccatttacactcgagattcatagagctttaggttggaataaaacaaagtataatcagaaactcacaatccgacaatattagctcaaaagtactattgcatatcacagacacaccatcagtccatcgccgtttacaaaggccaaacaacacactaacaaccaacggaattatttctgcgcgttctcaaaaccattggatatcatataacggaaaaaacttaatttataggcctgctactgaaaagatcaaaagacggtcgatcagtaggtggcaccgtccttaacgtcacactgggacagggtgaagtagaaggggccggcggagtaggtgacccttccggggtagacatgggaggggcggcacggccgctcgccagtcttaccgccattgaagttggtgaagacggcgcaaccgtggtccccggaggaggcgaggcggacgaggcatgctgatgggtggaggtgggcgctgccgacagtgtatggcacctcaatattgaacatacccttgtcatccgtcttgtctgtcccgtggtacaccgtccttcccgtctccttgtctaggcaggtgatgcccaccatgctccctgcagcgcacatcatctataattatcatcgattgcctatggttgataagtcgcgaaaaaattaaacgaaacaataaggggtggagataggagtaagacaattagaaatatgttagctagtcctgcgtctaagtatccattgaaaactacacctcaaaacatataagataaaggtaaaattatgttgcgctagccgagttctagactcgagaaatttttgatttcatccttagaaagaaataagcacttcacaagtaaaacttttatatttaccagtgttttaaatagcggcttaagacatttagcggttagccttgtcaaacagctatagcgggctaaatagagctatagcggctaaattgtacgtgagagcaaatagctagaacccttcgcaaataactatagctgaagatagcggcagttatagcgggatatttaaaaccttgatatttatacttaaagagccaatgtttaaaaataaaactaaaataaaacccctcaaaatcaaatatttttctggcaacgtatgtaaagccaacagggaaacaatgggagtgcatggcatcagccggcgaggaaggagaaagcagcttgcggtggcgcgaagcgaacctggaatgggcttggcgttgtaggcgtaggcgttccagctcttggtgcagtcctggcacagcaccgagccggtcaccgtgaacttggccgcgccgtagttgtgccacgcatcggcgcgcgtcgccgccgccgccgccgccgcgacggccaccagcgcgagcaacgtcctcctccacgccatctcacgtacgcctgcctcggtctggatcgactggagggatgatgataagtgtggttagatgactgcttgtgagannnnnnnnnnnnnnnnnnnntgcaaatgcaggtgtgcttcttttatataaaatcgtggtgcacgacgtgaacccgacttgcgcaaatgtttttttttgttttgttttttgttttctgagttgttgacgacgatggccatgggcggaagacgtgcgcgccatgcgtctctctctagtctccccccctgtgtcggtaagctagctaggtagcctggtttgatggcacgacgagttacttggtccgtcgtggaggccacacacggccgcccaggccccagggtgacaagatgcccgtcaggagaaaatagagcttgaggctacaagatgctcatagacaaaatgaaatgacggagaaaagcagaaaacaaactctgtttctcatgcagtcaggtttattgatttgcattttgtgttttgctcatgtagctacaataagtcatctagcagtttcagggattccgcaaaacccatcagggaacaggtaatagtcatttgatcatgatgaattgaatagcatgtcggtgatggcatgttttccttcagcatgaaagcaccaactcaaacaatcgctacaagtttacaaccattttgtcattattcatagaacattaaggccccgtttggcacagctccagctcccaactccaacttacttagagctagagttgtgccaaacagtctagatcctccgtttttgggagcggagttgggagagctgctccataaaattgtactacgggggtggagctgggtttttgctgctccacagctccactccaccccaaaagacccactaccctttaattctttagtgtatttacataaaaatgccattgaactacccctactcacctcctctcctcccgttctaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcaccccttgtttcaaagagaggaggacgggttattcatatttaatttgatggtcagaggcgaattgaaagctaagcagtggtaattaagacccccggaggaaaatagggatgtctcctacgttacccattatatgtagaagtatcaacgtaatttcatagagtcattcgatctgaatgctacatgaagaacataagccagatgacggaacgcggagacctaggatgtagaagatcataacatgagcaattcggcagatttggattcctttcctatatatccaatcatgtggtacttcatcatacgattcatataagatccatctgtctagagatcttcatatacatatagaaagtcgtatgctttggaagaagcttgtacagtttgggaaggggttttttgagagaaaagaagaatctacttcaaccgatatgcccttaggcacggccatacataacatagaaatcacatgtggaaagggtgggcaattagctagagcagcaagtgctgtagcgaaactgattgcaaaataaggtaaatcggccactttaagattaccatctggggaggtccgtttggtatcccaaaactgcttagcaacagtcggacaagtgggtaatgttggggtgaaccaaaaaagtttgggtagagctgggtctaagtgttggctaggtaaacaccccgtagtaagaggggtagttatgaaccctgtggaccacccccatgggggcggtgaaggggaagcccccattggtagaaaaaaatccacaaccccttgggttatcctgcgcttggaagaagaactaggaaaaggaaaaaatatagtgatagttttattcttcgtcgccgtaagtaaatacgtaactaggaatatggaaaattgcatctttggaatttgcaataataggatgggcgaacgacgggaattgaacccgcgcatggtggattcacaatccactgccttgatccacttggctacatctgccccttatccagctaaaggattttctcttttttccattcatcattattctatttattctgacctccatacttcgatcgagatattggacatcgaatgccactctttaaaatggaaaaaaaggagtaatcagctgtgacaagaaaaaaaacgaatccttttgtagctcatcatttattggcaaaaatagaaaatgtcaatatgaaggaggagaaagaaacaatagtaacgtggtcccgggcatctagcattctatccacaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaagaaatacccaatatcttgcaagatattgggtatttctagcttttctttcttcaatatgttagcagaaaagccttatctattaagagatggaacttcaagagcagctaggtctagagggaagttgtgagcattacgttcgtgcattacttccataccaagattagcacggttgatgatatcagcccaagtattaattggctatcaactacatattggttgaaattgaatccgtttagattgaaagccatagtactaatacctaaagcaatgaaccaaatccctactacaggccaagcagccaagaagaagtgtaaagatcgagagttgttaaaactagcatattggaagattaatcggccaaaataaccatgagcggcc

SEQ ID NO: 24255 - DNA, 15919 bp, Oryza sativa
ataccatcaaagaaacttccttgaccaatagggtaaatcaagaaaacagcagtagcagctgcaacaggagctgaatatgcaacagcaatccaaggacgcatacccagacggaaactcagttcccactcacgacccatataacaagctacaccaagtaagaagtgtagaacaattagctcataaggaccgccattgtataaccactcatcaacagatgcagcttcccaaattgggtaaaagtgcaatccaatcgccgtagaagtaggaataatggcaccagagataatattgtttccgtaaagtaaagaaccagaaacaggctcacgaataccatcaatatctactggaggggcagcgatgaaggcgataataaatacagaagttgcggtcaataaggtagggatcatcaaaacaccgaaccatccgatgtaaagacggttttcggtgctagttatccagttgcagaagcgaccccacaggcttgtactttcgcgttctctctcctcccccatctttctcccgagtcccaatagttgtggcgggcggtggtgggcggcatcggcggcggcaggcggcgtcggccatagcggcggaggaggaagagggatcgggggcaatggcgtcggttgctgcggtggagggcgcggcggcggcgctccggtcagtgctatcccgcggcggcggcagcaggcacacgacggtagtagggcgacgggacgacacgcgggcggttggcagcgagctagcgggcagcggccgtcgggcagtgggcggcgcgcgctgtgacgatgcgcgggaggcgtccggccggcggcgggcggggcacgcggcgacgacacgcgggaggcggccggccggcgacgggcggcgcgcgcggtgatgacgcgccaccggcggcgggaggcgccctgggattgggctgccgcgggtaggtttcctttttttttcaactttttttgcatttttttttgcaatttttttcagatctagagctgaaaactagccaaacacttctcaacgagtctcggagctagctcccactggagtaggagtttggagccctaccaaacgggtcctaaacagccagtatgttaaaaattgagataaccgccaacatcaggtatcaaagggaacctctctgatcttggttaaacttcaaaattgggcaaaaaaaaatgaaaacaattgatgcattcctctcaacaaggcacaaacttgtctacacagatatcgcatccaaaacaaacctgaggtaagattgagaaacagaaagggcaccacatgattaataattaagataatacataatctcagcaacaaattaatgacatcgcatcctctttggtttaatatccatactaaactcatttatatagctaaactactatcatgcaatagcttttctttcaaagacagaggccacgggccaccggaaaaatcggaaaagttcagataacacatgaccgaatctccgacagcacattctttgtaacatcattactcccagaaattcactttgcacagcaatgttatcgacattgaaacccctgataccaaccaaaagggtgaaactcccactgtctccttttatttagtgcttctgataaatgcgcacataactatgcaaccatgtttcgagtgaaatcgaccaatatgccatttaataataactctagcaagtaaaatctaccataactatgcacagactttccagccagcaacttgtaccagtactttgagatttgagtaaaatctatgcatactattccaagaacaaaagacatactttaagaactatcactccatattcagcatttgcaaaactagcatgcagaattacacggtcaggcaccaaaaatagagacatgttggaatctgatttgcagatctaaaggttctgtaagataatctaagatacaaataaagatcagacacaaaacatatgtactttaaagacccatcaacattacattcgcatagaacgaatatcccaacttagacgcaaacatcaaatcatgacattcattaagaacatgtccaattaacaagttaacatcaataaaatagaacagcaagctgattcccggtactattggataaaaaagaatgtgtaattgagctgattcccgatactattggataaaaagaatgcgcaattgtgttaaaccatgtcctgtcattatgaccctaacaaagtttcccttacccctggctcaaaattacaactaagattacaacagcctcaattgaatcactatgcggaatgttacaagttacaacaagaagcaagctcataactaaattcaattagctaaacatctgcaggagctgacaccctatttggcagatatgtgataccactagatgacgagatcatagctgatataaaaattcaagtgttaataagggaaaatacaggcaagctcacattgaagagatgatggtggattagctggaatatctgacacaaattgctcaaaatttatagcattagaacaatccacattactcagtggaaggagtataccaaatactattgcttaaaaagaataagtataatcgtgttcaaccgtcactcagtcgttattccctagcaaaatttcgtttgccccctggctcatggtactactagaattacaacagatccaattgaatcactcatctgaaatcccaaaaatccatttgggcaatcaaatctatctgtgcctcagcgaatacgcacttaagatctagatcttaaaagcagaatgcaaacaaaaccttatgagctcgacttggctccatccaaagcaaccgcggccgtcgccgactcttgagaggcagcggcggcggcggcggcctcctcctcgagcttcttcttgttgcgctcgagcgcctcgccgacctccttgggcatgtacttctcgtcgtgcttggcgagcacctcggtggcgctgaagaagcactcgcagtcccgggccttgtccgagaccttcctccccgcggtgtctcggcggaggtcgtcggtgaacggcttgaggaagccctcgacgacgacggagtggccctcgcggaagaggtcgggtagcgcgccctcgtagcggacgaggacgtcggtgatgaggtcggtgacgacgaactcgatctcggaggaggaggcggaggggtgggcgacggagccctcgaggacgagccccccgaggcggacgcgggacttggaccggtcggtggcgtagcgcgcgagcgcgtcggtcggggtgaggtagaagacgagctggtcctggaacgtggcgagcacggtgaccacgaacccggccgcgcacccgaaggtgagcgcgtacgtccacagccgcctgctctgcagctgccgcgcccgcgccccgatgtccgtcgcccgcggccgcgccggcccgcgccgcgccgcggaggagaagaaccgcgcgggccgccggaggaaggaagccaccggcgttcccccaacctctccggcggcggcggcggcggcgcgtgggattgggacggggctgggcgtgtggaggagggcggggaggaggcggcgggaggagaggaggcgcgaggacgccatgggtgggggatctggaaggtgcgggaagcggagcggaattggggaaagaggcgaggcgagggcgaggcgtgcgcctggtttggcggcggatcggcttgctgcccacgccacggccgcacgccggagcaagtggggggaggtcaaaccgtcaaagtgggctggctcttccgggctgcggcgtctctcagggtgggcccaacccaataagcgttgaccagggtctggtttgaactgcagtaatctgaacgaaattcgattgaaatgtttcagttccggtatagtttgactaagaccttgtttagttgggaaaaaatttaggtttggttgtcacattggatatacggacacacatttaaagtattaaacgtagtttaataacaaaacaaattatagattctggcaaaaaactgtgagacgaatttatcaatcctaattaatctatcattagcaaatatttacggtagcaccacattgtttatcaatcctaattaatctatcattagtaaatatttacggtagcaccacattgtcaaaccatatcgtaattaggcttaaaagattcgtctcacaattttacacgtgatctgtgtaattgttttttccttacatttaatactttatgcatgtatccaaatattcgatgtgatagtgtaaaattttttgttttaggaactaaacggggcctaatattctcgtcttgttctaaaaaatgaaaaaaggtgcctacggtggctatcgcctacctgagttacaacgaaacaggcatcaaacacagcccacggagaaacgactaaaaggcaaattggcgacttctttttgaagagaaaagagcgtgagattgtgccttttcaattgaatatgacgggaggaaaaagagaggggcaaattggcaactgaaatgaatcaattggaacaaagactgaaatgaatcaattgaaacaacgaatggccaatattcagaaacaggctataaatgggaaacacgtcgtgacattgtgaacctaggatgtatgtgacgattgatgagagtccaagtgtagtgtaacaagcggttgataacacatagcacatgaagaagctgaacatttcttcagccaagatgtaaagagtttttagtaatcagtaataattcagtaccccgtggtgtgcctgacactacagtggggtagttaacttatgctatatctgatgaaattgtccacaaagtggcatttcagtccaatacactgtgacgaatgatctcatgaggcaaaatagaccaaattcagcattggagatcgactgccaacattgctgatcattcaggaagcgagtagagttacaactcaggttcttcaggtgagcatgtgcctttgcaaggggcatcagtgcaccggcaaacgggttgtcccgaaagctcccatccattgaacccacgttccagcaccatgatgttctttgttcctgattcttccttggtctcagatagatagtcggagaacatcttggcacacgatggacctcgcacctgcagcgtgatttgatctcactgtgtaagaaatatgcacttttgcatgttatctcaaataagaatatcaggcgggagagcacaacgatatgcttgattattatataataatgagctaaaaagagattagaaaacttgccctttccatctgctattaataaatgtgctgttacaatataataaaaaacatgagctaacgcaatcagcaatgacgacagcgttctagatgcaaaaatcgaacatggtaccaactcagtggatgtggacaagtataagttaacaaagaacactctctattattgataatattagaagataatgcaatgcttcaaaagtattaactggggatttccaaaatctttactatagaaagcatcaaaatcagagtttgaaagactatctgcttgaaccagaaataggtagcctttcatttattttagataatggatatcaatccggcctctacatccctaaaggacgtgaagcacatcaaacagaaattgaccccagaaaggtaagtctaagtcattactgatagacgctgttcaagtttaggtgaaaaccagtgatgttccgcatgtatggattgcagtggtactgtgttattccatttgcagtggatggaaatagggaaacccttagagcaagaaaatgttaaacctgaatgacaggtccacgtataagttcctgtatcaccaatatcggaaattttgtctcgacaggactacaatttgctaggacatttttcaggcaaattaactccaacgtgaagggaataactcctgatatcatatctcaaaaagcatcctggtttagattcaagccaccaagtggatattaagaatcctaaattcctagtgttcaattgaaacaagaccattcagcaggacccgaaatcttagtccaacctttagctacaaacgttgccagagaactaggacagatcatgccatccaaacaggtaatctaagttgcagacaacaggcacttagcctgatgccttttatggtgtatatctcaattctttaagctccattcaacaatgaataaagcagtacacatctcatgacatctacccagatcagtactaaagagtaaagaagctaacaaattcatacttcatcgggtagtgacaacaatagcacgatggcgaaggttcaatgataatatagctaggagactaagataagctttcgatttttcctatcagaaaccacgcaatcgagtaacctaaaatacgaaccacacgatgtcctggtaaatatcagtaaatcaaacaacgttgttgcaaggtgattggtgccatgtgcctgcatcctgtaggagatcgggtacagtaatcgcaaatttgcaaagtgcctggcatgagatgtatgggggatcggaccaaccttgctgagggcgcagtggaagacgacggtgtccttgtcgccggtggcacgcgcgagctccggcagccgcgccgcgaagctgcggctggagaagtggtgcgaccccccgatgtgcgcctggtagctcctctcctcgtccctgcaatcccccaccacacatagaaaaaaacgaactatctcatcaacatcagccaccaaatcagcgcggcggagggtcggagagagacgaagagcggaagcgagcgcgcggcacctgacgtcgatgatggcgacgcgggggttgctgcgcgccatggccaggagcttcgccgccgacacgtacgacacgctccgcgccatcctccccgcctccgccttcctttcccctctcctccgagagaaaggcgtactgatgaggaatctgcacatcgagtggaggaccctttcctccttcggagacgaagctatttttgcaacttgctcctcacaattcagaaatccctgtctaaactattttttgcaacttgcgccttgaaattcccatacctaacctaggctacgcctttcacaaatttcaaaatggaaaagatctcgtcaataaagaaatttgatattttaagaaagaaaatatttagattttagaaatataaaatttataaaatacattataaaatatatagattttggaaatataaaatttataaaatacattttaaaatagtcatttctagggtagaaaagattcacaattctgggaacaccgttagaagggaaatacccgatttattattttagtcaaatcccacggttaaggttccaaattaggtaagcccaagtcaaaacctatgggcaaagtttaaaattgggttgaaattttaaattggagaattggcaggggccgcgcgaacgcgtaccccctctaccacaaattatgacgtccactctcccgcttggggagatggtaagccaacgcgcccaccaagtgcaatgtgggccattggcctaggccacggctcttcttgatcggccgtcgaccccgtccaggtaagtatgttgcaacgagggcaggggtgcccattatatactgctcctcccctcccccacctcctcgaatctccgaggtggtactaaacttataacagcgagacacaacgcccctccgcgggtgcggcgcggacagccggacaccaatctattcctgggcccatttctacggcccattggaaagcccacgagatccaaaggcccaaatctttttcgctcctgcgcgccaagcttttcaggcgaaattttcatggcgccattgcgtccaaaatttccccttctctccgatccccaatccccacgacggcgatggaggaggccggcgacgaggagggagagcaggggcttcgcctcgggggagtgggggacggcgccgacggcgaggaggaggtggctcgaggagtggtggcgccgcaggtgctcgagctgagctcgtccagctcgggcgaggaggggggctcttgggaggaggaggagagccagggatctgtcgaggtgacgagaggcgggggtggagatcgcgaggctagggtttccgagagccgggacagcgcggaggtgaacggcggcgaggcggagagccagtcccttcccggctgccccatttgcatgaacgcgtggaccgcggatggcgcgcatcgcgtaaggtgaggagattttttttttgtttttactaaattcgtggaattgcgccatatgcttctatgttttgattgttctcatgagtgcatatcttaagttgctaactgtgtgatgctgtatatctagttgcattccttgtgggcatgtctatggcagatcttgcttagagagatggttactgcagtgtcggaagaaacctgcgacagtatgttgttcaatgaatctagttctgaattatatatacaacctgtaatgttatttggagaactcctttgaatgaccccatgtttatgttttcagtgtccccaatgtggtaggaggtttaaactaaataacattatcaacctctatgcaccagagatttctgttccaaataatgatcttgaaaaggttagctttgcctcgtttcctttctttggaggtatttctgcccatgggctgaaacgtgtttgatttatgcagcaagtattgtcattgagggagaaaaatgaatctcttgagaagcaagtaagctactccttgtacagtattttgtacatgcttatacatgctttaacagaacattattttgtacgatgtggtgtgtaccttcgaaccgtttcagttcaatgtaataactactgactattttcatttccgcgaggaaaatgtaaatgttttgttgttggtttataggacactgttagctactgccatgaccctttcctataactattttatgcagctaaaatcgccacaagttccatgtatcttttctaacttaagctttcttaacattttgattcagaatcaagaattggtccaggagataaatgagcacaaggtacttacccaatttcttttgttatggtatcactttttttagaaggtgaatgatattttgactgcaaaccttgcatctaatttacataggaaaagaaatgcgacaagcatttttgtgtatagataatgtttgccaagcgtattcaacatttctttttttagcaaaggtctcccttgtatgtttccttaatccttatttaaatcaaagttgttagattaaatatcttttttttttttcattggcctttccagtgtcaggaaataaagttttctttccatggagcctcatgttttttcctttatgtttccttgtatgcagaggcagattatactgcagcaaaatttcataaatgaatcaagcttaaagagaaaggtagcttttcttaaatttttagtgattaaccatgattacacaagccttgatgttaacattctttacaacaaattgtgaagaaaatggcagatcaatcatcacatggaacaacagatgcagattcagtagcatctcttacagcagatgatggtcatagcagtccttgcagttttgttctccaggtttctctctagtctctatattttatgtttatctgggttccagcttctattattatattatacttgatcaatcaaactctagatctatttgctactccatttccatttggttgtgcctaatttagctatggtcatgtagtatgagcaggaatacttacgatgcatataacttgcttgtcatgccaacttcagcaatacggatgtttgagcagttcacaatcacctacagactacagaaagaaaaactggccagatttaatttattgctctattggacttataatttttcagtccaatactattccctggcttcctttcatgtattgcatacctcaataagcaagaaatattcacaagcgtgacaagacaatggttaaaaacctatacacgtgttgcaggaaaattgaccttttactcaatcttaggttaccctatcatttctggctatccatgcctttttctatcgaacagtttacggtcaaatagttgtaatctagattttgagtgggagctattgtaggtatgctcagggatggtataattattaaataggtattgagattttatcctccctgaatgttccattcacttttctttaatcaaagaactgcgttttgaaatggtaattatgttttgtagaacgagtttttccttgatggagctcgagtcatgggcatagatgcatcgagccagattatactcacttctggcagggcacctggaattggtgctgaacatgtcctcacaaaggtacatgttctaaacttgatgctttccctaatgattttatgtaacctatccttcttctgattatatttggtcgtttattcatattgtgtacctttaattcttaattttgacagctcagcatgtctagacagggattgcagaaaatccaccttccatctgatactaaagctatcagggatatctgtatactgcctgggggtcatgttgtttttgcatcactaggcaagaagttgtcacttttaaggtctatcttgaacatgttcaaattatttttttcacaacacatttactcagaagtttgatttttgttcttgtgttttatttcccagcatgacaactgaaagtgtcgtccttcattatgatctaccggtgattctttgaccttgcagtttcacaacattcgaaactattttttgttacctacttgttgattcgaaagtgctcaccaaaagttattcattcacaattttttgtggctaactccatctcccactttatttcatgaaagcacattctagatattatatatgcattttcttctcctggaggtgctattttggttgtcatgtcataaccctgaagctctttaaatatggaaatgcagcacgtttttcatgccaatttacattttaatctttacgagatcaccaagtttgcaatctttataatttgaagagtatatgcatattctttaaaaaaaagcatcatgatactttttttttctgacagagatgcatgtaaattttctttgccttgatctaaagctgttgagtgaaaaaaaatttgaatcttgacctgttattttggatttcattatcttgcaggctcctggctggtcctgttcaggcgatcaaaatagtccgaatcacatatatgctggactacaggttgagttttcagtatttcgtgcagttcttccttaaccattgtgtgctcttcgaagggttgactagaaatctctattgatgtttcacagaatggcatgctgttgacctttgatattcgccaaactgttgcaccgttgcattccatgatgggtctatctacacaccctgttcatacgatccactctgttgtagatggcggtggttccaggaaggtcatttctgcatcttccataggaccctgcatctgggatgttgacgggagcagaaacaggtatgaaacagttttaaaacttacaacaaagttcatagttctttgtggtttccaatgttcatttttgctagtgtttctgatcaggccagatttgctaaatggaatggaaaaccacggagtctgcatctctcttgcgtgcaatcctccatcaagtgatctcctagtggcttccttccggccaaaagttgagctgtccgacgacggcacatctcaagccggcaaatcacagtcaccgacaccctctgcatcagggaagctaggctgccatgcactcataaggaggacgagcaacacgtccttcgccagagaccaaatctgcagaggcaatgtgagtggattgcgaatgtccaaatccgcaatcatacccttcaccggaagaagcaatcagcaacatctcttcgcctatggcgacgagtcgctgcgcggagtccggacatggcggctgccttcactccagacgtttgctgatctcaggccacaccggcaaccgatccttgatctgaggtttgcagagagctcgtcgacaggggaaaggtaccttggatgcttgagcgaggacaggctgcaggttttcagagtaaggtagcccgtagcaacaacatcagagacagtcatttgacttcagttcattgtctctgtctgttagcagctgttccctttgctgctgtgttatactatagtataacacatcagcactttggttaggtttgttgtacaagcacaagcaagtcttgcaatctttctctgtacagtactgatctctagagcagatgtctagtgcataacatcatgtgtgatttgttttgggtgataaaaccatgtattaattttgtactagtatcatgagtggttgaatctgccacaaaaatcaaaggtacagttgggtagtgatatgtcataccattgatgctcagggcactgatattttgtccagttcttatcaaatcataatcacctcatctgtcactgtattgtaccatcacaaattcatgtttgctctttgtgtaccttggcaagttcggtggactcagcattctcaaagtctatactcattcctctaccaacacaacaaactagtcaaagagggttgatagcatagtacaactagaacttcaattctgcaaaatagacaaataataatctgtgatactgcatcgcttcaaagttgataaaacacttacggggctcaattaagctcatgatataactaatgaagaataaagaatttgatcaacttatgagacagtaaaacactttcctcaaccaatacaaactagtggcagaaaggattgttataggcaacaacatactctgtagctcaacaagagcctcaaactatacactaccgacaaacaatttgtgacaatgcattgcttcgaagttgataaacacttaaacaatgcagcatgacacaacttttttttttagataaaggtattttttttacccggcctctatatccaaccggatgtatacagtccatttaaattgggaatttggcccttcaaaaaacccaatatgaaatttgctcatatagaaattttaactcaggatcttatggtgctacttaagtcactgcaaccacattatgatacaactgacgcattgcatacgataatgattttaatcaacttatgcacgcctcaactaccaaattgcagctgtgcagcatgcagttcacactaattcgatcacacttcacatgaatccaacgaagcaatgagccaatgagcaataatcttgacgctgttcatcagcactcggggtagaaggtgtgatccctggagtaatcctggcagtagtagtagaccatggcgttgcgctgcgcccacgccatggcggcctcctgctgcgggctgagcgccgcggagccgccgccggacgacgccggcacggggctgcacgccggcggcgcggcggtggcgcagccgccgaccttgaggtcggcgaagcgggagacgaagggctggtagcggtagtcggcgcggtagcggccgccgtcggtggcccagtcggaggcgtcccagatggatccgtacgcccacatctcccgctccgggaacgtcccctccaccttcttctcgtacctcctgatcggcacgtcgtccaccaagaacctgaccactcgccaccgtcggcagcagcttgcttagtttaattaattactacctcgcactaatttaatttgatttgtcggttaaaaatcacactcactagtccagtactacaattactgccctatgaaatgacatatatatatatataatgataaatactgattatagaaaaactatgggaaaaaactcggagaacaaacaaaaaaattatatgtcatttcatagcatgacctgcgctatgaaatgatatatataatgatattcattttgatcgatgcaattaattaggatctcgatgaaacggaggaattttaaataaattatgtaagatgcttaacatgagtactcgtatttatggctaattattcttttaatgataggcggcgtatcaatctatagtaggacgtcttaagatatgctggtctagtctttcggagatgcttatagggatagggtataccgaatatgtgtgtgcgttcataagtgtggatgtgagcgtttgtactgtatttctaaatcacgtaaaaaccctgtaaaattcgttacgttcgaaacaagctctaatttactgattgagcacacggtttttcaacgatcgccgcatgagttacatgcaaacttacatgagactttgaatgcttacaagatttggtcggggttccagaggatggcgtagtggtggaagccggcggtggggtcgaaccagaggtggaagcgcatctcgcggccgacgatgttgccgtcgccggagccgcgcacgtagacgttcgtctgcagcgtgtacggctcccccggcaccgtccccagcagctccatgtcgatctcgtcgtggtgccccgggtactgctccgtgttcgacagctgcatccatacaacacaaaaacataactttttcagcgaaattctactgcacatttcactgaaatttgcatgacaaaagttgatcaatacgtagaaggccgtgttgacgccggcggtgtagcccggctgcaccctgatcgacgccccgaagtagccgttccggtacgaccgtgtcgacttgaacccgctccctatcagcatcgaatcgaccgatcagttcaacccaaaagccgaaaagtatttacaagtcaactaccagtttcactcaaaggcttaagatgaacagagagtacagacatacctgagctacggtccatccacagggtgagagacttctgatcctgggacagggtctggtgctgtgggccccacagggtgctgtacccttcatagaaggccatcgacctgaacatcttgcttgggtagtagccaggagaaggctgagcttctgatggatgcagtagcagcagcagcagcagcagaatcagaagaggaatgcatgctgatcctgggatgttaccactaccaggccttgccattttgtcagttatagtgatgtgaatgaatgatgggctactagtttctcttcttctttgtgatgaatctctcacttgttggagtgagtcatttataggatgatgtgtggctactaatgcatgcatgggatgggaccaagtgatggcaggttgatggatggaaggaagttaattgcatgaatcttaggtagagacaaaaactgggagatttggatgaaactgaacactgctggcataaaggctgaacaggatgttgcccccctaaagagggtttgtgtgatacggcacacaaattttggatgttgacgcctcacgaaaacaggaaacctgagaaagtgaatttgcaaattctcaccatgaaactgcatacctttggttactggcagcattaacaaagttgatttcccatgctgcctttcttccgatggtaactaagtttgcagcctcactttcggttactacacatcagcagcaacgaatatcatatatatgcttataatgcacctgaaactttttccctttaccttctttggtgaattactccacgaaatgttccttcctccattactctgttttggtattttggctccaattgggagaaattattggaattttttctcatggatcagacaaaaggtaccatcacgtacacactatcttaactttttttcagaaacttaattcactgttcacataattcatcttcccaatcatatgataattctattaattcacacatatataattcatcttcccaatcatatgacataccgacacacgtttcattgacaaactgaagggaagaacagttgagtagctgcccaaccaatggattaggcctaaatgatgagctattttagataatggatatcaatccggcctctacatccctaaaggacgtgaagcacatcaaacagaaattgaccccagaaaggtaagtctaagtcattactgatagacgctgttcaagtttaggtaaaaccagtgatgtt

SEQ ID NO: 24256 - DNA, 4422 bp, Oryza sativa
ataagcgccggtgctggatactacgattgatcagagggtgttgtactgtgcataacgtccttggagcatctgaatgtgactgatcagcttcgtgtctcttgcatctttgtgctgcccttaactccaaacagccccggacgcaactggtgttcagttggctgttcagaattggaagattgattctgcaacctgcaccgcaccaacaagagggtaagtacacaaatccaaggttgaattctttaggttgtcttcaaatggtcactaactcactactaccaactctaaatacgcattgtgtcagtgataattagtaaaagaaaaattcaggaatgtgtaaagcctgaaagcatgacaaaagatagcaggttaagagaatctagctccctgtagacccacacgattgaatgcgcacaacattccaaacgagaacagatgctccttagaaattaaggactatatgtcatgaaatcgcagaggacccttcaattgttcacatgatcagggtactggatacagcactgctgaaggttcttatattaactataaactatgctatctgccttcctgacaagaggctcaaactgaatgcatttttctctcatgataaactttacattttatctatggtacctacacttatccttgaggccttaaacttgtggagatgaaaacaggtgaagtctgcaatcagtgcaattgcaggtacttcagagttgcttgagaattcattcctcaatctctcttcagtcacatcaaaatccagtgtaattgtccacttcgaaaaatccattgtagctgtgtgcaacagttaggtaatcaagctacagtttacaggcatctattcgtactcaggggctggagggctggggcccttgaccctccatggcgcatttaaaaggaaatctcccctagcttcactgaccgacaccaatgaagaaatgcagttacatggaaaacataagaatatttctgaaaaaaaaatggcatttccaatttcaaaccttaggtccctgcagctttcagtttcagcagataagtttaactgttatccctgtctgatgcctggatatatctgaatgcgttcaaatttgggatagcaagtgtcaatttaattagcaagaaatgggcgcacccaaagttgatttggtggatacccacacaccttcgaccaactgagctaagtcaattgactcagttcttatcttacgtctgctcaagtctgtaacaactttcttgcgcttgaccattacatatagatagaagcaaactgtggtctgaatgtctgaaaggtgcacagttcatcacttcaggctgaaggttgatgaggcacctcttcagttttctcataagtcgatgagacaccttaaggttgacaataacgatgcgcattacccactcgatcatacatagcagtgtaaattatatttgtttgctcacttctgctgatccctattttgccatgattttagcctcactctggaaatctggtgaagacttggagcatcgatcgtttacaaacctttgtcaaagtctcttgcttatgatatgtgagaacaataggaaagcttgattgaaagatgtgattgccagtcactgtgctaggttggtgttagtcaaaatggtagcatgtggcattgtgcgctccctgtcagcaatgacatgttgctacaagtctaggtgagcaagtgttatagattattagtatgttaaatcaatatgctagtctaacaagatttagcagcattagctccagtgccaactaccaatttcctcagtattcaactggaattcgcttgaactggaattcgcttccaaaataccggtgaatcattagtattcgactgatgtgaagaattcgtccaaaaagttgtcgagaattcaaaggcacagcagggtaatatatgatcataaaatgctaaaacctcttaactagagaataaatattccacaagcttatcagatatctaaaccaacgcagaggaggtactgaaaactaaaaaaaaaaggagcaactaacgtgtactaccaaactagattggaagtggtttaaactaattcagagttcataatctgatctcaaaggaaagcgagatcattgacgtgctatacactatttggacatacaaagttacaatccaatgtgttgtagttgaaatgcttgcgagatattgttgcgtagcagcatgccaacatcaaggcatttcatcgaacagagaggaggcgcttacctccaagcgaggaggtggcgacgtcgccggtgtgggatcagccgtgcagtacagctccctcagggtgtcgatgagggggcggaacccgtcgcggagaggcacgacggagacggcgcggaaccgctcggcggctcccttcgcgaacgcgcgcatcgccacgcggcacacctccccctccagggcctcctccgcggcgcgcgcggcccccgcgtgcgccgcgaagaagcgcgcgagctcgtcggcggggcagccgaccagcacgcgcgccgcgcggtcgaatagcacgacgggcacgacgcggtcgtgggtggccacggaggcgcgcaggcggtagacgcgcgcgggcaccgggcctccgccgccgccgcggccggtgcaggcggcgcatgcgtcggcgtggtccgggagcgcccgctcgcagcgcgggcaggagaggtagcagaagtcggacatgtcggccgccacgacggtgcagtacggcggcgtccacgtcgccgccggcgccgccgcctcgccgttgctgcagccgacgagagccatgacctcccacggcccaataaggcccaaggccaatacgccaagctacaacggagtactacgttaggccatcccaacctttcagttagtgtcttgacaagagaatttagcgaggagaggcgtaaaaaagatgaataaccatttctcatgcaagaaattatctctacacaagaaccaagaataaaataagaagatagttgaatgaaagaagatagtagtagaagagagatgattagataggaatttaatttaaaaacaccatctattgaatatatattctatatagtttatatgacatgacaagtataataattatttgatagtttcagagttagggatggcctaagccacgacaactcttaactcaaagatcactagtttgtatcaccctaataaatatgttacatgcaacccagaaaccatcaattagtttttatatgtatagaaactatatatatctaaaagatgatctcttcaaattaaataatcatccaataacattttttctatctccttttatctatatatctcattcatttttggtttttacttagagatggtttcttgcatgagaactggtttattcatctgtttactttgtcttgttaactctcttgccacatcaattttttttcttatgtaaaaatatatttaataccgtggataccagatgatatggaggatcaggataacctcatcactttggactggagggagtacttagataccaattttggcgtattgggcttggtccttgttgggccgtgggatgtatggctcgtgtcggctgcagcaacgccgacctttcttctcacggcccaaatccaaatccggcaatccccaacacctacgagtaatctccaccgtccattcgagatcggacagccataaaacgcacgtgctctcgcttcggtggagctctggatctgacgcgtcctcttcttcctcctcctcgagacctcggcacctcgcacgccacgcttctcctcctcttcctatcccaatccactcggcgacccccctcgccgtcgccgcgctgcgccggcgagcgccacgggagcagcagccctcgccgctccgcggctagctagctcgtctcctcgtccgcctcgcgcctgctggagatccgccccccgacccccgtggtaagccctggacctggggttggttttcgtctgtccctaatctgccgctgatgtgcgagccgaaatcaaatctatcgacgaggtttcgtgcggttagtgtgggatcgatcgatttgctcggtagtatctgtaaatccgctcgctgttactggtttggtcgctcgctcgtcaggtagggtttcgttcgctgctctcgcaaattggtcgtggactcgtggttcagcgcgcgtgcatgtttgtaggatgggagcgtaggttgtggagtagtcgaagcagtaggatgggagcataggttgtggaatagtcgaagcagtaggaatatgggagcataggtagtatggttgttgaacttgaatcctatggtaaagatatgatgatttgttgtagattgggcggttgtgttggggggactaggagggaaatcttgtgtatgagcaattgagcaaatggctcgatggtccttgtttgtagtaatcaaggatggaggaaggtggggcattcggagagtcgtt

SEQ ID NO: 24257 - DNA, 957 bp, Oryza sativa
cagagttggtcaatacccaatatacttctccatgactcccaaattgtacaaggttctccagtgtagcaagtgaccattccctctacaatgaatgaggtctctaaaaaagtgaagagttttctccttttagataaaatgaagttccccattatgatgtctatacttactatgcctagactcgaattaaaacagtcgggtatatgtatcaactatcaattctaacatgtcctgttgaaactcctatagtttattattatttcttcaaaatccattacaacgcatgggcactctgctagtaaaagtaaaagagtacatggagtacgatggacctcattccctttattggacgatcacttggtttaagtgtgcaaaatgttcaacaaggcataagctaatgttgtttcgtgattttcggaaaaccctctcatgattacattagtttgtcatgattcatgacctgaagagtgcaatttaataaacgaatttcagattcctgtcaatctgcaatgtatctgagcttttgtatcctccacttctttgttttcttccctgcagatttcctaatgatttgtgcaacaattgtaagcgtccaggacattttgctagagattgtccaaatgtggctctttgccatgcatgtgggcttccagggtaaggactatttgttattctgttttgcagatatttcatgttcttatagcctttaaagaagtcttccattattcagtatctatttgtggtgtacttgtgtttattttctcttatattgttttgccatgcttttaaaattctgtattctcaatagcactgcttgtttatgtcattgtgtatttagaaccatatccatctagattacaaatgtgcagtgaatgagacgtgatctcaataattgtgacagttcaaccgtaatgaagttgatgttaggtgaacatgatagatggctacattgatttgcta

SEQ ID NO: 24258 - DNA, 7117 bp, Oryza sativa
tggatcccttttttgtagtctgtacttccaatccggtactgaagcgcccttttgaactggcacacaagctcggcattgctccgttgcaagctttttttctaccccctaattttggtgtgtgaacgtaattcgggtaattcgggaagagtatgctgctgattttctcctgtttattgcatatctgagccaagtaatatttctggaatggacgttaacatgcctcgatagtatcaaaaggcataacttgttatccttgcctacgataaagtctcgattagtagtcgatttggcatcaaaacaccagagaaatgcagatcatttgcttctacagcgcatatttcacccaaaaaaaaaacatatacagcaattggttctgactctttcaagttgagcgcaaaccacataaagactacccgagtcacaatgttattggtcagcgtaacaagttccatggatgctcacaagtcacagccacaaaaacaaaaggcacagcagcacgacactactacagaaatcgaaacaaaatcaaaacactacacaagccgtaacgaacaaaatgaccagggaggcattccagattttggctatatataggacagtttaatccaacttcgcgtagctcaatccattgctatctgctttctcgccttccgtttgccccagagccttcatctgtttcatccaaggaaacaggaagagagaacgaaaaaaaaaaaaggtcagctactctgtcaactgagttgcccatttgacacataacaattgtacaaactgaaaattctctggaattgaagcatagaaaatgaccggagatagcaacagtgcaaaaagaaaactacctttgcttggtacgccttatggtatctgtaaccctgaaaaaacaagagcacaacataaatatgtcgttcttgtgtgttgggggtgggtgggtttaaacagttgcattgtgtaaaagcagatacttactttgtcggttccatatagataatcacaatacgtgaaaacagaagcgaaattgctctgactctggcgtccaacatagtgatgataatcatggtattctgcgcctccatagaatggaatatactttgtcaggttgaacgggaaatcaaagctgcaaaaataacaagataattttgttatgccatgtaaacactacacgagtgcaacagcaatgtgatgggcgatatcatttggtcagtgcaatagcaaagtgatggggaatacggcaaaaagtatggtcatgatactcaagttttatgagttgacactgacacaatattgatatgaccaaagcatatacatgtctttttatttattttagaaaaggggttggcggctttccatccttttaagttaaagttcaagcaacttaattgcttctatatcatccatggtcacatactacaattttatgagtgaacacttgcagaaaaacaatggatcagacccaaaacagtctagtaatcttgcattgttgctagttctccatgtctagcatagtatcatatacactagtaaatatgcatatctatttaaatttgacaagctgcttaaaaaaaactaatatcaatcattacactccagattgcttagagttgtataattttgtaattaaaatcacaaatgcacttttttctcaaattaattagtctaatcaactttaatgaattgaaagtgtagttgcaaaattgaacaaggttactcatttgctacttaaatttctttctactaaaaagctgcagcgaatgctgaaccatggtctgtagtctattctagcattattctggaaatagtagataaaagcatcctatttctaggtaaaccttttctgttcaataactccaaatgcatcaacataggtacctgtatcctatgttccaagcttccaattggaaacaaaccctctgtccaaaaatccatttatcactaacaaatcaaaatgccatgcagctagatttgcaatcacccactaaatctatccacaacatatccatccatcactagcaacaaatccaaatacttgccaagtcaacacaatgctgtgcacatcgttagacttatattacgtgataaattatgcatcctccaaacaatccaaagaaggggggaagtacaaagtttccttacccgctgtgtgtctctatggcctccatctggcggagtacaatccagagccagaaggtgatcatgtgaccaggtgcaagcgctggcccgacaaaggaggggatgccgaggatgagcacctcagcccagtgtgcatatggcgcggcgaatccaatgggtgccgtgaactcatggtggacacggtggatcttctcatagccccactccccatgtagcaaccgatggatccagtagttgaggtagtcctcaaccaggaagtacaccagcagctgcgccgccatctcccccagcgacggcagtggcagccctgtgtggattcccaccatctgcaatgttcaaaaacgacctatcttctttatttgatctctagaactactataataatgcaccacatataaataatagtaaatgatataaaaggaacaatcttcttttacttaagagtattaaaatatcatcaagacgaccttagatcatgtgattgcatctcacaagggttcccggatcacaaatcccttcaaatctcgcaatctcgaactgatggatcacccaccatcttacaaatccaaattctaagcgccgcatacgcgtagtaaccaaatgtcgcgttcttccttcgaatctaatccccgcggcacagcattgcgcggattcatcgacgagagccgcagaaaaaaaaagaagaggaaacgcaccttgacggtagggtaggacacgagctggagcgggccgatgacgaggaagaagaggcgcatgacgtccctgtagcagcggaagaactcctcccgggagagccgcaccttgggctgcagcttgaacggccccacggcggccggcgcgcggagctcgaggagcgcgacggggagcggcgcgagcgtgaagacgacgaagaggaagaggatgttgtgccagaagaggacgtagtccgggatccccgccgagtacctgaaccacagcgactccgccgccgtcatcgccctccccagcgccgcctccgcctccgccgccgtcgcgtagggcagcatctctccccgcctccgccgccgccggcgagccactcgagatggccccctctttgcgattcccgataactctagggggttaggtgcaaaatgccgcttcgagtggcctcgcgtcgtcgtccacagctggacagtgctgtcctctgctttttatgatggcatgtttgtctcactgacatgtggggcccacgtaaggcgcggtgtgcggtgggctccacctggcagtgagtggggcccgctgctcctttgttgtttttgctaatgctgtgtggctggatctcgcatgcatatatggtatggagaattggagatggagattggagagagcatctgttgctctttgactttctgtggccatgaatccactccaaaaactacaaatactcgaaaattcgattgtttgttcaatgctgtggagtaatcagatgttcgatctggagattaagaaacaaattagctgcaatttgtgttacaagttggtggcagatcaaattaatcaaaccaccaaatcatatttttacagctgaagcgttggatactcctccaaatttcagcacaaatgcgtgcctagccagtgcattcatgatagagagaaaaagatatccagtgctacaggtcatagacaagatggatttcatttattatgggggtttttttatatataatttacatcttagaacagctattaaaatactggaaactattgagatggcaatagttttatcagagaataaaagagctatagtagcaataagtgatcaggggacaacaatgtgagtatataggatttaatttgttcgatcgcccatacaaatatgttcgtgcttttaaagcagcacacgtacgtacgtacgtcgaatcgtcgatgcatgcattgtttggtcatccgtatttatagccaatgcaaatttcttacgtgcgaaatgcaactacacatatgccacctatgcatccacgttcccaagagtccaaccaccagcagccatagatgtcgatgtcataagagcactacggctagggaaaagaacaaattcaaaatgttgccatcaatgtgcattttgtcacgttatattttgttttcccgattacccagcagaaatatacgtacaataccactacacgtaacatcacacttgcacgcccgtcaaaataaacacacactaaacaaaatgaaaaccaacaatgcttatataaatttattattattttattgaaagttcatttacgtatactcgtagcttaattttcatacacgcgaggatttaaatccggtaggtaaaattatatatcgatgactccaccattattccgtatcatttctcatttcaattcaatgctataaaaatactacaatgcacttgcttttcctcaacaacctacccgtcaacctctttcctagagagcgacgtgtcgggcatatactctctctgttttaaaatgtttgacaccgttgacttttcagtacgtgtttgaccattcgtcttattcaaaaaatttaagtaattatttattcttttcatatcatttgattcattgttaaatatacttgtatgtacacatatagttttacatatttcacaaatttttttaataagacgaacggtcaaacatgtgctaaaaagtcaacggtgttaaatattttgaaacggagggaatacattcataacaaaatgtcgtacatttttatacttcgatcttaccaaagttaattggattagctatctattatcgtttttttgctggtccatttcggaaagtagctagctagatgcatttttctatggctagctaggtacgatgtcgagctagctatgtgtcatcgcctcaatttcggcagtttttcttcctctcctctcgtgacttcttctgtcgacaaagtggcatggtttccacgtccaaattcaggtatgccaggccgccgcctatgcatacatgtatactcaagcaaaattgttaggaaatgataagcgaacaaacgataaaaaaataatagatcagtcacagaagacacgagatttaacgtggaaaaccctctcaatacaggagagaaaaaaccacgggcgccagccagcaaaatatcttcactatatctggggtgaggttacatcgccgcacggcggtttacaagaggtatatatatggtggaaccctaaaaaggatgacgatccgttttgcgggggctccggcccaagcctcccggtgacgggcctccgctctgctacggcagaagctggcctttattaagtgcaaatgaatttgtatcacaactcaacaaaaatgaacatgttttgttatgataaaataaaatatataataatatatcatatatgtaatatatttttaaataaaaatgctagtatgatttgttgcttatttgattatattttatttacttgatgcaaacaaatattagactattatgtgatattagaaactaatttaaaaagtccaaaagtagcggtatatctttcatagtagtagtttagataaacaggtatgcaataccacgcacatttcagacctctcaacttcatcaagcaattaaatttctgagtcccctcatgtactgtgttagatactttggacttgagtttgcttaatttgtcccatgtatagccccataaaatttatttttaaatataagtggtttgcatttagtttcaggcctccatccttaaacacacaagataccatcacaattgtatatttctatgagagtatgaatactacttatatagctttattttttataactattaggtacaaactttttaacagttcatagtataattatattataactcatatatattatatatgtatttaactaattagaagtagtctcgccgaggagcacttttgctcacgaggtagtgcggcttttttctcttgggcctgttcagctgcacttaactttattgttgtgcagtcaacacaaatagtaagttgagtttgcagctgcagcaacaacggctgcgtacaatggctgtaccagctagccgaacaggcctcttgtagacacgaatctcaagacgacccgacggtccacaaatcaactgtttggcaaaacaaatttatcaacaattgtatagcaattcagatcctttaatccacgaacagaggatagtttctttttccggcaggtacagtaaaacacaccaaaaacacatctataaatccaaggatagttatcgtccttggccctgtttggtggagtttaagattctaagaaacaactggtgagaatttggagaagctgggaaacccagcttctgacttctagtttattttctgtattctacaactacagtttctcataatctaagtgaaaatttggattgtttggggagcttctagcaatagcagcttctagaaaaatctccagctaccagaagctcacccaaacaagtcccttattaggtgcatcaccaaacatgtacatcctctcgtactcgatcctcctcggattgacgacgaagcggtgactgaaaataacacaaacacgtgataccgagccagcatgcacggtaaggatgtaagtggatcgatccgtaaactcacttatagtacacaaatgaatgggtaaccgccgccggcggactgtacagaggcgtcgtcaaacgggcggcgcacatagtttccctggggcgtgcagacaccgaacgctccgacgacttgcacgctccatgcatcgccgggaaacctgtctctctctgacggctcacgagcaattcgcctgacaagtgaccacccctcatgctcaatgttctgcatcacaaactgacacggcaatacaacaattaatactggtgcttaagtttaaactgcttgcttgtgtccatcttgtattcattgtttgctggctaatttggccgatctcactttgtatatctccagtggttgagcacgtgagtcgtcaaacatccactacaggcggcaattttacagcaaggatgagcaaatcttca

SEQ ID NO: 24259 - DNA, 1669 bp, Oryza sativa
tcacatgctgggatgctcaatcaaaggtagtagtatcatctgcatcttcaagtgcactgtgtgcagtggcagtccataaccaggacacgaactccatacatgcatgcacaaatgcactggatgcagaagaattgtagacattcagagttccggataaatggccgaaggatgattgatggaggcgtagacgactgtgagcggaacaagttgaggtctgtggtagttagaggtcttttgttccattttagatgacgtaattcatataaaataccgttataaattctaagtgttttctattcggtgtttcagttagatatcatcaggagggacataggggtttgtcccataaccttgagtattttatttatcttttcttgactcattggtcatgtacctgatggcagagaccagagatttaaatcattttcatgtctaaaaaaattagaaaatctgagaaggaacatctcttaatctcttatgcatgttcttacagagaactctagcaatctgaccatatccatcagccaaccaccatttgagccattatggttcatgtttgacatggttaatctccctctgattcttagagccttcccatcttaattgtaggcattgtaggtactgacgtagagtaatgcacccacgactctaatacttttggcaccgacgccatttaaggaaaaaaaaatcctagtttacacatataatcctaacacttggagctggtgatttcagtaggtgagtttgatcactgctgcctgatttctcttcatgggcctttccatcagcttagcccagtggctacattagattctcttcattgctaattcgttcctgtatgcagattgtataacagagaacatatagctcaatttctccaaataggaaatacaaaagaattatacacaagttagaacaatcagaacaaaccagcatctcgtggtcacccattatttcctcgatcacctcaccaagaatcttgtctgcactgttaggaacaagtgctgcaaaagcagctggttccaaccctgaacaacaagtagcagctcattaattttgacaacacatgatctgcaagcttccaaagttcatttatatgatcccagttaagtgtaataaatttcacagtttacataggacaatcgagttaccagtttctgggtaggaattgatgaacatcatcatctcttcaccagtcaggccagaaaatatacaaattcttggcattgactttgcaatctgccaattgaaaatgagtgttaaccgttaacaagtgctcaatatcctgatctaaggtcagagattaattgattggcatttggtatctgtaacatcagcacaatagtgatgtgtcagctgttagcagattaagactgaaaagaaacgtgaaaataatgagaatgaatgattcagaccttgacagcttctatactaggttgctcagtgtgcatggcatcccacaacgtttgctttgtcatttcttctgtacaatgaatcacctgaaacaaagccatatgagcatataactgacctttcagattatccatagattcatataagcatggttgcatttcgtcctttgaatgatgcacttgcacgctatgaattttctccctgaatttcatcttagatgattcttgccgatgagactaaagctgagtccccatat

SEQ ID NO: 24260 - DNA, 227 bp, Oryza sativa
gcacgggctggacgcgcggcgccgtgtggtgggccgcgctggcgggttcgctgctgtcgctggccatggagtttttacagatctacctgccgcggcgtgtcccttccaacctcgatctggtgctgaatgctgcgggcacatggctgggcgctttgctggcggcgctgttggagcgctggggggccatcgaccgttggagtctgttccggggccgctggtttgtgccg

SEQ ID NO: 24261 - DNA, 7750 bp, Oryza sativa
gttaaacaaagagggagcaaattgacaagtgcacaaagccaaattaactttattaaaagttcaaaactgattgcaagtttggagcaatgaggtaatccggcatgcgtacttgagtcactagctcattcgctagtgctagctttgttgctatcaacttcattcaaacagagaccagctggcaacagggatacagtacatatatacatgcattctgctgttcatttgccttattaccatgcaccaatataatgcatcctcctctctagcttatcataagtactaattaactaattatcccagagcatggcaccaatataattgatccacttgagaccaagcatagtgtacacttgaacacatgcatgcattggcatgcacatagtacggcttgatcacaaacttaatcatcatactagcttccttggattaatatgatcatatcacatcccttgtaatttgcatgaattcttgcatgctcgatcattctgccttcttctgatcgttgtagatagtagctagccggattatattaattaattaatttaatgaatactagatgttgatcttgccgatgagagggatgccgatggcggtgacgacgagggtggatgggagtccgaagatgacgtggttccagaaggtgaggtcgtaggcgttgcgcgtcgcccgcctcgcctgctcgcacacgatcaggttcgccgccgaccccagcagcgacaggttccccgccaccgtgctcacccacgccagcagcagccacgaccgcgtcaccgccgccggtgatatcgtcgccgccgccgccgccacctcatcccccatcaacaacactacacccacatatataaattaatttacaattaccactcaaataacatgtaaaaaatgagttgttcttttttaattatgagagacaaaaaaaatttttttcttttaataatcattcatcttattaaaaaatataattacatttattttattttgacttgatttattgtctgatttaatctttttatatttacaaaagaaattgaataagatccattcatcgataaaaaaaagtcagatatcatgtattaaaagaaactgatgtactgtacagtacaaatgttagtgctgggtgagtcgggacacattgggtactagcaatagcatggtgcgagaaaggttgtgagtaagtacgtaccggtggggacgttggaggcgaggttggagaggaggaggatgatgacggagaggacggtgacgccggtgacgtggttgatctttgagtagggcgccatcacgttccagatggccccgggtagccccgtcttgttgaacccgctcaccgtcacgaacatccccgagaagaacaccagcagcgagtacgacacctgcatcatccattcacatccacgcacacgtggcacccagttcacatattgcttcttgtccgcatggccgccacgtgtacttgctcgtgtggcctagagttatagtgatttggacggatatgggttaccttgtcgaggcatggctcggcgtcgcggaagtcgacgacgacgagggcgatggcggtcgtgatggcggtccacgacatgttgaggccgagcatgtaggcgacgagcatgccgacggtgaccacgtacgcgaagctcttgaggaacagcttccgccggtgctccgagcactgcatgaaccaccggtgcttcgtcgagatgttctccgacatcatcgactcggcgtcgccgccgtcgtcgtcctccggcgatgcgggggtggcggcgtcgccgtcgtctttcttgttgttgttgagcgccgtgcggcggccctcctcgatggcctccatctgcttgccggcggcgacctcgtcggggctgcaggcgccgccgtcgagctccttccagtacatgcagagcagcatgagcatgttgatccccatgccggcgagcatggcggggaggatgccgaggaggaaggaaataaaggagatcttgctgttgaaggcgatgaccaggttctgcgggttgccgatgggcgtcgcgctggagccgatgttggcgctggtggcgagcgcgagcaggaacggcttcgccgggaggttgcgctcggcggcgagctcgagcacgaactcggtgaggacgacgcagcaggtgtcgttggtgaagagcgcgctggcgagcgcggtgacgacgcagacgcggcacatgaggtcgcgcccgccctggctccgccacgccagcagccggcccaggtgcctgaacatgccggcgttcttgaggtagccgccgacgaccatggtggcgaagaggaggcccaggatggggaggtcgatggaggcgtaggcgtcgtcggcgctgatcacgtggaacacgatcatcagcaccgcgcccagcagcgcccccgccgtccgcccgatcggcaggaacggcaccgacgggaacaccgccagcatccagaacacaccgaacgccaccgaccccatcaccaccttcggcagcgacgccagcgccatggccgcctctctctctcactacaatgcagctagcgtcttggagtgggaggtggtggtggcgatgagagtgaggaagagaggcgactccccgtgggcttaagtactcccagccaggacgaacagctggcatcagttgcagctgatgtcagtgtccagctaggtaggcagatgattacgatccagaggcaagggcacgtacatctaagcacttaatttacatgccattcttttgctaattttttcctttttatcttccagatggtaatcttgtaactttttctactatatctatataaacttctactccctccataaaaaaaaggcaaaccctaagttttcgtgtccaattttaactgtccgtcttatatgaaatttttttataattcgtatttttattgttgttagatgataaaacatgattaatattttatgcgtgacttatctttttaatttttttcataatttttttaaataagacggacggttaaatgttagacacgaaaaccaacgtttgtcttttttggtacgaagggagtagattgtaatcttataatttttttctgctatatctatataaacttcgcctgtatggtgcgagtagttagttttttacctaattgttataatgatgacattaattagtgataatgttaattattatctaatactgtattaagtaaactacaaaacaacataatagtatgctgtttgactactactgctactccatactccttttaaaggaaatcgtcttgggaataagggagtacattcatgtgcagcagcaattccgtaacatttatgtgatactactagctactattccgtactacacatctacacagatgcatgtgtaacacatcatctatgtagggtggacacgtgtacgtgcaggattcatccttagccacgactggagctaagcatcgatatgggtccatgggtcaacgtgtcagtgtcatcaaatgttcctgtccggttcgtgtctgcgaagagaatgtactgtacgaaaaatggcggagcacatgcacgcagtgatctctctcttacccgttgcgagtgctaatttcaggttaagccttatctaaataataaacaatactgccgtataaattaattagttaaaagtattaaccaacttgctaagcaaattgtcctttattttactttatataggagagcatatcaacgtcgtcagacaagttttagagggatttatttacccgactatatgtatttaaataaggagaagaagataaatttatggcttaagaaaatacctcaagctatttgctccgttcattttaattataagtcgatttgactcttgtcaaagtcaaactataagtttgactaattttgtagacaaatataataatatttacaacaccaaattaagtttattaaatctataattaaatatattttcataatatatttgtcttaagataaaatataactattttttttataaatttggtcaaatttaaaacagcttaactttgactaaagtcaaaacgacttctaatctgaaacggatggggtagtaaccaaggtttacataaaaaaatatacctcctaatactttcttaaatatgataaaattaaagtagaatgcatggagaaaaaagccgttgctagcttaagcgtgcaccgccatgaggccattaggatgaacaagtgatgatcatctgatcaaaaggtggcaaatgcttattacattttaattactagggatatgtcataaagcatgattaattagctagctagcttcctgttcgattaaacatgaaagccatacacctatatgctttcgtagcggcgacctggttggatcgatggatctagccttcacgactagaaaaagcattttcgccgatgttgggtattaattttcacaagtggatatgatccttagaatcaaatagccacctacaaaaatataaattagggtgaagttcactgtctattttcgcaaacggaccacttaagccgtgcctgcaaaaatgattttcgcaggcggaccacatgagatgtgcctgtgaaaattagcgtggtatatatacagtgacacatcggctgatatttttctaagtgtcatttctcccctcactcacctctcctctcccctccccttcacctccccgaccgccggcggaaggggcagacgtgcacgggacggccagcggctggcggcggctcccctcccccctccctcccagatctagccagaggagggacgggggaggccggcgggggcaacggcggcgactacggcacggggcggcggcggcgacgacggcgcagggcggtggcggctcccctctccccctccctcctagatctagccagaggagggaggggggaggctagcgggggcagcgacggtgactacggcgcgaggcagcggcggtgacgacgacgacggcgcggggcagcggcgacggcgacgcccggcgcggctcccctcccctcccctcccagatccggtcgggggagggcggcggcggcggcaaggcgcggccgcgttttttttttttcgttcaatggattttcgtaggcgggccattatcccgactgcgaaaatcgttggactgcagacggtccaacccccgcgtaaaaaaatcacttttggtcgcctgaaaaaaaatactttttctactattgcttatggccagatccggtgacctcgcgtagtaagcaagacggtaacggcgcgcgcaaaacaacgtcaggcttgttgccggtgccgaagatcatgaggcgcgacgttggatctaaggtctaagagcctcttattttcttttgttattcctcggttaagtctaagtgtttgctacaacctttagctgttttatatccacatatagatctagacgctggatttctatccatttctttttataaaatacacctgtgcgctgctgggacagcttcagaccatagctaccattccatgatcaacacgtatatataagagcaggataaattaggtcacagccctgtaaattaattaattaatctgctcattttgcagccctgtaaattaattaattaatttgctcattttgcaggatgctttgctttgtgataagtatattattatgtaaaaaataagttgtccaagagatcttgtggttacacgttcctttctcgcggccttttgacttaatgaaattaaatttctaagatcttctggtcgatcaccgtttcgttcgtgtatgcatagcttaagcaaaatttccacttcagttttacagtctgttagttcttgatggcaacttgcattgtcattgttaatttacactgctggaagaccagcaggtaagtgtgttggttcaaataaagtctggtggaaaatgaacttaaaactgtatattattcatatctattactccctctattttaaaatgtacgacgccgtttgatttttttataacgtttgatcaaaggtctgattaagaaaaaaattaatatcatttaacatgtttatattataaatttttaataagatgaatgatcaaatgttatagaaaaacaataacattttcaaaaggaggttagtactaataattaacttgatatatgtatatcagctatgtcttagatggtgccgcgagatcgtgagactcaccacggtctcgcggaccgagggtgcaaggccgcgacttcacatccgaactagtgcgattaatcattaatagattaattagcatcattagcaattaattaatttattgttatttctttaattagcattattagtaatcaattattcactaatcatgataacgaattacaatcattaatcatttccaaaggggtgtcactgtcatcgtttgaccctgttgaggtcttgttcggttacacaaggattcgttctgggtcagaaatgatatgtataacaagaaatttataataggtacaacaagagaccgagatttattccaggttaggaatcaatttaatcgtattaggtataacaaaacatccggattagttccacacttcttgactagtggattgattcccggtctcttattctccctatcatgaataaattggttcctggcctggaataaatcccagtctcttctcgttgtatctatcataaatttcttactatacttgtcattcctagcccagatcgaatccttgtgtaaccgaacaaggcctgagactgctcgaaccgcaacacgtcgtcgtttttcttaacggttcagtgatatcgggtcaattttacactcccatacagcgacggcagtatatttgtgaaaaaaaaatgtatcccggatatttctgagaaaaaataaacagtatatttttaaatttaattcttttcttggcgggtattactatgatcacaaccaatgtacgtgctattatagttgatagatatagattgatcgtagtggtttcgcgttgttacttgaggtaggcaccgctaatggatgtcaatttgctcttgaaaatctggatgctagtatcgatcaaatcttttcattgagctgatcatatatactgatccaatcatatctcggctaagaaatataatgcatgcttggtcatccctaaggttggagatattttatacaagtcggcacacatcaagctagtcacttcggaaatgaacacaaaggcttcgttccgaacatgagaattccatcatatacgatgagaggattataattgtagagcatgattcaaaaagacgctagacgctaattagacgactagctaggtgacacctaggccagaccaacaagttaaatttaagatattaagaaccatatcacatatataataacaactaaactatatatatagcacgaaaatagcaacgaaatatcaacaaaggcagtttagccgtctaatgcatcatctaatgcctaattgtgtggctacccgatgcctagctagcaccaacttttaaaacattgttgtagagagcttgtttcaagatctacaaaataatccatgatttttttatgggcacaaaccaccaaggatatagcatcaaagccatcaagtaatatattttgtcagccaaccgagtaatacccgccaagtctaaagagcaaggaaaattttattttcttgacggctaaccattatttatgcccaactcttatagatgtcatgtgtcgatctacgaaaaatggttaaacttgtgcaagcatgtataatagtccttgtcccataatatagctatctttatgttttcatatcgggactaagaaagtgtttggaataagg

SEQ ID NO: 24262 - DNA, 11913 bp, Oryza sativa
gaccgccggccggattttttttcttttttttttgagatgtgaatatgtgatgcatttttgtgtgagatgtgaatctgtgatgaattttttagaaccctgtgatgtaatttttttaagagtttgtgatgtgtttggagatgatttgtttgaggatttgaggatttggagatgttctgtgatatgtgatgatttggatatgggaggggatggtgtgaaatcaatattcaatattaaaaacagaaaaaaaaaagaaaaaatatctttagtcccggttggtgttgccccatatttagtagatcgatttttagtcccggttatttgaaccgggactaaagatagtgatctttagtcccggattcgtagtcccggttggaaaaccgggactacaggggggttacgaaccgggattaaaaagcacttctccaccagtgacagtatgcacgcatgttgtaaaggatgttccataggggatgtttggttgctagttacaatttatcacgtgcacgattagataagtttgataaacttgatagttgttcgtttgtagctgcagttgtaacaagatttttttcccaatactagcaaaatacccataattcactatgggtaaaagaaaatatattataatatatcatacacaaaatatattttttatcagatatgttagcatcacttgtttgcttatttaaatatatggtattcacttatttgaaacaaatattagagtattccataaaattaatgaatatcataagctaatttataaaaactatgaaagaagtggtgggttttggtagtggcaaattcaccgccgccaccactagtgccttaaaggataatagaaattgggtctcatacatcaataactcttcaagagtaaagtgtacaggcgatccttaaacttgtagaggtgtgtcatctagatccctaaactctcaaaatgcatatccaaatcctagaacttgtcatagtgtgtcatctaggtctcaaatcgccacaaccccttcagaatcctacgtggcgctggtgtggcatgccacatggacatgacgtggcataatgttgattgacaaatgggacccatttaacttttttcctttttcttttttcttctctttttttccctttcttcttctttctctgtgacccgagcagaagaaaggaaaaaaagaagaatgagaagaaaatgaaaaagaaaaagaaaaagaaaagaagaagaaaaaagaaaatgacacgtcatatccatgtggtataccacatcagtaccacttaggattctagaggggatatgccgatttgggacatagatgatacgctttgacaagttctaggacctagatatgcattttgagagtttagggacctatatgacacagccctataaatttaaggactgccaatgcactttactcctcaaaaaaagtacaacaagatttccttagatttgctatggtgtagtaaaaaatttgacagtctcaacttaaataaacgtggtaatttttattggtaagtggtggtgaagtgggtgagaaactatcttctgttcctcatttggaacggaggattcctagaaattttggaagaaataaactagttcatgtgaaaatcctataaattactgtatttcaaagaacccttaattgactgtagcggccaatgtagaaacacaaataatgatagatgaacccagacttatcaaatatataaagttgtagctttttatcaaatcgtatattattattgcaattagttaaaatattagttaaaattgtagcaaaattgatagttttgataaaataatcgtagattttttaaataaaccatatacgcatttgttcgaccgatgtaagactaaaacgacagaatgacgcaatatgtgaagcgtgagatggcagtatgacttggtcctgtatatatagtcattgacatcacacacacattacggtcatcctataattaatcggacgtgttggtcgtgtgtataatattttccttttgaaatttactctttaaaatatagaataatctaggttggcataagcccattaattaaacagtgtattttctgaacaatgtgatcgatgcgatgcacagtccagccagcgtgcacgagagcagtctagcacacgaaagcttctcaaacatattccttcagtgcggagagcgaagtcgaatccctcccgccagaatcaaagcacaaaccgaaagcaaaagaagagcacgacttttcccgccaaaaaaaaaagaagccaacgacgcggcctctctagtagagtagtagtctctacaaagcagagcatgcagtagtagccgtcatagcatcgatcgccagttcgccacagcacaatgccgacgaggaggcgagggatcgcggagggggggcacgccacccgggcggccgtggtccggtgcatcgtcgccgcgatactcgccgccatcgtcgtcgccggcctcgtcgcgctcgtgttctggctcgtcgtccgccccaagcccatcgagtacaccgtcaccagcgccgccgtgcgccacctcaacgtcacgccgcgcgaccgcggcccgggctgcagcgcccccaccgtcaacgccaccttctacctcaacgtcacgccgcgcgaccgccgcccgggctgcagcggccccaccgtcaacgccaccttctacctcgccctcgccatcgacaaccccaaccgccgcgtctccatgcgctacgaagacagcgtcgcgctccgcgtgctctacggcggctccgagctggagctcgccgccggctacgtcgtgccggggttccaccagccccaccgcaacgagacgacgctgccggtgcgcgccgtggcgcgctcggcgccgttcccggtcccggtcacggacctggtcgcctgggagctggagcacgacctcgccgccggcgagctgagcgtggacgttgaggtgaccacgggcgtccggttcatagtcggcggcgtcgcctccaggtactaccaagtcaatgtgacctgctcgccggtgaacatcggcttgtcgccgtcggcggcgcggtccttcaacagcgtgccgtgcgacgtcgagatctcgtgaggcaaccaaatgcatgcatgtttccgtgtccgaccaaagtgatcgtttagtttggattggatttgtttatattttacagcacacgatctactatacttttgatacgtactacctccgttccaggttataagactttctaatattatccacattcatatatatgttaatgaatctaggcatatatatgtgggtaatgctaaaaagtcttataatatgaaacggatgaagtatttgcgaggttgtaaatttagctctagttggagtggccttcttttcttcatcatctcttttaggggattatttatttatttattacgcgatatgccattatattgtgctgtgattttacatgtttgacacatataacctctatttttttttcatatatgacacaattgatttttttctcgaactttgatcaataatatttatttatttagttgcgtacgggttccaatactaacattgcctagagatgccatagcttttctttttaagattgcctaaagttagatagtcaaatttgataccacacttttgctagcaaactacaatcttttttttagacaatgaggtgcggatttaagacgttgaaaagaaaatattgtcataaatgtgacaataaatcaaacgtatggataacttagtcaaaactacgtaagttaagatacgtcaaagtgtaaccatataccacatgtaaattggaaaagggtatgactagatcttttatcgaaagtattttaaacatatttaatatgtttgtccatttgtacaaaaacttttagaaaaatacgaatagttaaataaattagaaaaattcaagtacattgtgtattaaaaaaaaggaggtggtatatatactgtcatgctcgtttgctgagagtggcgctcccatttgggagagttgatcctcctattcaatgccttatcccaaaaaatggcattttttacatatatttattcagatcaaactcatctccttttgtttttgcttctactatattgaaggtattgcgccttttttttttgtcaatttgttctggacttctagctagccattgtccttggtcagctgaccttacagctacatatattctttgagtgtggctttcatttcctaattcctcaagtgaacagaatatatagagtaatagctagtagctctttctaatcctttccactttattaccttattacctttgtctttttggtctttttcattgaacacagtgaccaccatgctagctagctcgtcagtgggggcaaaaacaagtagcctctcttcttcatccagaatgtcctgcaggtagccgttgattcagggagacatttgatgtaatgccactaactaattattaccacaataaattatcattgcttgagtatcgtaattaacttctactttggacatgtggacacagcaaaacgtacatagatactctgtctgctgaactacgtacacagatggaagcttctagtatgcgatcatgctaattaatcaactgatcactttgctttgtgtgaagaagggagagtccatcagattatgcaaactgatgaactgatgtaataatcttcctcgaccacatgatacatggtccgtttgacattttgcagctagcattgtgatgaatatcatctctgaatcttcaatgggttcttacgcacacggcactgatgcagagttaacataactagctagctagttccatcatgctggagagtgtgtcagcactaacgtttccttctctgaccggctttctttctttcttctctgtcaactaatttctctcttgcaagataggattatatcgcgccgtcagttcagatttcagaggtcagtctatcttccattatgcttccaagagactcgaatttctttctcgcaagttgaaaatgaaataaagggcgacaagttgtcctgaagttagaataatggtcacggcctatatgaagtctagtggtatatcggtgaagtctgaactctgaagactttcagaagctacaggtaatgatgcacatggagcctgaagatgttggaatgtggcctggatagatgatggcaatcgtaactttgtttggattacgcgatgtgtgggttgagatgacagtaaagtagtgcgatgcggtgtggtgcgtttcagtgcccattcgttcagtttgaaatgatgagatgaactgacgaccatagagaaacatgaaggcgttatgcttgctttcagtctccactatgcgtttttggcaaaaggagagtttttgattctatacaccgatacgttgttcaatgtgctaaattaatctttataattatgcatttgtggagcgaattcttctgaagtagtgaatgagacgactctcctctccacacattgtgcacatacctttggatgtttgcttgtattgctaatataaattctgggacattctcagatcagtgcagctttctgaggagcctgactcgctgacatagagatgggagtcctcagcggagtattctctctgtcaggggagttctcagatcagtgtcttgttcttgggaagaattcgcttctagcacaagccaatttgaaagtctttgatgtctcctaggtgccgctactttctatggttggtcgctctgaataggtgctggatggcagaccatcttcggagccacggcctgtcgcaccctgattgttgtgttctctatgatcaatgcgagaagactatcgatcatcttttggtcgcatgtgcagagtctcatcagctgtggtggattgctcttagagcgattgggcattcagactgcttgctgatcaatgaatcctcctttcacctgtggctttgcgacagccggagaaagatgatcaaggaactccatcaggggttcgataccattgcaaccttggtagcgtggacagtttggaagaaaataaacaatagagtctttaatcagcagagcagaacttgggcggaggttgtaagggccatggcaggcgaatcagaactctggcgtttggccaaagcagtaattcctccattgatagttccaacggatggagcggggtcgccaaatttatctagagaataggcttttgatctttggttttctttatgtactctacctccctgttgttttcttttttcggtctgctttgtacataaactttattccttcttaataaaatggcacgctccttacgtattccaaaaattaaattgctaatataaattcagtctacatttcacacggaacaaaatctgtcccttaattaaaagattgcctccatttcttcaggtcagatgatgcaatctttagatgtgattttaaagttcggtttgaatcaaaatctccatgatctctcctagtatatctacctacagctacttcctcaagagtcaagccacgaccagagatcgtgcatacgttgatagctatatctgacagggttgaatctaagaggatatagatatagatgaaggtcgaacaggtggagatggaggtgttatcgcaggattggccgattgggttactgatggatgtgacggcgagcacagcccggcccggccgggtcgccgtcgccggtcgtcacaggtggttcaattctcccctgtcgcctactctctccgtgtaaaaaaaaaaaaaagacaaaccccttccgtgttcaacatttgaccgtccctcttatttaaaaaaatataaaaaagtaaaaagacaagtcacgcataaagtattaatcatgttttatcatctaataataatgaaaatactaattataaaaaaactcatataagacggacagtcaaacgttggacacaaaaatttagggtttgtttttttttttttatagaatggagggagtacgaggcgaggctacggatgatgacgcagcgcgcgtggcgcagtgggagcgattgcggcggtcacccggtgcgccccaacgcccgacactcggcgcgtcgctgagatagtatgatcttggcgtgtcatcgccggggatctgccctacctagctcgctttgccgatatggcaagtgtgggatgtaactaataactacccaattgtttcctagctagcagaagttactggctaaatgcagataatgtttttgtgttttggttacttctagatgtaagatatttttgtctgataaagtagtacatgttctcttattttcactgtttgtcctaataaaatataaaacgtgttttttttacacagtgcagggagtaaataaagcacaacatatcgagttatttgattgtttttctggcccatccgtctccagaaaaaaaaatcccattttataagaaagacaactcgtccacgtatatataatccattaagtgataaaataaacctgacctctgcatcaactaaacatatattcaaaggaaaaagaaagggaagaaacataagataatatgaatgtatcacgccctgaaacaacgccttcaataaggatccaaagtttgttcgctgatattgttcgaacctaccagaacaattggtattgaatttttatctagtgacatatctagaataacggcttcaacaaataattgacaaacgcttacattgtcaaagctagatatataaaccagataagggattgatcacctcgaagattcttgccaatggatcacgatgcaacctaccgcaaaatactccctccatcctaaatatttaacgccgttgatttttttaaacatgtttgaccattcgtcttattcaaaaaatttaagtaattattaatttttttctatcatttgattaattgttatatatacttttatgtatacatatagttttacatatttcacaaaagtttttgaataagacgaatggtcaaacatatttaaaaaagttaatgacgtcaaacatttagagaagaaggaagtatatagcaattggtcacaacatatgcccatcgtcttctgcccaccaaaatataaccagagaaggaccacacttgtgatcagtcacaattgccaagccaccttgaaccatcctcgaccgatcttctcgatcgcaacgaatgtcatcccccgtgtgactaccttcgaatgattgtcattagcttatagtaggattggagttgagtcatccatctagagaggcaccatcccttcactaacctgtcacaattggatatatgcatgaggcatgtcgttaataactactcatccctttcatattataagtctgtcagagttatgaataccacatatcaaatagtagttgactaaatttcggcaggacccaccacatatcatatcttatatgaaaacaaccttcggatatagaaggagttccacataaggaaagataaatagagttctacatggaaacgacaaggattactcagattgtatccatattggtttccctagttctacttggaaaagggaacacatatgggtataaatacaagaccctctaggaggagagggggacggaacaatagatcaagacacgaaacaataaatcaacatacaagccaacatatgccaagacaagacgccggatatcgacttcagagataagcatggctagtcccctacggtgtctatggatattgataggagagacatagtgttgtctttgatcttgccggatgcggattcgaggaggaaggctaccctgttgtcgactacgagtcagcacttcagaccgccaagtcgacaacaattaaataggctaccccaaatattgtgctggcgtgattatgatgaataagagcaacgaccggcctcggccaacaggagtagggttattacctgacaattcaggggtccgaacctatataaaaatcctcatccccatattttttattacaatctcgcatatatcctagtaccaacgatccccatactatgcaaataccggaatcgcgacatcaaacgtcgacagtggcgcgccaggtagaaaaataacaacacttataacaccaaattagtctcattacatctaacattgaacatattttgacagttttcttattatgtgataaaaatattactatgtttttctataaatttagtcaaacctaatgaaatttgaacaatattgtagattgtttgaagtagggagcagatcatagcggctaggctaaaaaatgcctttctttcaacaaactagatccactaacgtcaagtaggtgtagaaaaaaaaaggccatatcacgaataatgcctgatgcatgttatttaaaacgggaatgctagaggacgggatatcatcccccaacggaatagctcttctccagaacgcgattcttatccatacactcactcgccgccgtcgccgtcccccgccgctgccgcgcccgtcccctgtcgccttcgcagccgctgccaccgccaccgccgctgtgcccgtcccccgtcgacgccgccaccgccgccgcgcccatcccccaccgccgcggcgtccgtcccccatcgacgccgccgctgccgccgtgcccatcccctatcgccgccgcacccgtcccccgctaccggccgccgtcgccgcgcccgtcctctgccgccgttgtcgccatcctcgtttgcagggggcgaccgcgcgtgtcggggtgctcctcccccaacgggatgcccagctatatccagtaggaatcacctgatacctggtaggtatcatccgttaccttgcaagtatcatgtgatacatggtagaaatcatctgatacctcgcgagtatcacgcgatacgtggtagaaatcgtctgataaatgacaggtatacctcgtgagtatcacgtgatacgtggttgaaatcatctgatacctaacaggtttcacatgatatcgagatcatcttgttgtgtagaatcgtctgatacctgataggtatcacacctgatacctactcgagatcaacccgttcgaaaacgggattccgttatatagcagccccctatttaaaaaggagagaattatgcacacaaatgtaaaacgaattgtgtttagagtcaacgggagtgattataacctttgctcattttcttttggctaagtagtaggacctgtaaaaagtactcgtaacaaaagctgtaacgcgtgtcacctagcgttgggtagaaagttgcaaacttgcaaatgcactgagacgttgtcgatgagcaaaggatccgaatattcgatcactgcgcgatatgtgtaaagagccaaagatcaaattaagagtagcacttcatagttcaggtaatggaatccaagtcctttcctaaagtttctcattgcaatttgaaaagcagaggagtggcaaatgcagtggtagtagtacatgccaaataaactggataaggcaatatcgccgaagtgaacaaacacaaacaaaactaactaccaaaaaaaatcaaaataaaaaaaacaaatgttaatattggaggagagagagaggggggaaaatactgcccaaaaatggggaagcgaaaacgaggagttcgcggctcatttgctaaaaaaagatgccaacatcctcaccgcctcctacgatttcctcgcctcggcgccccaattcaatcctcggctccgcctcgtctccgcattcgcagcttggcggccatgaatcgatgatccgcaccgcaccgcgccgccgcgcgcgcggaggagggcgatccgggcggccccgctttggggacggggggtgattcggtgtccgtttgggcgcgaataggtttggggaattgagagagggagggcgagatgtcgacggagctcgatcgtcgcggctcatcggatcggctccgcgagcgggtcaagttcaggttctccggcttccgcgccgttcaggtcaaatgtttttttctcttttcttttttttccgcattgagcagcgctgcattgttgagcgattcgtaggagatcagtctatccggggaatagcgatgaatgtacgaccctatgtcgtggtctgttgcgagattgagcattttactatcgataatggtcaattgttgtgtgaaatttactagaaaaaaatcaatgttgtgactggtgctaatgcgttgaacagttttattacaacacgcattgcttgtaagtaaaagaaatgtatatggaatactttccctccttagccatgctgttttgttttgattcggcaagagaatgcgacgatatttgttttagatgaaaggtcagtgtaatgatgatcgtggaaagttgggatggacctttaatctgattatgcatcatggggtgttctcaagaaaatatgtatcgcgaggttgtgggaggttaaattagtacgatgtgggaggcaagttactttatgagcattttttgcaggctccaaatatgtaaggtcatctttggtaagtggtgacaattcttttctcaaatatgatattcctaatgtaactatgatagtttgaatagaaaagggacatccaggtttcaacatttctgctaagttcatgtaactatttttctagtagcaatttcatcgagtgtgacttggtgtgcacaacaatgagtgtacttgagtaccggtgcaaaatggaagacatatgtttctttcccgatgacatttcttattcccgatttgtcagcaggttccagtagtatcagacaggctgatgctttcaatagttgcagtggacactggaaaaacaattgccaagtccactaaagccgctgcacttagtggagcctgtcaatggcctgattccatcctggaatcaatttggttttcccaagatcaagtgtctgaagaatttcaggagtgtcagtgcaggtttgttgtttccatggtatggctattgttcgcatgaacttgccttcccgatttgcatttatgcactgtactgttgttttactaataacaaatcttatgttatagggatc

SEQ ID NO: 24263 - DNA, 2474 bp, Oryza sativa
tttattcctagtagtaacataatgccagctcatttggattttcccaaaagagaagtttttcacatgatcctctctttcagatatgctttttagtccatctaactgtaattcaaactaaaccatgtgaagttccctacagttgatagttctctaataaagctcctttcatgttctgtacttctgtttgttgacctagcatataagctatttggttgttggattttcaaaaatgggactgctattgggcagtcgtgtatgtgttgtacatacctgtgagttttcttcttttgtttctaacaagaaagttgcaatgcaaaacattttggcttttgagatgctcacttcatgtgctagctgactggtatgaaccacctattgttatatgagatgccacaagttctactgccatcggggtgctgggtttgagggactttctaatggcagcttatatactatatttcgtttcttgcttgaatcacccacccacaaccaaccccccaaaaggtggttgacaagtaattttccccatgtgtaccacttatgatgatctccaatgtttctcatgtgcagcttaacattcaatgtcttggagcaaagtctaaaacaaggtaactgaatctcttttatattcttttaggggatgttagtaatgccttttattactccagttgattcagcaaacatctgtatcttaggtctttagtggtcactaagttgatagccttaactgtcactatttcttgtttattgacagctcataaaacttgtttttctgtttcatcttggcattatatggcaatgtgaaataatggaatgaactatctcctcgttttgatgattgtagtcgaaccaatgatgatacagagtgcacatcagatggctttgacagcatgctgaataggactactcattctttgtcaggaaatgacttaggtggttcttatcaagatgaagctggaaatagggtataattcccttactcaaaactcattaatgccaattctttttaagcaatattatgttgggggacaactaaagcttacatgttttgtgtgagttagtccagatatactagaaactagaagagccacaaaatgtagtgataatgtttggatgagactctacatagcacagattgcaggagctcccggtgtggtgctcaacagcccgcatttgattctctccaaagtccaaactaagtctttatacaccaaatcaatacccttcttaaaaaagccatcgacactaagtccctccttaatgtcccactttttatacactgtttagatgccctaaaaatatattatttttttgcttgaacagtcatatccattgatgagcagcaggtttgaccaaaatagtttttttttataagctgaaaataagagctagtcttgttatagctaatatgctgctctttatctgtcccatcttcgaatgcggatagaaaggatctattacaaaatttgcatccataatcttcttacatcttacattttcaaagcacactttcattagacttagtgatagcttcgattgtcagctatcttgttattggatttcagtgcctgcctgccgctatgctttccatattatctttataatgtaactacttccgtatgttcaaaagagcctattgtgttttgtactcttctttcttacgtactatgtgtaaatggctaaatgtggactgcatacatgatttcaggatgcaagtttgtcagcatcaaggtcttattctggagatagtaccactgatagaacaaacatgcctcctagtgacaacttgaatgatgaattgaatacgcagaggcataattttgctagtccagatgccatccatgttagtgcagatcatgttgacgaggccagtagatcaaacaattcatcattcagttctcaaactccatctcgaaacatgctgcagggtaataatgcacaaccatctgcaagtgatctttctcagttatcatcaggggtatctcatgcatccaaagatgtccttgaaaatgctgaagagacaattgatgaactacgtggtgaggcaaaaatgtggcagaggaaaactcgcaaactcaaacaaggtctagagacattgaagaaagtaagtactgacaaatctaagcaacgttctgagcaagatctggaaaaaatgtggcagagaaaaactcgcaaactgaaacaaggtctagagacattgaagaaagaatgtgctgacaaatctaagcaacagtctgagctagagctggaactttctatttcaatttctgagcgagattccctaaggcaagaaattgaagaactgaaacgttctttggaagaggtaactgcacgccaaactatttcacgaagtcccagatctggggatgcgattgagctccagaaagaagtggaagatgatgtgcagtttctgaaagaatcgaatgcaagcttagcaacccaactgaataaggcccaagaggccaacatagagc

SEQ ID NO: 24264 - DNA, 928 bp, Oryza sativa
agcagacaaggctaaacttgaggctaatcttgaagatgtcaatgcacagatgatacattacgagtctcaattggaagatctgcgggagtctaaaaccaagattaaagacctagttgactcacttaatgcatccaaacagaatgaggaaatgctcactacagatgttgacaatatgagaagatcgatagaagctgctagatccaatgaagataacttaaggaaaactttgtgtgaactagaattgaaatccaaatccagtgattatgagaaacagcagataattgaagaaatttctgtactgaaaatccaggtccacaaaatagcaggcctccaagatgaagttcttacattacaaagttctcttgatgaagctaagtttgagaaagggaagttggaagggctgattcaatcattgtctgaagaatgtgaagaactaaaggcacaaaaggggatgttaacagacaaggtctcatgtatgcaggacactttgaatgctgccaatgaaggaaaacaaattgaaatctctgcacaaacaaagcttgtgatgctaggagatgaaccaccagttaaggaaacatcagatgtacttgaagctgagctaaaaagtgaactaagtattatcaggggagctaacagtgaataccaacaaaaaatatattctcttcaagaggaaaatgaggatctcacaaggagaaatcagcttatggagaaggagcttgacctgaagacaagccaaaacaaagatgaaaataccaataaacaggtgagcctccaagatgaagttcttatgttacaaagttctcttgatgaagctaagtttgaaaacgggaagttggaagggctacttcaatcattatctgaagaatgtgaagaactaaaggcacaaaaggggatgttaacagcacaaggtactcatgtatgcaggaca

SEQ ID NO: 24265 - DNA, 1249 bp, Oryza sativa
agttttattaatagtctacgtttaatatttataattaatatctaaacatccgatatgatatgtaaacatccgatataataggtacttaaaaaacttttagtcccatataaagacagtaagctggtaactattgcagtcgaaaagttaaacattctgtccagcctcttctttctctcctttttactgacatcatcctgcattacaatcgggcgataccagttccattaacgctgaacagatcattataaatgaacaaactcatccgcatacgcacgctggtccaatactaactatagagtagtactactacactttgcatgatgatatctatcccgtcgcacgtccacatctgtgaccatgatccaactttctacccgcgcgcgcggcgtcttccaagttggcagacaaaatcacaccacaccacacaataccagtgcgacactgagccctggccggctggccctgccctctcaagacaaaacttgacaaaacaacattatctgatcctctctatcgaaatattgctcttataccaactggaaatttacatgtacagtgatgatggtgagttacaggttttacatatgactaccaaaattctgctgccctcgcagctgccactgccgtggcagtggaggaagacaaataaagaatcgaatcagtggaactatgtgacataattttataaccactatatgaacaaggaaaaccgaatggatccagtccaggcagcttccagcttcaccaagctctccttcggagatgagagggagatcgaagaggtgagaaacaatgcgtattcacaacaatgctgcgttcgcgctttacctcttccagctgcaataatgtgttcgattgccgtatgacaaaacatggtctggtgggttgagtctacagctgatgttgatcagaagacttcctgattgtcattgtccaaggggtttctgcttgtaaccggacttttgtctttccagcaacttcaccttgttcttgagttttttgtccaatttcttaatgtatttctcctctctctcacggtcagcgataccaggccagaacacctgaccagtcagtggccacagccattgatcatccccagcatgcatgccatcatccgcttcctctgccagatcctcatccatgctcttcagtagggtgaaattgaagaacttcacccacatctcatttctatcatcaagagggtgctgctctctgatatctccggtgacaggatttaggtaggccatct

SEQ ID NO: 24266 - DNA, 3073 bp, Oryza sativa
aggtggtctcgtcagtagaatgtcccataaatgataggtagcatatatcttacacaagtttagatgatcagaaatggtcaacataagtaaacttgaactggggggatccaactatttatggaatagaccagtactaatttcagcagcagacccaaacataccacaatctttctcagaaaaagtacataaaacataaaaaaacaattaagttcacaacttcagacaataaccttgaaacctatcaaacattcaaactcagatgagcaattttaggaaataatcccccttatagtatttaagcacagaaatccataagttatgtacttttttctgacagcgaaataatccataaaattcaaaaccactgacagttatatttagacaatcagtggaaccaagataagtgctagtacatacctatttctctgcgtattatttccaacctcctgtaattattttccaattagaaaatggataaaataaactatcaagaaattggtatattaactgatcaaatccaatacctcttccaacatttctttcaggacataatgagtctgagagagtacttcttgcaaaaagaaactctgcatcttttcagccatgccaccgatgtcacccatcagcgcataggcatcaataacctattgtccacgtgtaaacatataaagaatggaacctgtaaatcagcaaagcacatagataactaagacttccctaacaactaagccaatcaagggctcacgaggaaaaacaacaatggaaatactcacagttagatagctttcctcatggaaggtctgacaaacccctagtaaatgggtgtctaatttttggattgttcgtgccaaccatgcctgaggatgtattcatagtataaacaccatcaaaaggacaaacattatacagctatttgttcaatttgatggtggacaagtttcttttgctctttgaacataccaaaagaaagctttgagatgaagataggttcaatgcattctacacttgacatagaagcaagcaataaatgcaataaaataataacaattacctcaatcccacgccccatttcttgtacagaagaaaggcctgaatagttctccaagatttgcaaatattcaggcaataattgaaacgcctgcaaacatcagcaacatggcataagaaaactaccataaatataagaaggcataggtgattaacagcataagaaacaactactgtggtagttcagactgtggagcaaccaacatactacaacaggtcaggtgatttatggggttgaaaactactggagtaaaataaagcagtagctaatatcaccctagagtaaaagagatggattcatgaaacagatagagaaaacagcagtcatggataaaattcagctcacctgaaaatagttttctttctccacaaaactttcaagttccatctgcatgtcttgtgcattacgaagttctgtaagaattggaagaacatcctgcgatacagaaactaaatcttttatttataatcttcaattcgtgtagctaatggtagcgattacttaaatattatatgcacatgaatttatcaacacaattaataatccatccttgaaagacattgaaaaaagaagggttggaccagaaacatataaacacattaagaatattgcttcacagtagaatggtagttcagtgattgacatgtaaagtctggcgccaatcaccattcactaagattatccagtcgatgccgcaaacaataatgagacaagagaatttatttaccagcaaagcttgtttcttctttgattttacattgacaaccagatccctcgatacctcattctttgaagaggatacatgcctccgtccattctgtaatattgattaataaatcgtaaatgcaaaaatataaaaggaacagaacaatgtttgtaaataccatccagaagtttcatgagataataccatgcagatcacatttgcaacctttaaatcttgttctaactccatcactaactgcatccccttcactggccaaaacttattatcagtgatctgggatttccttaaaaggaaatcagtatagatgcatttttggtagcataacacagaacatgttattttaggaaaattgagaaaaatacttataacaggtatgtctgaaaactagaaataaaaggcatgtgattaaaatatatctaatatgacacagcaaagtaaggaaccaaaaactgaacctcttctatattctgatgggagacatacccatttcttcatgatgacccataacatgatgtgatagtcgttctgcaattttgtcgagctgcgctaatctcaaagtagactgcacagaaaaaaaggaagacgtcaattttgctacaaaagcacacactcatgtgcatggatgggcccttttgttggaacatatgttcattggcaagaacattgctcgaacacgacaagaagtactcggtttcttctacaaagggcatgcgtgttgtttgttgaaagaaatgcttccagctatcattaacaaagctgtatgcaagtaagcatgcaaactccactcactctttatcatacccaccagcactaatgtctcagacatgaaaaaacatgtgaaggtaaaccgctgcactaacctgcttatcgaaatagctggaatcaccctctgcagggatactttgcagaatgtactttattgggtcgaactcctgcagacaattcaaaacacatcaagcccaactggctgaaagccgcgggaaaccacagctgcggaaatacaacacatacctcctgaaagaacacctcctcgagctcatccacggcatgcccctgcgggttgctcccgtagatggagaccaagtcctccgaattcgaaggcaggctgatcttctcgtgcggtggcagcccagcgatcgcacgtgcggccgccgctgccgccgcagctctagctggaacctagaccggcgaattacaaaaatgagcaacctctatcggatccaacacagggtacaccgagtgagagattgacgaaggtggaggagggaggaagtgattagggacctcggggcggaggg

SEQ ID NO: 24267 - DNA, 1340 bp, Oryza sativa
ggctcgcgcgcgcgcgtcgtcgtcgtcgtcggtggcctcggcggccggtcggatcgcgcggggggaggagagagagaaagagaggagacgagaggtggttggtctcgtggcgtggcgtgggtctggctgggcttttttttccctcgcggtcgcggcgatgtgcgtaaagcggaggagaggagaggggagggggcgagagaggagcagaccagtctcgtgctgaagatgatgatgctgagtctttttttttctttttaccttacctttgttcctctccaagttacagcgcagtttgttacaacctccgtcctataatacttatcgtcgttttgaatttaaatttttgtttgtaacatttgatcatttattttattttaaagtattatagaaaaaagctaatgtttaccattagccaccacgagtgatgataacccgaagatgatgtttgaaactaatgacaaagatgaatattccctccgtttcaggttataaaacgttttgactttggtgtttgactaaatttgtagaaaaaaatattaacattttcaacccaagataaatttattatgaaaatatattcgattattgatttgatgaaattaatttagtattataaatattattatatttatccataaatttagtcaaacttgaaacattttgattttgactaaagtcaaaacgtcttataacctgagacggaaggagtattaagttagcccacataatgtgtaaaaccagtagtacatgattaattaagatttaattattacaaacttagtaaataaatattttttatattttaaagcaacttatatttatatatagaaagttaacttaccgtttagtagtttgatgaaaaacattatagcaaaaatcgagataaaatttaaatcttaataaaaacaattgaaggctcagattattgtttgtgataaaagagttttccactctcctctaaaacattttttcatggctttcgtgtgaggtgaacagtacaacaaattaagttacttatgtataattcgggatggtatattctgatattcacaatacctacacctcttattgttggaattgtggataaaacacatcattatatccttttagtacaacataggagtagatcttaataaaggttcggtccatagatgcactttcatcgtaaatatcctcttaccatttacatttaacccactaacaacagacataaaagattttaccatttttccatggtttatcagccatagcaaacgatcaaataaggtggtgtttagattcagagacttaactctagtccctgtatttatacgctattttagagtattaaatatagatta

SEQ ID NO: 24268 - DNA, 753 bp, Oryza sativa
cattcttaaggcataaagcacgagatatgattattcataatgccggtcccaacgaagagtcatctgattgagcacttggaaaatcactcaaaaacggcgagggggaaaccgatccataagcctcccagatgggcactcataagccatgtgaccacgaccaccgcagttgtggcagatcatgaacgcaccggccatgcaatcacggctcatatgaccaacctgattgcaagcacggcagaccacatcactgtatccaccacggaagggaggaggcccacccctctcattgatagcatcagatttggggcactctcgggccaaatgtcctgacacgttgcataggttgcagacgggctcgttagggcagttacgagcaagatggccactcttcctacagttgttgcaggccttctcattggtgcattccgcagcaaggtgccctggtttgtagcagttgctgcaaagcctcatttcacctggcagcattggtggagcactgcattctcttgcaatgtgacccgacttgccacagttgcggcatatcccttcatttgggcagctgttagccatgtggccaggttctttgcagttccagcagagatctttggaagaacactctgctgcaatgtgcctgccaaagtaagcattagagtaagtaatgctagctcacagataagaaggtgaagcatgtaagcattcttgatcacatgaaactataatctgtgacttaaaatacaattatttaattccaca

SEQ ID NO: 24269 - DNA, 686 bp, Oryza sativa
tttcatctccatgaaaagcctttttttttttgggctgccatgcctatgttttccttttgttgttctatgctttccatgtgctgagattgcttgaacacttgaatgaggccgttttcaattgataatgacatggaaataagttttaaacattcttatgtcatcaggtatccttgtctgaaaaagccgaagaaaccttagaggaaactatggctggcgaaaataatgaggatgttatatactactgggcaccaatggatatggatcaaacttcaaacttttggtcaatgtgtgattggctaaatgctggtcgttgcaggtgcttttttaagtgttccctttcagtttcttttatgtcaaattcgaggaatagactgaagaactgttgtctaactcattacatgcttcttagtgtagtatagcttcaaaattggcctgcgagcaaggagtagtgatgttggttactaattttcctattgctgtttgatgtaatatacagttctatgatgcactagttgagctattttctacaatattccttttcttatcctgcctgcttagttttcttttattttgaacgcattgtttttttttccagaacactttttgaagacgcattcagaactatgtatgggctctcagatggcatcacagccctgccaccaatgcccaatgatggtgattattgg

SEQ ID NO: 24270 - DNA, 651 bp, Oryza sativa
tatctgtaccgttgaatctgcacttgttaagtccacttgtttgaaactcatggtcactatgcgccaagaaaaaagaaaagagttgattgccactgttagtgccactagcaattaacttctctgcatgttactctgttcttatattcttttatgttgatagttaaggatttggtcaccacttatgtttgttttttcatgcattttgtgtcagtcaaaaggaggtaggagacccagatcagatgatgtggatgccgtaactcatctttcagttctggacaatccatattactcagatcgtctttgtgaatttggtgctatgtttgccgttgcgaacagaatcgatgctgttcacaagttaccatggataggtttccagtcatggcaggctgctggaagaaaggtataagttaatttctcatagaatcatgtgctaattttggtcatattggattggcaatttggcattcttcctgctgaactttttttttcacagatccactttttgtcctttcattcaaactgtggaaattaattcgttcttgtattattgtccaatgctattattatggatatgccttatagtggctaaagctacttaaatttgtggtgttcgatatttttctgtactatgaactagacataatttttcac

SEQ ID NO: 24271 - DNA, 8943 bp, Oryza sativa
tcatgttattgtagtgacggtctgacgatactgtggacctattaaattagctgagttactgtaagaggctgatactgaattttgctgagttagtcattttgctttaggttttatactgatgttatatacttcccagacttgtttgcttttactctgtttgttgtcgtagtatttaatttgtgtacactcattgcctgaaaggggagctcatattatacaccttgacccccaccttgttttaaacttttaatccttcctccatatatatgtaagccttatctgattcaagtagcaactggtgtgttttgtgtatgttttatgcttcttctggtgtatagggtagggtatggcatccaatagttcattcatgccaaactaacactaggtgtatagggtatggtatggcatccaatagttcattcatgccaaactaacactaaagatcaaagatgacaataagtgcaattttttgttcttttcttcttcattaatacaacatgcatattttctagttattctcatgtatttgatttttttctgttgcattattcacatggctaatgtcttgttatacaatgaccatactacatgcatctctgtttcagtgaatagatgaaagtactacgtcaagctacaaaaccaattcaaggctaagtaaggttaatatggagtactgacaactggtcaaatatactatggtggcgcttactttgctgtatcatagccatctattcagagcatgagaatgttgggcaatgtcagctggctgctgtcagagcaatgaggcctttccaaagcaagcaatttagcgaccaaagaagagtcttattctcaatgattagcacctcagtaggtaaccaaagcaagcaacaaaaaaacagaacaaagagtgcagtaaaggtagaagtttcttttttttttatggtctacaatttgggcttggttcggggcttcgagtgatttatactctggagatgaggatgcaaattgacttctttttcttttgtttgtgggaagtcagcacctggagatgaggatgtacccgttgcagttctcgttcaaaactttgactatacagagaaaaagatatcaatgaatgatcacctacaaaggtttgcttcaactgctcagaatggttcaatgaaatattcaagatcagatagttgaggcaagaaaatacaagtgcttttgattactctgaatatgagcatgactgctgtctttagtgggtaaaaactgcggtggcagaggtagaggacacaatgatgaccaaggagaagcttgcaagtaagatggggactggcttttgtccaaatacaaaggtcaactgcaaccggtgagcaaacatctctgccacttcatttgtcttgttgactagaaatgtttttccagcataatttttcttgtcccagtcctggcaatttaaattttgcatgtggtgtttgtaaccagcgcggaacactggaactgattgaccttctgatgttttggaataggtactgccgtcctggaactggcagtaggggtggagaccttggcagaattgattcatggagaagtcacttccccctgtgctgtttggaacaaatgatcaaccatgtccaatgcagtgaagtgagagcaccttggtaattgctactgttgttctcttttccaacacaagtacatatgatttaacacaggtatctctaagtttcttggtgcaaactttgcattgttttttcagagaatctcttttattttagacgtggcaaactttgcactgtttatttagagaatttctatcatttttagagaatatggagaactacgtatcttggcactaaagaaggagcaagcttgcaactgatgttgcgaactaaagctatatataacctattcagccacccataggtgctccggcaagtttctaggtcaactttgcattgtttatttccttgaaaccatcttcacattagcttttggtcttgtttatgagcaaaactggacacataattgaaatcacactactttggccattatgtctcatgcaaacttatgctaaatgtcaggccatattaacacaatataagtggaatttttgcaagaagctaaacacttgctagcttgttattcttttcaattgcattctctatagagatgacatttccttttatcaattgtaaggtgatgttcatccgagggaaaggcaggagcagagaagacggagtcagggaccttggaatagaaaggggaatgtatggggggggggggtggaataggagatggagtacatgatttattattttagaacttcaagtattttgcttggtgatgtatttgttaggacttgagatttttcacaataaccattgtacatggactgttgtcggactttgtgctgttaatttggtttcaatatttgtttaccgcatgcatgacccgttttcacaacatttggctgcagcagattgagcaaattgatacaggatgtacattaaacttgcactggtcaaccgactgtacagtattagtgtattttatgtcgtcttacggcatatatttcaggaaaactatattggaccgatctaaggcaagttcgtaaacatggacggttagtaggcccaatatgatgagataatcggccattaatgggccttttctaaccgcaaaggaataagatcactttgactccctcaactgaccaccgaatctaaatcgtatacctcaaccgcaatacctgaaatcttgaccctcgaacttgcaaaaccggtgcaatgtgactcccttggtggttttggatggtggtttcgctgatgtggtgcacacgtggtagtgttgacttggtctttgttctacgtggcattgacgtggtgcttatgtggcattaaaataaaaaaatatatgcgggacccatttgtcattcacacaaaaaaaaaattgtgggacccacttgacatgtggatcccataggtcaccctctcctatcccttcttcctcctccccctcctcccttctctatctctcgctctttctcttcgtgagtggggagcggcggcggcgggcgatggacggagtggcagccgacggtcttcgcgccgccgccaccgacatagtagcaaggattcggcttcggcaggtccgggactggagcggcgctagcgccacgggagatggggatggtggcggggcgagggcatggcggcgagggcaccttgagcgcccgctcagcgagggcatggcggcgagggcacaacagcaacgagcaggatgattccggcgacgatggcgcgaggcagccgcggcggggagggagcgagccgggcacggtggcacgaaggaatgtgcgcggcggaggacactgagcgcaccaaggaagaggtggaggagcgcgagaacgctgccaccctggcggccaccgagccccctgctcttgccgccaacttctcgagcctccgtgaggccgccgcgggcacggctggcggcaagtccaagaggaagaagggggcggtctcgcggcggacgtggtcggggaggggcacgtgtcggaggaggaggagctccagtcgctgctccgcatcatggccaggtcgacgctggagcgctcaaggccagtctgccgccgcgcgttggggcgtgcgagctattgctccctttccactgcggccccgcccgcctcccgtcgacgccgcggccgctgccccctcattgccctcgacacagagtggggacgaggagcggtggctgggagcgtgctcccatctcccccgacgcattccgtcgcacgtcgcccgaggtccaccgcccaccgcagccaccactccggcacccactcgctgatgccgccaccgagccctcgcctgccatcggctcttgtcaaggggagagagagagagaaataagggagagaggaggaagaaggatagtgagagagaagatgacatgtgggacccacatgtcagtgggtcccacaattttttttgtgtgaatgataaatgggccccgcatatatttttttattttaatgccacatgacgccacgtcaatgccacgtggaacaaagaccaggtcaacactgccacgtgtgcgccacgtcagcgaaaccgccatccaaaaccaccaagggagtcagattgcaccggttttacaagttcggggggtcaagatttctggtattgcggttgagggatacgatttagattcggtggtcagttgagggagtcaaagtgatcttattccaaccgcaaaacagtcgtacaaaactctgttaatgggcctacatattccaacacaccgccaatgggccgtaagtgggcctaaacgctccaatatgggccggaaatgggttatcaacatgggcctacttcggtgaatatatgggtttgaacggatcataaatgggccaaatgtgggtctctgatttccataatgggcttcttcttcaaatataagggccaaagttgggcccatgatgggcttgtagttcgaatatacagggccataacgggcctgatgattgtaaaacggactgtggatggtgctgattttgcttgagtgggccgttctttatgggctatacgtgggctcacctgataccggccatgagcccatgacaagatcatttaaatgggttgcttaaaggcctggtctttagtttagttcgttaagcccacgcaacagcttatgcgcgcagtaccagcctaaagtaaccgaaatgatattactcacatatatatataggccttttgtggccgaaagttctatgcgcctaactttctcttgatgaaattgttcacgcaattgggcctcttaaatatcggctttctacgctatagaacgggcattgcggaccagattctcggggatatataagcatacaacgtatatccataaacaataaacgaattatatccatgctttcgagcttcgtcaacctgtacgccgatatttaccacctgtgcacaaaaaggcagatattcagacagctaaactagacaagcaataaatttaaacttgtagattacatctcatgtgtgtcgatgtacatcttttgcttttctgctttgaagctgtttccttccgttcatctggacccactgaaagaggaaaatgatagtatgttaaactatggaaagtatgtacaacgaccacctagtaaaatttgggcttgaaacggattaactgatacattaaagcaacattcatgaatcatcatggtgcatatgtacctgagtgcaaaatcaggttccctgtcaactttacgcagacttacattcatatacaggccctgcgagaaagaagagtattttagtgtatttttcagatctgaataagatgggaggattgagttctgctgtcaattgaagcaaatatttcttcatttccagcatcccgtctgcccattcaggtagaagctggcaacttacagtgactatatgcaatagttccaattgcaacatgaccagattttccaatttcctcgaccaagtttcaactagtttttatatatttatttatttattttgggcgaggagtggtatggtgaaatatgcaggaaaagtgactacttctaaactctaaagctgatctagacaaattataaactcagatcatgtgccctttacaagtgtgacgataattatctcgttctaggttctttcctacttcctccgttttacaatgtaagtcattctagcattttccacattcatattgatgttaatgaatcttgtcatcatttcccacattcatattaatgttaatgaatctagacaggattcattaacatcaatatgaatgtgaaaaatgctagaatgacttacattgtgaaacggagggagtagtagacaggtaagtggtttagtatttgttatatttcaacatttaatgccatctgctagcagtcataagcattgacagtggaacacttacattggttgtatgaattgtggccccagtagtcatgttaattttttgatctggcacaagctcaatgtccatcttctgcaacacaacagcaagtgccacaattgcttccaagagagcaaactgatctccaacacatttccgaggacctccactgaatgggataaatctgaaaaagagaagtgacagaaaggcagcatagtttaatttgtgtgtgtgtgtgtgtgtgtgtgtgtgtgtgtgtgtgtgtgtccagatgatttaaagtcagttcgatgataagtggacacgttgtaaaaacaggttaaaaaaatatctcaagatgacctgtattcagtgtttgtctcatttggaacaggtccctctaaatcaaatctctcaggaataaaatcatcagctctgtcccaaacctttgcataaggaacaaacaatcaattgtaacaatgtataatgttatggtcgttcagacattgctaagaggatgacaatatcataaagacagcagaatgattgcttattcactgtgacataaatttcattgccagtcacaccatttcaactagtgagcagataaccctgcaatgcgctgctaaagaaaatctacatttcacaaatatgctggacatagatatggtactttctctaaacaattggcataaagagcttaaaaaacgccaatcaataatgcatgtgctccaatattcagatggaaaacgtacctcaggtgacctgtgtatattgtacactgaaatcataatatcttgaccagctttgatcttatagtttccgggaagcacatcatcaactatggctcgccgtatcaacacctgttaacaagaagcccttgagtaacctaaactaactctgaagttggttgactaagcacaaggaatgtacaggtgggtgtggataaagccgcatagactcatttatacagcgcatcaagtacttcagctcttttagatcttcatatctggggagtctaccttgtagaacacggtcaacctctgcttgagctctcctcagcgctgctggatccttcagtagtgcaatactgagtagtcaacatatagttaagggatagcttatcttaagtaacgttttacttgttaaatcattagcgcaaggcgcaagcaataagggagtaccttactgagaagataaatagtccacgtcagtacagagcctgttgtttcatgaccagcaactaacattgacaatagatcatcacgtaactgcacactggttacctggaccgcataaagaaaagcatgttaggtaacggcagtaaaacaagtcaaaagcaagatgcatgcatgtgagatagtgaaaaagagtattaataggaagttccattcaaatgcatcattagtttgaaacaaaagctttgtggattccgtgaaagtattacccacaaaaacaaaggaactgtgcatggaaactgtcttataagattcaaaaatcaataataagtccatgtcacaaaattctatgaaatgagggaatagcttcctactagtacaaaaatcaatgaagactacaattgctgtaaaacaacatcaaggctttagattagtcaaagtacctcttcacggctagcaagtaggaatcgcaggatgctagggtctgcctcatttacatattcctcaccctcaatttgttcattctcagcatctacaatcttcttgcatttggtaattaggtcctcaacggtattcctgatgatgttaactgccttttctgcttttatttgtctaggaacaatcttgcacagcaaatcaatctatcaagaacaaacaagggctacatcagacatcagtcagcgacatcagtcagcaatttcgtctcactagaagttagataggccaaccataattggattttttagaaaataacatggcaaaaggaacattaccttccagtatggtaaaagatctgtagaacgaagttctgcttccttgagtgcagtgtaaacagcatcaataacagggctatctgatgtgagggaatcaaaattgtaattgaacaaggacaaaccaatcacatctaagtcatttgagagaaccttgcttccatatttacaggtttgccacttaaagcagatgtctcaagcttctccactaatctctcagcacatttacaaaaaactctgtcaaccatcaccgagagaaatcgtttgtgtagagatggtacaactgatcgacgtctcacctgaacagataccaaaacaagtgtaagttgaacaagagattatcaattaggtaagtagcacataaaaaggtaaggggcaaacaagggattgtaagaaaacaccaaaccatgtgaattagatataggaacctttcacctttcagaaccaacccacaatcacctttttgttttcatatttttttatactagtttcactgttccagctacaaaatgaaatactactctagtacactacagaatatcctcatgtccacaggagcacctatattctgttaatagcttgtgagaagctactgtaatactaaatgggtaataacattgacttctgataacattacataagatctaataacattgcaaggcaataccttcgtgtgtcctatccaattcaaaatgcagggaaatttcttcaacacatacgagaaactaaatggctacatcaaacagcttaaaacaaccaaattacaaagttagaggaaaactgttaacttcacctaactatgcaaaattcactccatacctaaatttctatccttatcaagtgaggaccagaggcaatatcttctgggagcggtaaaaagttaggtatttatttccaaatccctaggatgctatgctatgaaccaccagcacatcaatacagaatagattatccagaaaaaaaaaggacagccataaaggaatcacggggtaatgtcaaaaactctaactactccacaattaccgcttaacaaacaatcgaatggcccacatcctttggtaactcaatctaaaaataaccaaattctaaggatttactacaacgacataatccgctataatttttgc

SEQ ID NO: 24272 - DNA, 3637 bp, Oryza sativa
aacagcattagtccagaacacgaagagagacagagagagagagagagagcaccgtccagagagcgccctcggcgatggcgaacccggagccgaagaggaactcggaaacctcggcgacgagccccttctcgtacctcgaaccgtacccacgcagcacgtgcctggcaacggcgggatcgctgacgacgacgagatcccgcggccccgccgcgaggcggtagacggggccttcctcgcggaaccacttgaagagagggaggaagagcgcgccgccgaggaggtcccgcacgtcgtcgagcttggcggaggcgacggggatccccgagtcgtcgcccccgccgaggcgggttgccaccgagcgggagagcgccgtgagccagtcggggctcacccacgaggtggtgatgggcggctcgtctccccccgctccgcctccgcctccaccgccgctgctccttggcggccgcaggcggaggcggacgtggccacggcggagacgcggcgagaccaatggcggaggaggcgggcacaggaatggtacgcacgggacggcggcggcggcggcggcggccatcgcactggccgcccgcgagctagggattcgagatggattttggggaattggggtcgccggattggggggagagagagacgagacgagatgagcagttggcagttgggcgcggggatggatgggagggggaggaaggggatgaggtgggacccagctgtaagtggcggaagcagcacggcacaaagcgcgtgagttttgaatgctgcgactctcgtggtaggaagttcttgggccggtgggccgttacaggcttacagcaatcggttacataccaagaaggaaaaagtatacttaaggtccctcaactagtcatcgggataaaaaacgttctcgaaccacaaaaccagatatgcggggcccttaactatacagaacgggtcacccgagatccttcggggttttgaccccgattttagtctacgtgacgactgagtcagcatggaccccacatgtcagctggccacgtcatcaccctctctcctcctcaccctttctcctctctctctcactgtctcacactcttctcgtttgggtaggcagctggggaggatgtcggagggctgttgccttcaacggggctaggtgggacgagggcgtcggcggccggcgacgggcgacacgacggcggcggctggcaactggcgacgcaccgccgttgcagaggccgcaggagcggaggtgggccgccgtcgagggaggaggtaggcaagcaaggggggcggggaggccggcgatgacctcctcaccggctgcgagggggagcaaggcgtcggcggcaacgaggcggttcttagccgcggccagctcgacccgtagtctctcaagctcctcgccgagcggcatggagggacgacacggcggcggcaagccagtcgcatcgtcgggtttgatttccgacagcaaatttccctgcgcaaacatcagatcgggatggctgcggcgatcaggatgcatgattcggaagaaggtcactacagttttcactcaattttgtccaggtcgttcactcaattcggaatgaaattcattttcagtagcactggcacatgatttttcaaaaacatcaagttgtctcaactcttcggatcgaacaactgctttcttggatcaacatcaacaaaataggattataggagcgctggccgctgcacatgatttttttggttggatgcggcagatttggcaacgctgaggagctccgcggtgtgcaggaacgtgtcgccgcgagcgtcgtggtgtgcggagaaggagaacagcgggcagcgtgacgcggcggcgaggacgacgacgcccaagcccgctctttgcgcggagaaggagagctaccgtctgggcagagagctaccgtctagattttttttatgtttgcgtgtgatcaaggctagacaaagagctagatggtagctctctgcctagggcccaacctcagcgccaagaaaaatggtgttgagacttaagacctcggcgccaaatcaagtggcgccgagctctgtaacttaaccgtgtgcttgcggccgacccaacatcccttttgtgttggccgtcaacttggcgctgagcctacaaacgtcagtgccaggagtaatggcgctgaggtcctcaatgccaaggcaacgcccaacataggagctatgttgggcgggcaggcctcgcgcggctgttgacagaaaatacgaggcctgggagatctgcttaactccagtgcaggtccaaagctcgccttcggatgtatgagcgtgccatttgatttgatattgcaatcaacaagaaatagaacaaagaaaccacaattaatcctataaatgataaccgatcggctaggtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgggatagatcggtcgccttgccgagacagtataaatcacttatatcgaaatatatattaatagtaggattatatacattcatagcatagccgatcaggtggatctagcatgtatctgctaatactccgatactactctatactaagattttaaagtaagtagaatatactaaacataagcttaatatacttagatgcgacaaaatcttaacataaagggcagatttaacatatagatcaagcatatagaataaaagtagttaaatcagataagatcggctgaaactctgatactaccctaatcagcaaccagaaagcaggctagagattgcaattttaagcacgacttaatagatcaaactcaactgatgcagcattaagtatgaaaagaaaaacaatatctggacaatcaagccactggaagtttcatagagtggtagatatatcacatagtctaagttaacatcattgtctaacctaatcggctgccttccattaacagatgttagccgattacagattagatgaagatattatcgaagattatgtgagatatatgataactcgacgaattatatagacaagattagagtgtcataaagatggaagcactaatcttgagaacataagtcgtcatgacaagctttacctcttgttgaagatcgaaaccgatgcagctcaacccgagagcacgaactcgtcgaaataaaagtaaagcataaagggtggcgatgcgccgagattgtattggatgtcttgttttttttacataggactcgggtctatttatacccgagaattacaagatacgttcataacagacacgactattatctctaacaaactctaagataccataagtatttacggcagacttttacccaaacatatctctaaggaaattaaatagaatatcctaattaatagatacaattgccttcccaggactctatccatgcatggcaatcatcttgaagcacatcaacttgaacccgatgacgtacaccgagtcatattatcagaatcggttgtatcggctaaccccgtccgacttgaactatgccgacctgaccttagccggttggactgca

SEQ ID NO: 24273 - DNA, 8166 bp, Oryza sativa
ctttgtaggctcagtgacaatctcaatggcgttgagatttgccggctcaacgcgtccttgcggccgaacacaggagcgatgttgagcggcaaggacgcgagcgtctaagtcccaaatctcagcgccaagcaagctggtgctgagcttagtggtttagcgccaatgagactggcgttgacatcctgccacgtaagcgtgaggattggtagggggatggttggcgctgaccccgtggcctatttttggttgaagtttttagcaagtactagttttgaaataagttttccccaaggaccaatttgtcaaaaactcccgaggaccaggtgccagttggagaagtcagatgacgagacttttccgatcctatccaacccatccgtcccgccccgttgctactccctccggtttgataatacttgtcattttggacaaggatacggtcttcaaaaaataattttgactattattttttattataatatgtataaaagtattaacaaatatatgattttattaaagtatttttaagactaatctatacatgtttgaaagataaatattttaaaaatgatttaaatcaaatattctaaaatttaatctcacccttatctaaaacgataagtattatcagcccggagatgggaagagcatttgttctccaacgattgtgctgaagagagactgatttgtacaagtgtgaatgccgcacgtgtgtctatgtaatggacttgagtaattagtcttaagcatccctaattcgtggacaagaaacttaaatcaagcgatccaagacgaagacagccgatcccgggacaggagggcatgtctgacacagcaactctctctctcacacacacaggacagtatggcacaccatgaccaccgatgacgcagccgcgagatcagtttggggagatgcagcgcagctagctaggagtagcgatgttcggtagcagaacagacagaaggcaaccgtgggcaaccaaccagcagagcccgcgtttgcggatgaccatccagctgcactgcatgtacgaccgattcgcgccgcggaattataaaccggatccgatcctagtccattcattcacaacacacgtgtgttcttgatcttggataggggtagtacctgggttcaaacaacgaaccagcgaaagcacaaaacaacgcagtgtcgatcgagccatatgagtggagttgggatcctatcctgtaaatgtacgtgcagtaagtcactgacatatgggtctaaaatttaggtgggacccacatgtcagtgacacataccacaggtacagtaatgtacaacagtggatttgcatccgagtgaccattttaattttaataaccacccaagatggatcggaccggttccatctcactttttttttaacctttaccgacctcatctcacctcagttgtatgactgtatctcctccattcgagtcatgttactgttcacagatccccacacgatgctgtagggcctctgcatttcgccaggcccgtcaataaaatatgagtgtcgtatgataaacacactctcttcctctcacgacagtagatactactactcctatatcctaccaatggatcaaaaggagacagaaaaaaacggacgcggaggaaaaaaacaaggagcagcacgcatggtcgttcgtactcccccaagctgttaattattcaaaatacttactgctaccaccaccagttcgtcccgtacctgtagtaacgaatagatcagtttaactgtcagacactcatgttcacccaaaggaatacaaggcggagtaggattctctcgccgatgcgtcgcggcgggagaggacacgtcggcactcggtcggcagcgggagagatcacgacaggacgacgagcgcggtgcgtggcgtggcctactggagtatactactgctccatctatcgtagggtgtgtttagttcaaaataaaattagaagtttggttgaattggaacggtgtgacggaaaaatggaaagtttatagctcctatcgtttagctttttccctgataagtcaaaatggtttattagggaacaaaaataaatttttagataaaaattttatatatgtgttcttgttaacttaaaagccaatgctgaaaaagaaactacgttgaaaatatcaaaatcaatctcaaaattaagtttgaaaatttaaattttatcttattatttggctgtttaggccatccgatgggagcatgtgtatagaaaaattttgatgtgatggaaaagttggaagtttgaaaaaaagttcgaaactaaccagaccctataagtacactccaatcttaagtacggctgtgggtctttttactaacgttcattttatttaaaattattttataataattatttttatttttattagatgataaaatataaatagtattttatatatgacttgctttttatttttaattatgttttaaaatgaaatggacgattaaacgtttaacataaacttggaatgagacggatgagtaatatactgcgagtttaggcgcacgggcggcgggggtgggcatccgatgcggtggggttgggggtggggggcaagcaaagactggggcaagtacagtggtgtggcgccgctccggaaattcgcttcgcttcgcggcgcggcggctgaggatcagcgtcagccggatgggaatcccaggcgtggaagcgcgatttttaatttgggcggcccccgaggcggtatccgatgatctccttgtcggctacccgcgtcaaacacactggtatagtgcggctaggtacccaacttttctgctgttttacacaacggtccttcctctatttgactatgcctacccgtatggtagcaacttatttcctcctattgtagtaattcttaacattttcaataatgatactgtctctaaaatatatctttaacaaattttctattattacagtactttgtaaaataaatttatatgttgttctagtacctttcaactatatatttttcaaagttatttatagtaaagttataaaattttaacctcaactttgggtgtgtttagttcacgtaaaaattggaagtttgattgaaattgaaacgatgtgacggaaaaattaaaagtttatgtgtgtaggaaaattttgatgtgtcagaaaagttgaaagtttgaagaaaaagttaggaactaaaccaggcctttgtataaaacatcaagaattatagatttggagggagtactccatatccgttttatattgtgaaaaattttgggtttcatgctgtgaaacacttcaaaatgttgatgcatttcttttattgaacttggacaagaccaaaataacttatataatatactagaatagagtgaaaactgtttctacgcaaacattattaggtaccaagatgtgtacaatgtggaaagctatggtatgtattaataattcatccatttcatatgtaattatcgcttttccgtgattatctttcatgcaactttttttgttattatgtggaaagttagctttaagggcctgttcactttgatgtcattttcaaccttaccaaatttcggtaaagttaccaaaaagagtggctacatttagtttgttgttaaattttggtaactatgtaagaaatcctgcccaaattttggtaaggtattttttttattaaagtgaacaggccttaaaagaaaaaaggcttgcttatatcttggaacaaatttatactccagcaaagtcaaatacacatggatcgacctagctagccttttcatactgtgcactcaaaaccatacctttagtgtggaggataacatagtatcccactacaattccactgctataaaacccctagtttattgaaataacaaaacaaagttctacaattagcaagccttaactagggaaggcaatgaaaacaaaaatcaaactacattagactaggtcaaaatgcacccacaaccacaacggttatgtgctcgagccagtatctcatactaccaatactacaccaacaccaacactacatactactactagcggcactgtacatacaaggggaataatacaagctaaaataaagctactccactcctagagaaggaggacctaaacgcaataaccaagtcaattaaacacggttggtacaaaaaggacacccgcccaatacaaaaacgccactacaaatgcaaccgcaaatgcacggccctttcccccaaaacccccactgcattcccccccaaacccacaaaccccgccgctggatcaacaccacctcaagctcgaagtgagccactgtcccaagcaaccttccttcttctccccacctcgttttctccaaatcgccattcacaacccatacacactctgtgcgcgtgtgtgtctctatgatgtcggcgtcgccggagttctacaagccggcgccggtgttctcgccgtgcagctcgccgctgcggctgctgcagcagcagcacggggaggatcatcaggaggagtacggctacggcagcagcggcggctgctgcaggacgccgacgggaggggagagcaacctgaaggcgccagggacgtgcccgccggcgccgaggaagccgcgcgcgcccgccgcgccgtgccggaagcggctgttcgaggtcgaggtgttaagcctccgcctcgaggagctcgagcgcctcttctggcgccctccgccgccgccgccgacgacgcagccgcagccgcagccgcagcagccgccgcagaagcgccggagggtggccaagctcggcagctagctagctcgccggagtagcacacgtgtgcgtggatggccataagtggtgttggttgggttagttactagagctaaagctagagtagttcggagttggtaggatttaggcgtactggcgtttttactgctgtacttgcactatatttctactgctcaaattatctccatggctagtatagctggttgtacactttgtactatacctgcctagctaaggttgctactactactactgtagcgtatcagtgcagtttatactagtatctgtgtatgtgatggcattgggggtgtgtactcctggtacgtattagcaatcaataggagcttagcttgaatttgcttccatgcatatatggcagttgcagtgcagcctgtgaagtaatgacaagttgtatgatccgtgtatacatccatcaatgtatcagtgaatcaatccttgcaacgaatacaatgagaagcagctcaatcctcatatgttctactattgcttccgtcctaaaatatagctacttcctattacatgttttctctactttgtgcaacagataggagtagttctcgaaagtatggagatactgatccatctgcgtagcaactggcaagaacgcaagatggatggattcagtttcagagtgagctgcacctcccaggcacagcacgcagctgggctgcaggaggtgcagggggagaggaatcattcaggaatgtgagacgagagcagaaggccaaagcatcgagtggtagtagcaagcagtaatgatgtgtgtcgctgctgtggctggctttgtagtagtagtagtaccgaaaatttttctgcaggcttggcacccggcaaggctgcagcaggggagcctgtgctggaggtacgagaaggaataattttggccaccggtgccagtaaatgtgaggacgtgtggtgttgggggtcttggttggggatccgagtccatctatcatcacaggagcatcgcaagcagcagctgtccatgtgttctggacttctggtgcgctcgcagatagagcagcgaggaatacggtgatggcgaaatgcatatgaacatcaggctaaagcatgaattgaaaaaaaaataatactgtcactccatatgcaaatgcaatcgtaattttacggtatgaatttattatagcatcattagttattattactacagtaggagtgaggtttaaagctgcagtgaatacggcaatttaagcatctatgacgcatctgtacactacagtcatttaagacatctggagcgagtttgcagggtagtacacactcctattgaaacagttgctccgttgcccctttgtttatgagttttgaggacatatgggacacgtagaaaaagattggtatttattgagccaatgctccatgtatggtgtacatacatactgttatttttgctgttgagtacttaccccagtaatatgatacaaagatcgacgcttcaatatacaccaagggtgaatcatggggttagcttcaaaatgagccgaaaggtgaaagaatcgacaagaaaaaaaagaaataataagaaaaggaaaaaaaataagggagcaaaacacaacagctctatatgcagctgaagaaaacaaaaacaattacagccgttttcgcctatggtcctgcctcaatcctctcgatggtttctaacctcgttttccgtttccatcctttcatagtcgcaaccaggttaaccaacccgacaacctgacttttgctgtattcctgtaagatcagacaacaaaaacataaatcattttgtagaagtatcattaccaaaagtgaaaatttactcaaaaaaatatatagattaacagggttcttactggatgagaccgtgcccaatgaacatactcggtctctggcaaataataagcctgtaaagagtaaaaggctttgtcaggttcttataaatgaaaaggccaaatgaagcatacaaaggcactcggtctctagcagatagtacgtggttggcatagcgggagtactccaagccaattactactgcagaagcgtggtgtaaatgaagccttgactggtgcatgcaacgtacctttatgaaagtatccacaatttgcagctttggcctaacatttgcggatacaatgtgcagcagcccattaattagtacctgaaggagcagagaaaatctttatgagtattcatccatgcctttcaatctagataagctactgggtaagaataaaaaagattacaacctgaaggtccagtgacatcaaagcccgtccttcatctgtgcaccgttttaccctagagagaccttcaactaaaacttctgcgatgctatctatgccatactccagcaagaggtcttggagctgggaagaaaatttacaagttcaatcacctttaacatcagtataacatcgatatataggctgtgtttagttcacactgaagtttggaagtttggttgaaattggtacgatgtgatagaaaagttgtgtgtgtatgaaatgtttgatgtgacggaaagttggaagtttggaaaaaaactttggaactaaacagggccatagtttgaaaaccgaagaactatcttaatgacgaagcagaatgaagtactccctccgtcccaaaaaaaactcaacctaagaggggtgacccctcctaggacaacgaatctagactaagggtaatccagattcattgtactaggggtcaaattccctcctaggttgaatttttttgggacggagggagtaggtccgaaaacattgtattgctcgccacataaagaacacaaacaaagcacattaaccaaaaagggaggagggggtgcccttggcttgtactaacctccttggaaattcctccatggtccaatctagttttgtagtgcttgaattcacccaataacaaatcaacatagctgtaataaaaggtgcaaacaacatcatcagtggcactccaggtcacaattaaaaaacaccactatcaaccataatcctttaactatgcaatttgtaatcagatccctaactatgatactaagaattaaacacattcaatgcagccctgaattattccaaatgcatgtacaagttacagattttttgatatatcacagcatggcgaattttgatatgttggcttcaaagtacaaggacctaatactccacccaatttttttagcacactgcgaaaggaaaggtgtggtttttcttttctgtaagagtaaattcaacaagacccaatatttccaaatgatcagtagtaacacatttccatagaatacctaccgatattgcactcataaaaaaatgatggagtacaacataaataacaaagaaaaaattgctagacatcaaatgaccacaaatcactattgaatcagtcaccaaagacatcaatataatgcat

SEQ ID NO: 24274 - DNA, 838 bp, Oryza sativa
gaatccccgaagtccaatatgatgttcaactcagttgacaatagttctgcccatggaagtactaacaatggcaatggaaataaagcacctcttgacgaagagaatgaagaccttcttgcagattttattgatgaagatagtcagttgcctagtaggttagcaaaaacaaaaattgtgaaaggcaattcttcccattggaaggatggggacatttcatcacagacaggatcatcgctttctttattaaggtatcaaatatgccataactttcagattgttcctgtaacataacttcctatgctaaggtgtgatttcttcactggaatcaggatgatggataaatatgccagattaatgcaaaagctggaaattgtcaatgttgagctttttaaggttagtttaagtcacccatcgtaagatattcgacatgtagaatatttcctattgttcatgctagacaaaattttcagggtatatgccaactgtttggcatcttttatcactacatatacgagacatttgggaaccaggacaggggtcaaagtggcaagtctttacctgatcatcaatcgtgtaagaattaggtttgctctgtgcagttttttatgattcttttctattgctgcacaaatgcaattatacttttgagtcttaaatatcctttgtgacgcttgtgatgtattcagttcggcttagagtggctttgtcaaaaataacacaagactctgaccagtggatcaaaccacagagtatttcatattcaccttcatcacccgtatcaatggatgtgatgcctactgcgcctcccagctcaatgttcaccttgtatggtttgaag

SEQ ID NO: 24275 - DNA, 87249 bp, Oryza sativa
  unsure (1)..(87249): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatgccgttttcctgcaggttcgtgactgaaagccaaatggaagatacggatcaggagctatgcaccgttgcggtaagaacagcgagttatctgctatatctctttatgtttgagcttgcgcactcaagctagcgctagctattattgtgatctcttgtgttgatcttctttttatctgtctatcaggtggagatgatgagttcaggaaaactcaagccatgtagacacttgttgttctatcaagactcccttcaccgagaagcatccataaaaatggttcatgtttagcaatagcacggtgttatcctaactgagcttttcttctagccaccgtccacatccttcttcaaaacctcaacatcactttgtgtgggaattaaaaggaattggtcttcttgaccttgcaagaccttttcttgaccttgtaagacccaacatcgttgtgttgtttttcttgtttcttatttttcaatttcatccacctcttctttctacctcccatctttctcctagttcttgccttctctctcggtctatccctcctgagctgtattgatcactttctatgttattttctcgatgtttaaaagaaaattaattttgtttagcaatatacgaagagattgtgaaattctagtatacctgtaaattgtaatattattgcttgcgtgatataatttgtaatattattattgcttgcgtgatataatgtatttctgcagtcagagtgcagctgatagacctaaggatgtttcctgttaccacatgtgaagctggaaatctacctgtaaggtagcttgacatgtatcacatcatgaacggaataagttcgctgtgtgccactcgataacgatttggatctttgccgccttgctcactgttgggaacaagtactcgtactcgttataacactgcatatgcaatacacggtttatgtgctgtcatttcgtttttgttatgcgccgctacagaaggttcagttctgtctcaaacttttgtcacagcactcgactgtgtactactcgatattgtcctttctcgcccatatacttcgagtttttttttattttgcaattacatggatcatcgctttagttcgcggcttaattagccatttactaaacatctaggcctactgagacgaagtttatatgaatatatagatcgacctagggaacaagtgtactcgcgataaaataaagaattgatcaaatactgatactaccgtaccttcgagatagcagcacaatcctgacctagcagaattatattgggccgtgtttagttacaaaatttttcttcaaaccttcaattttttcatcacatcaaaactttcttacacataaacttttagtgtgaactaaacacagccgattcagctaagagtctaaggaaaaaagaatatatagccattcatgttatacgtacctctagcatgcaaatcattacagggggtcaattgatatagcagtaagatgtatcggaaatttagagtagtcacggtatatcgagcagtccaatctataacctcccgttattatagcaggattacagttgatgaatcaaaacattgccatctagtcatgtatttatccttacaaatcttaaatgccaccacttaattatttggcatttgatctaccgtgtctgctacacaaattctactcccaattattccaattccaaattggttccaaaggatctatgttttagagccgtgcataaacataaaaaaaatttggttaaagttactaacttatcctcagttattacaccatggaaatgataccccataagatgggagttttaattaaatcgtgcagaagagattaagatagttaaaaagtattgtgtcactataatattagaaatgaataccctatttactcataggaacggtataatgcgttcaattgcatgatagggaaaatggtggatatctattttttaagttaaaaatgggggatgagctactccaagttttagtcttttagagaagcgttgattactctaaaattttgaatcaatagggattttgaaggtttaattaattgttgcagcaaaacagggaggtctgaaataataccatgcatgcaagtaatagtgatacagaaagtgtcaagtagctgttctgacttaaacagaagagagacaagatacggacaacttaaacaagaaaccaagcaatatgtacacactcacgtcactttaggaaagaagtggggaaggttgctccacaacacttttcagtcaattcattaatcattgacaccacgaattcttcagaaaacgggaacgcgtagagcaaaatgccaaaaagcagctcttacatctgtactgttggcaatactcaaattagcccattattaattaagtcattatcagtgacaccaatgagtataaatactttcatgcacttagtaaaatttgcaacagtatctgcattcagttctcagaactactagtctgctactctactctactactacaaaaaatgtatcagtaatttggagtctgcccctagtgtactactccattgaagcctggtatcatagtggcagatcagacaggtacgtctaatttggcagggcactctcactcaagtctgtacagtaaatgagccattgaaaggcatgaatgaagcaacctaccgttctttcacagcacaagatgcatgcataccttccattcttgctaccatgaataatgggtgttacataaaatgggaggatgcagaatgctacaacactaacacatgctttattgatgcatgccgttactgcatggactgattgaattggttgaattgtggtgctcttcacatgggtaagattgtagtgtaagagactaaaatagcacagagctcaaaggctatgaaagtatcattgccttagacttcactttcctgtgtggaaaccaccaagagttgtccaggtattcaatcaaaaaataataaaagaagaatgaagggaacaggtattcctaaatacctaaaagaaataggggaaataagaaaggaaaaactttagggttcctttggactgaaataatttcaaagaaaacctggaggatttcaataatccttggaaaatttttcctacgagctcctttggaacaacggaatataaagttctacgaatttgcttcctatgtctcaattccatagaaatctaagcatgagctcgtatacctctttttattttcctttgagaagtcccatgctctctccctacctccctacctccctctctctctctggccgtgtttagttcacccctaactactccaaacttccaactttccatcacatcacatcacatctaaaacttttctacacacatgaacctctaactttttttccaaacttccaactttcctcaaacttccagcttttttcaggaactaaacacagcccctctctcactctctctctctctctctctctatctatctatctatctatctatctatctatctatctatctatctagtatctctcttccacaaaacaatttcctccaaagtttctatattttatttgttatgaaccatccaagcgtataaactgcttgtgttttgaaaccctataggaattcctagtctgtgacatcctattcctacggtttacttgttcatgcgatttagaaatactgcattctaaaaaggagcccttaatctacacattagaattcaaaatacggcaggatatatgtagtctccaggaagcatgcaaatcaaacacccattttcacaaaattcatgtgttttcaatcctctattttgtgcatgtatccctatcctattctattgtttttttccctattcctacgttttttcaattctacatttcaaaaggggcctgaaagttaatgcaaatactcaggctgttatcaaggctgtgtttagatggtggaaaagttgggagaaaattggtagtttggagaaaaaattggtagtttatgtgtgtaggaaagttttcgatgtgatgtgatggaaagttgggaatttgggagaactaaacacgacccaagttatatgaggtctatgatctcaattccatatgtggcacttcaattttcatgtcatatatgtgccactttcagcgacaaacatgagattaggcaaaattttaatggtagacagggattttatccgaataaaaaaaatactccaggaacaatgctcctcagtccaccacttttcaagtttaagcgtcatcaatatcacaaaaggtaaaaacactacattcttttgtacaaatttttaagatgcaagaaaccacaagcaatggcattcctgactgagctttttatccaccggatgcacattgttatagtttgaaagaacaagtttcaaaagtcccaactataggaaaataacagagaacacggagcaaggtaaaacatttagtaaattgaatcaactaatcaaggtcccctgttagatgcctctacagttctttttaatttcatatttttttttactttagagatgaaagattggttgagaacaagtttaatagtaaagccaactatgatcttatagcttatattagagttaatatgtatagtaaatgagctataaggttatctgtattttttttctcctcactctagctctcacatatgcatttaatatattcatcttaaagtatgtgaatagttagttaactcttgcatgagccaaaccttttcattttcaaattctttcttctctacatataagcttgacttatagtctactattaaacttgctctatgaagatagaggctatacagaaacaatagagagaggataacagtgagctataagcctactataagcttatgtggaggagagatgtaacccaaaaaaaatcaagggtattggctttcatgcaagagcttaacacaagctccaagacatacattaaatgtataagtaaggccgtgtttagtttcccccctattcccaactttccatcacatcatatcacatccaaaactttcttactcacataaattcctaactttttttttcaaactaccaactttcctcaaacttctctctaatttcaggaactaaatacagcctaacttttccatcacatcaaaactttcctacacacaaaaacttacaatttttccatcacatcgttctaatttagatcaaacttccaattttgacgtgaactaaacacacctttaacatgacagccatgaagctctatggacatttatgaggtacccaccaccaccatctgtcccctctaaagagaaataacaatcccccctatataccctggcacaattggacagctactacacacagggggtatagttttgtccttaaatgcctttttgctctctccctctgctggaggattgtagacgcagcgacatttacgcaccaaaacgtttgaaggttgtcatgcatgcatgcatgcttgctaagggcgcaaagcctgagttttttcagctcagaagttagtagtaagtagacaaaatggattgaattcaaacagtgaagcgagcagccactgtgcgcaagcaacagataggcaagaatccacgccatgtccagaaacagttgcaagaacaggagcagtgacgagtttagtagcgaagaaaaagaaatgctactgcattttaaactttgcccaacagggagactcagaacaggcattgaaagcatgcaagactctggagggtattactgccgcagcaacccgactagtcaaaatctaatgcatgcatgcaaacggctcgagatttaatggtccatatcttttgcatcttctttgaaaagtgaactcttgcaacatgttctcaaaagatagcctcacactctcttggcagcagacatcaataaggtaggttcagttcatgatcgatttagactaatttacaaacttcaccagcccccaaaacaaaccctcctcaaatgacatcgatttagactaatttatgacactccatgatctatggtttaaagtaggctgtgtttagatctaggggttaagatccaggggtgaaaagttttaccgtgccacattggatatacggacacacatttgaaatattaaacgtagacaataacaaaacaaattacatattccgcttgtaaaccgcgagacaaatttattaagcctaattaatccatcattagcagatgtttgctgtagcaccacattgtcaaattatgaagcaattacgcttaaaagattcgtctcgcaattttacacgcaatctatgtaattagttatttttttcatttatatttaatactccatgcatgtgtctaaacattcgatgtgacagggtgaaaatttttgcaaggggatctaaacatgccattaaatacagtataagtcttgcatcaatgtcttatctttatttttcatggcactagctttcaaagacttaccatactttagtttcttcttcttaacgtcctccagattttgttgaatgctcttctgctcccccaccactgtattcagctgatcctgcagagcagcccagtgatgcatcatgaaatgaccataaaatgggtaacgtatgatcataaaattgcaccataaatattgcagttcctagagtcgctaccattcattcaaaacaaaccaattgcaaagctaaagatcttgcttggatcttatttgtttctgcaagggagacctcgcagttccaggaaccgcctggctcctacgggtgatgtgaacaagacataaatgacagagtagatcagcagggtagcaactgtgccctcccagtgcattttgaaagggtttaccccctatagctagtagtatgcaaagccatgattgtgttatgaacttctgatcaacaaacagtaacaaaacacctacatattaagtgaaagccgtgcaatgtaagtgcatttaaaagtggccaggcagaccagtggtcaccatttgtcaagtcagtttgtgcagaagttaaatgctctatacgcactgcagagaaaaattaagaccgagtatgtccaaagcatttaacttaatgcgattttttcccggaaagccattagattgcagcagcaattacagtaagtactccagatatgaatttttacctgttcttttaagtggcagaggatgcatggagcaatcagggatgttaaagagggagcatcagtgaaaaaaaaaggagcaatttcagatcttgactgcagtcgagtctttactactaaatgtttgaacaggacaggacacacacattagctggctgggaagaagaccttaattggtatgaatatacggacctgacagtttaacccatgactgcttgctcctaaacaatgctggatgcaacagctggacggcatgtctggccctcatcacttctggggactcagtcagctgaaataagaatcaccagctattcttatcagaggcaagagcaagaacactgtcagaaacattctcccatatattgattacaaagtggcaatatttacatcctgtcagtttacaaccggccaatcaacttttgatcggcttttagtgtagtatgcaatcatgatttggtagaatgtacacacaagcgttatcgatggattaaccacaagattgccaaaataaccggcataggtggccaccctggtgaagtaactatgctaactagagcaacgtaaaaaatacaacgaagtagaatgtgcagtgcccatcttggtagtcaagcaccaattgtggtactacacaagaacctgcgaccttgccgcacgacgggagcatttggttcgggcactcttgttcacactgcatgcacacccttccagcagctcgagatcttcctcacaaatcaatatggatgccaattctggacagtctaaaagcattttagagctaaggtatcctgcaatcgtccaagtttgatatagccttgactgcttcccaataaaccttcctgtccttgtgtcataatattctggccacttgtcctctgagagtctcttttctgcgacttcaatggctcgctgtgctaagtcacgcctacccatcttgatacaggctagagtgaactaaattaacaaatacaaatgattaaacatacaatcggtggaaaaaataatggaagcgttaacaaggttagtgatatatcaattttagatttttacctgccatagcaatgtaggccaagatccaccattatgatacgaccagggcctgtatgcaataacaaaggtataaaaaaatagactcaaatactgaagcaatgcaaatctggttaatgctaataatacttcctgacaaatttaggtttcaatatctgcatctgcacataacaaatgatgtagtcatcataaaaaagagtttttcagttgcttacgtgtttttagggtcactgccagtgatgatacgccattcctcatactctagagcagggtagcatatcttgagtggcatatttgcaattatatcctcccatttggcttcaatgaggttcaggataccctctgcttgcctttgagtagctagagaagagataattgcccagagatttccaagagaaaaaaacctgaaatccatgtgagccggttgtagatttcctataaggtaaccacccttttcaggaatccaatctgcaagccaagaaggtatttgttctggatagatattgaacttattaatagcatcatgggagtactcttcagttttgtagcgataaatttcatttatcttcttcatatcaacccaatagtactctcttatgtgaaacgacaaagcactgagcctgtagttgatggcacggatcaaactgttagatccgtcatttacactgaccatttcacgggcacaacgcaaagcagaatagaatagcgactgcaaaatagataccactaggtcaaaaaccactacatttgagttgtgagtaggacttgcagtgaagaaaaacaccagtctggtactgaaagtctgagtttgtcaaaatcattatcaagcattagcttacctggatctcaagaggatgcccatggattcccatccgtcgatcgatcatacatgatccatcagtgactaacaatgttgggaacatgtcaaatccatcagacaagcataaattcaggattagtctgatgcctgtctgcacatcaaccctttcttgtagtgcatagtctccagtaattttaccatatgcccgcaacaggattatccaccaaagaccttataaaaagaggatggtataaaatatccacgtaataagtagtaagagtatattcaaaagtataatatgaacctatctagcttactcacccgaatcaactggtgctacacgtccaatggctgactctccaaagtcagggtcaagaacctcctcaaatgcttcactgtttccatctagaggtatggatctaactttgaaactagcaggcatcaatccctgaccaggactgtagcaatcaactgtcttctcccagctctgataggttaaaccaaacaaaaaaaaagtgacttttctttcaaaaaacaccaatgatcatcataatttatatattttaagaatgatacaaaatttaaaaataaaataaaagaaaagaaagaactcaactcttatgctaccaagcctaccatagatgagctagcagcgtaatgtgatgaatcatgacaaatgaagcatcttaccctatcctgtacatagaaacatagaccatggaaatttggtcgatactggtctcagaggtttggatacgctagtggatctatttttgaagttatggaacatgtttccagaataaggataagtatgtcttttattttcaaaagaacatattcatgttgtgatttattagttagagcttagaacatacttgtcctagagtgttaaaccagtgttaaccaccttacaaaaaccaaccaaagtagtagtgatttttaacagtcccaaagtcagttggtaatatttcagatttagaacaccacacaaattttggtgttcgagtattccagatttgcaacatggtatctctttgtggagccctcactacagaataccatgctctagctgtctcgaagtagtgcagcactcttctttcttttttgatttgaatgggttatggctagcacttgtgatgctaaatggtaacatcatttcttgcccctgtcccttatactgtagtatagacaagtagacaaccatgtagcactacctgtagacagccataccaactgacactaatgattcttgacttcttgagtattggtagcaaacttggtcatgcagaaatgttgtcttgctgtcttgcatgaatcatcaatcctatcgtgttctaattttagatgaagcttagtatgtactactaaatgttatgcattgcatatgaataaaaaacaattaaaagtgtattttaagacaaggctgagaccattatggtcatatcactaggaatgggcctaggaaaagaactagtaaatgataacctcaagtcatgcacccttgccaaaaatgaaaagaaaccatatctgctccaatagttacatttaaataaaccacatgaacttttagatcaacaaacaagaatatgtcatactcaaggtgccggcgctacaagattatagtattagtattataagtataacagaggcatacatcatgacaaatgtacattagtggaaatttagaaaatatacaaaacacatagattcagatccttcaaaatcctcatacgcttaaacaagttgttgtttgaagtcccaccaaaattatgccaggttgtaattgcactaattttgtgttatttaatactcaagttttttaagcaagtttctggtgcaagaataattggcattgttgcaagagatgcaaggatcataatctacttgagggtttattagaacaattgctggtgttatctagcaaaggctaatgagaaacgcctagggttttccggctagctccacaaggtggtgggctagacgacttgagttcgaagcctcaccccttctaattatttgatattaggtccttccctaatattcgcgtctagaaagacataatatgtgctactttgtgcagaagattttctttccacactgaaattgcatcagaatttgtgttatttgatccataataacgttttaatagcgcactgaacattattaccacggctacatttaaaccgaagatgcatagaatgtactactgccacggcccacgggtaacatagcatttattccgatgtttgtttgggcgactgacctggagttgcaaagtgtggagcaggaagttcttcacgatgtccccctcgcccttgaggaggaacgcgatggccgacgggacaaagtctctaatgaacacctgatcgtaattgagcatctggttcgcggtggatgggtcgttcgccgccaccgtccccacggcggtgccgcagtagctcacgaccgagcggccgagcagactccacgcctccttctcctccgtcgactccttcctgctcctcaccgtctccacccaggccttcagaccctccaactcgtgctggcacgccgtcgccaccggatccttctcgggcgcgggtagcccaggctcttcctccgggggaggagtcgcgtcatcggggagctcctcgatggggggcgactccagcggcggggccgacgaggcgaggctggcggcgcggaaggggtcgaagagcggcggcttgtagctctcccccgtcgaggacgcgccggagtccaccgacgtggagagaaggcggcgggctgaggcggcgaccgcggcgaggggagccacccccgcggcggaggaggaggagaagcggcgggtcgagaggtagaggagcgcgcgggcgtggcgcggcgcgccgcggcggaggtgggagatggcggcggccgccatcggtggcgatttggattgcggaagaagaaatctcgctgcttcgatcggattcggtgggggatttgattcgccgacggaggagagagtctctagaacgggtaatggcgactgcgatcaactcgttaacaatggggtagtttcagtttaggagaagtgttaaccttagggcaaccgcgagatcggacggcgtaggagtgaccacgtatatggaggttattctgtccgtaattaacacgggccgcgggacggcgggagccgaacatgtggcgagcaagccgtggcctcgtgggtggcggcgtgtccgcataggaggagaagcaaaattcgcattggaattggcgagcaagcgacactgctttcatcgctggcaaaacaaatagtatcaggttttcttaattaaaacacggaaaatcatccgaaatcaaggcggtatgggtaatgggtttatctaaaatccagaaatacattgccttcaatttaaacaactaacatgtccgtgctaacgctacgacgttatttataatgcaaagcaaacaaccaaaaggtaacaacatatgtttcaaaaagtttctaactccatattcaaacaagatcacaagtatcattcccaaaaacattgaagaaaatctaaataaattaccttctggagtcttagcatcgacatcatttttaaataactaaattagctacaatagtattgcatcgcgctggtggaacattaatgtcttccatcttagaaaaaacctacccatcaacactatcatcactaccagcgcaaccatctgcctatcttagtaaaaagcaagcaacctgtccatcgtaatgatgtcttctttgcaatatgccacgtacttcatcaggatcctttgggttctcccaattctctcaagcatcgatcttcttgaatataccgccatcataattctttgggtctagactggagagatgagccttacatgaattcaaaagaaaactaacttacagaggctacacatgaattgtttatatatatatatatatatatatatatatatatttgtaaatttacaaatagttcttcttcatttccttttcacaatctttgccatgtacttccggcacaaattcaatggttaattaatccgggtccaattacataaaagcatgaaaacaaacaatttgcttgaaaagttcagaagtgaaaactggaagctattagtgcagattaaatcggagcacaatgaaaaatccaaatacactccactaaaccaatttaattgcaaggttacctatatggcagccaaaccccttaaatgcttagacagatccctagagagtagtagaaatccctaagaaaacatgcagttgttggttgctaaattatgcttagcatcctaattacatacttacggcaacatgatgatggtgttttaccacctcctgctatttttcattttgcaccctttcactcgtttgcatgcctccccagaaattggtgcagcaaacacgatcccatctacacctccataaagtaagatttggttcttttgacttcttctagagcatggcaacattggtttctaaatttgttaaattcagaaatggtctctctgtatcatgtacttttgttttggtccgataaggccttaaaattttgagttatcagtgtacagaatgcattacccagtgatgatgtagaactggtttaggtgctgcagctatcaagactgaaaattttccattgagcattctagcaatctagcacagctaacaactcattaaatgaacatcactgatcaaaatgcaacagatcaaaggcactggttgatatcgcatcgtactaactcaacgtagccacgcgtagcagaagcctaaaccgcgctgccaccggagcccgtcgcggggggccgccggagcccacaagcgtacgagcaacagtgccttccgtaccaactacatcagccaatggaaccagctcccagaaacaccacaacaggtaaaatctcattgttttttcagggttagcctgatcataattttcagtataatgttctcagcccgaagaaccttaggttgagtattgcatataagtatttatcatgggaatagagtagtatcaaatcttaattcagatgataagagtgctcaggtgtcgatctgtgcaacattattctcacacaatgatatcttcataagcttctgaaacttgaaaatggtttgcagagttcctgccaaggaaaaaataaaataaaattgtgccatcagtaacattggaaacaagagctctatttgatcaaagtcacatacatctagcgccaacagtctatgaaggccaatatctgtagcacgatttaataatgctcaaaatgttagatctgctcaaaattgtggtagcatgttctttccaataaaaattactgaaagtgcatctaggaccccacatttgtttttggtgttaatgacaacacaattagagggtaactaatgctttttgttgagatgtctgcaaggatgaaaaaggagtggaacttaagcatagaaagctttgtggcaatttttgtggtaaccacctctctaaaccttgtgtatcatgtgttcttgagtattagaatgccgtactattaagagggataccacatgcatataattggtagaacactagtgctcaaaatcctttatttgaagtgttcctgttttattcctgtcggactatccgatctagatcagactatccgatatccgatctagatcagactatccgaaatttcacagaactttgccctctgtcattggtctgagtgttggcaaaaaaaaatatcggactatccgatataaggtcggactatccgatacatcggactatctgaaattttcttagaacttcactctctgttttgaattgctttttattcctcttgagtgaatttcaaatcagactatctgatgtgatcggagtatccgatgacccagagactccgaaattcaatggaactttagtctctgtgagaggatgaaattcatgattcaaaaataacggaatatccgatatgacatcggactatccgatcgatcggattgtccgaaattctccagaattttgttctctgtctttggcttgcttgggggtcaaaaacatcggactatccgatgtcacctcggacttttcgaggtgggatgaaaagattcccttctgctaatgaccaaatttggtaaattctatcattattggcatcggagatgaagatcagatcgaagtggaatccaagatgaagatcattgcggaaacagagtaagaatcggctgcagtccaaatcagctaaggtcaggtcggcagagttcgagtcggatggggctagccgatatagctgattctgataatatgactaggtgtacgtcatcgggttcaagttgatgtgcttcaagatgattgccacgcatggatagagtcctgggaaggcaattgtatctattaattaggatattctatgtgatttccttagagatatgtttgggcaaaagtctgccgtaaatacttatggtatcttagagtttgttagagataatagtcgtgtccgttatggacgtatcttgtaattctcgggtataaatagacccgagccctatgtaaaaagtgagaacacatccaatacaatctcggcgcatcgccaccttttttgctttacttttatttcgacgagttcgtgctctcggattgagctgcatcggtttcgatcttcaacaagaggtaaaacttgtcatgacgacttatgttctcaggattagtgcttccatctttatgacactataatcttgtctatataattcgtcgagttatcatatatctcacataatcttcgataatatctttatctaacctataatcggctaacatctgctaatggaaggcagccgattaggttagacaataacgttaacttagattatgtgatatatctaccactctatgaaacctccagcggcttgattgtctagatattgttcttcttttcatacttaatgctgcatcagttgagtttgatctattaagtcatgcttagaattgcaatctctagcctgttttctggttgccgattagggtagtatcggagtttcagctaatcttatttgatttaactacttttatcccatatgcttaatctatatgttaaatctgccctttatgttaagatcttgtcgcatctaagtatattaggcttatgtttggtatattctacttgctttaacatcttaatatagagtagtatcggagtattagccgatacatgctagatctacctgatcggctatgctataaatgtatataatcccactattaatatatatttcgatctaagtgatttatactgtctcggcaaggcgaccgatctatcccaatcacttgatttaagtatacatcgatataaggattatatatcattaatatctacagccgatcgagtagatttagttctgatttgcttattgatatttgccaatcgatgtacgcatgacatcggcttgaaataaatgatatgtcatcggcacctagccgatcggctatcatttataggattaattgcggtttatttgttctatctcttgttgattgcaggatcaaatcaactggcacgctcatacatccgaaagcgagctttggacctgcactggagttaagcagatctcccaggcctcgtgttttctgtcaacaccttcccaacggccacattttgggggatctataaatacccccacctaactcttttctagggttacccaactcattcattcacattcactttgggttgagcttggtgctaaggtgctttgaatctttgagctctttctccctctctcaaatccctcttcgttctttgtgtggtggatcttagtggttgtggatttggtgtttgagggcctagtgtgtgtttcactcgatcttgagcactagggtttgaccaagagttgtgtggtgtttgttactcttggaggttgaggactcctagacggctaggtgtcactcccgagccaccgatctacgtgtggttggccgggagaagtttgtgaaggccggatctcgcctccgcaaggaaagagataccccttagtggaaggaggagtgcttagtgcaacctcttgaggaaagggttagtaaagacccggctcttagtgagctcctcaacagagagtagaatcctctcaaggatttgaactccgggaacaactccgtgaacttcatcgttggtgatatctcttcatcttctctttagctttgcttaattgtgccgctatagatctagtcgctgtttgcgctatactcttgtttgtgtgttagatctgcttgttgtgactctttagtggatcagacagtctgatccaacatcagactatctgattttttcggatagtctgactgtggatcagacttttcgaccctaactcagttttagcttccacataaagttttaaattagcctattcacccccctctaggcctaattgaccctttcaaatacaacacagagatcagttgaagtacaatcgcattaattaaagtacaatcagtagtgccagttagttctagctaaataaaaaattcactaaagtttccatttgaggttgtttaacagaggaaaaaaaatctaatgtgacaaacttcatttagagtaactttaattcactgccttcatttaaatacatttgtaatccattttcaatttcatttagaccgttcatacgcagtttaaagcgggatgatgcaccaacccaacgtaacctaaagtaacttggtttagacggtttgggccaacgtctttcacgagttaaaccgtcttcatcttcctaacctgtacacaataacgaaccaaagaaaatgagaagggacacgatcatgaccgacctcaataagaagattatatcaactggagcaatgtaggcacttagaaaatcatgttacgattctagtagagggctctccgggcggctaatggagtgggaggggccttgcagccgcacaccgcccatggtgctagcttgcctagccacgtgccgtcgctgccaccgatcttagtacaaagtgaggcagatgcgatgtcgatgggtggtgactcgtggctatttgcctacttcccgcatcaagtttattcattaccacgcgcaatcacaacaacaagatcaccttcgtgtacgactgaagcggcgatggtgcgctggcatgggcactgagtgacgacatcatcccaggcttcatccatccttttggcaacatgatcgtcactaaaggctccaatccaagaactctcatgccataaccacggggatggattccaaggtcagctcccagatcatatggttttagtccaagcaaatggttgtacgcgacattatccttcctggttagcgactcacctcattggtcgagagcgtaatgacgagactaacaatgagatgactagctacaatgatgaagggaatgtagagactaagcacacggtttggacgagttttagagtagcccaccacaacccatgtataactttgatctggattggtttaccggtgttggcgatatggcatgaggcccttcgaccaaacctgccgaaaccagtaagaattcaagcccgaaatgtcaaggttagtcagggcgaagcccccctccctccaatggtgaagactaggaagcaaggacggcgagaggcagggaatcacgcgggtacctcgccaagccagaggcctcctaggcgaaggatgtagggcgaagagtatacgccgaagggggtcgacttcgccatagcaagattcggcctcgggaggaccgaagaagccatcctggcccatcaagtctaagggctaattgggtcgacaatcacttgacggcccgttaagggcccatgaaacacaattacactgtgtacccatgtaaatgtccctttcataagggcaaccatgtaaattctcctgtataaccaaaaccctagtagtaagaacctataatggggatataaatagccccatagggccatgtaatagggggatcccaagaaaaattatcaatttaatacactttacttctttcccaactactgttgagtgaccacgtctttcgacgtatgcggtagtcgtttcgacaacagctggcgccgaccatggggatttccgagcgaaaccactgagagcaaatgccaccgaaaagggtcgtgaaggagaaggttacaaggcgaaaggaaagcgaagccgaggtggagatggtcgccgaagagggagcagagccttcggcgccagttgccgaagatggaggagcattgtctgcctccgcacctgcaccatcactactgccttcggctcctgccacctctgcgcaggtgctgaatgcggctgacatggcgaaggcagccgcggcggcaagggcactccagaccaggcggagatcctttcgacaagccaactgctggtgctccaagccgctccgtcgcagctggcagcagcctcgattgcgctcgccgctgtacaagcccaagtcaacccagaccccgaaacacaaatcgaagccgacatggaagccatgcgacagaacatgacacgactccaagacatgcttcgccaaatgcaagaacagcatcaggcgtatcaggcggcgaggcggtccaaggtcgcttcggccccagtcctccaatatttggcaagctacgtcccaccccaagtctatccacaagcaccgatccagccccttccgccacaagttacgcaagcgccagtatacttcaccgggcagccctcgaccgcagcagtgcatccagctcctcacgtgcaactgcaggctcagccggtcgctgcccaagtacaccctcaaccgcctggccaagtgtcacaagcaatggcagaatgggcttcggctctgcaggcgcagctccaagctttccttcagcatctcagctaaccccacagcatttcaggtacagccccttcggtccacccggaggggaatacaagtcaaggtgcacctagttggttgccgtcgaatcagccaggtctgggggcttcgccttggagtcaaagaccgcaattcgacttcatcaatgcccctcaggcaccaaccgttcggccgcaagcaccaacgccaggcttcggagcaaaccaagcaccaaatcaggtcgccatagcatggtcccagcaaacgttcgacccatccatggcggctcaacaagcatcaccaatcagagccgggtagccgaatgccatggcccatcctcaggcgcaagccgtgatttcacccttcgccacgccatacccgcagcaaggtgccgtgaacagggcaagagccgaaaagaggctatcgctgagtgggggaatcaagacccatccaatcccaccccagttcaagttcccacccgtccaacgctactcaggcaaaactgacccaaaggaattcctctccatttacgagtccgcgatcgaagcggctgatggtgacgaaaataccaaggcaaaggtaatacatctcgctctagacggcatcgcccgttcttggtattttaatttgccagccaatagcatttactcacgggagaaattgcgcgatgtctttgtccttaactttcgaggcacctatgaggagccgaagacacagcagcatctactcggcattcgccagaggccgggggagtcgataaggtagtacatgcgtcgcttctcacaagcccggtgccaagtgcaagacataaccgaggcgtctgtcataaacgccgcttcggccgggctactcgagggcgaactcacaagaaaaatcgccaacaaggagccacagacgcttgagcacctacttcgcatcattgacgggtacgcaaggggcgaagaagattccaagcgacgtcaagcaatacaagctgagtatgataaggcttccgtcgctgccgcccaagcccaagcacaagctcaggttgccgaaccacctcctctcgctattcgccagcctcagccgacgatctagggacaaccaccaaggcaaggccaagcccccatgacctggaggaagttcagaaccgaccgtgcgggcaaggctgtgatggctgtcgaagaagtgcaagccctctgcaaggagttcgacacccagcaagcaagcaaccatcagcagcctatccgtaagaaggtccgaaaagacctctactgcgccttccacggacgctcttcgcataccacggaacaatgccgaaacattcggcaacgtggcaacgtgcaagatctaaggccgcagcagggagcagctgtcgaagcacctcgtgaagcagctgaagaacaagcacccccggccgaatagcgccaagatgcgcagcgcagagtaatccaagtgattacaagggccgacccgccgatctagctatcgaagtgataaaagaagatgcagctccgaatggtccacaatatgatttcggcgggcgaaggggccccgaagtatctgaaccagcaaatctcttttgggccgggagatgccgaaggagtaatgttcccgcatcaagatcctctggtgatctcagctgagatagctggcttcgaggtccggcgaatcctggtcgacggagggagttcggccgatgtcatcttcgccgaagcatatgccaagatggggttgcccaccctagcccttaccccagcaccagcctcgctccgtggtttcggcggagaagcagttcaagttcttggccaagcacagttgctggtagctttcggcacaggggaaaacagacgtgaagagcaagtattattcgacgttgtcgacatgccgtacaactacaacgccatcttcggccgtgcgaccttgaacaagttcgaagctatctcccaccacaattatctcaagctcaagatgcccggcccggcgggagtgatcgtggtcaaggggcttcagccttcggccgcttcaaaaggcgatctggccataatcaacagagcagtgcataatgttgaggccgaaccacatgaccgggcgaagcacgcgctaaagtccgcccctcacggcaagataatcaagatgcagattgatgacgccgaccccacaaagctcgtatcgctggggggcgacatgggcgaagaagaggctgcgaacattctagaggtactcaagaaaaatagtgatatcttcgcctagggccctaatcaagtgggaggtgtttcgatagatctcatcatgttcacctggcagtcaagccggacgccaagccaaggaaacagaagctgcgcaagatgtccgctgatcaccaagaagcagcaaaagccgaagtccaaaaattgctcaaggctggggtcatccaagagatcgaccatcctgaatggctggcgaatccagtgctggtgcggaaatcaaacggcaaatggtgcatgtgtgtcgatttcacagacctaaacaaggcatgtccgaaggacgatttccctttgccacagatcgaccaactcgtgaattcaacagctggctgcgaacttatgagttttttggatgcatattccggctatcaccagatacacatgaatccggccgacatccccaagacagccttcatcacaccgttcggcacctttcgtcatctcaggatgccattcggcctgaggaatgccggggcaaccttcgccaggctggtatacaaggtcctttacaagcagttagggcgaaatgtggaagcttatgtcgacgatatcgtcgtaaaaagctgcaaggctttcgaccacgtgtccaacctgcaggagaccttcgacaacttgcccgcagcaggtatgaaactaaatcctgagaagtgtgtttttggcgttcacgcaggcaagttgttgggtttccttgtttctgaaagaggcatcgaggcgaatcccgagaaaatcgatgccattcagcaaatgaagcccccgtcgagcgtacgtgaagtacaaaagctcgcaggccgaattgcagcactcagtcgattcatctcaaaggcagccgaaagaggtttgtccttcttcaagaccctacggggcgcgggaaaattcaattggacacccgaatgccaagcagcgttcgacgagctgaagcaatatctgcaaagcccgccagctctgatcagcccagcaccaggaatcgaaccgctactatacctggcagcttcgctagtggcagtcagtgctgccctcgtccaagaaatagagtcaggccagaaaccggtctatttcgtctccgaagaattgcaaggagcgaagacaagatacattgaaatggaaaaactcacttatgccctggtgatggcttcacgcaagcttaaacactacttccaaccccatagagtcatagtgccatcgcagtaccctttgggcgaaatactccgaggcaaggaagttactggccggcttaggaagtgggcagcagagctatcccctttcgacttgcattttgttgcccgcactgctgtcaagtctcaagtgctagccgacttcgtggccgaatggacaccggcattcgtccccgagcccgaacccgtcgaacaaccctggatgatgtattccgacggttcgtggtcgcataagggggcgggcattgcggcagtactcacttcaccaagtggtgtgccgattcggtatgccgcaaggctgcagttcaacacaaccaacaacgcggcagaatacgaagccattcttctgggcctaagaaaggaaaaagcattggggattcggcgcttgctaatccgaaccgactctaagctggtggcaggccatgtcgacaaattctttgaggcaaaagaagaaggaatgaagaggtatttggaggccgttcggtctctggaaaagtacttcaccggcataacggtcgaacatttgcctagaggccagaacgaggaagcagaggccttggcgaaatctactgcttatggtggcccacattcgcctggcatcttttttgaagtactatatgcaccaaggtgcccatggatagcctggaggtcatggcaattgaccaggtgaaactgggcgaagatccatgcgactagcgaactccgtttgtgaaacaccttgaaactggctggcttccgaaagatgaagaagaagcaaagcgtctgcaactcagagccacgaagtataagatggtctcaggccagctatatcgctccggggcaattcaacccttgcttcgctgcatctcttttaccgaaggtgaggaaatggcgagggagatacaccaggggctctgtggtgcgcaccaggccgcaagaacagttgcctccaaagtgtttcgacaaggagtgtactggcccaccgtgttgaaagtctgtgttgagcaagtcaagaagtgtgaaagctgccaacgccatggccgaagtcaaaacgcgccccagtatgagttgcagcccatcgcaccaatctggcccttcgccagatggggattggacatcattgggccgttcccggtggcgcgaaacgggtacaagttcgcaatcgtatccgtcgaatacttttcccgatggattgaggccaaaccccttggagcgatcacttcggcagcagtacagaagtttgtatggaaaaacattgtttgccgtttcagagtgccaaaagagttcatcactgacaatggcaagcagtttgactctgacaagttcagagaaatgtgcgaagggcttaacctggaaatcaggtttgcgtcggtcgcgcacccacagtcaaatggggcggccgaacgcacaaacggtaagatcctagaagcactcgaactcttggaagaagtaagagtcgaagcactcgaacacatgcgcaactatgccataggcacttcggcaacttacaataaaaaagttcgaccgacggagctgttgcctggtcatcttgtcctacggaagaaggcgaacctgactgccgttggcaagcttgaatcaaagtgggaaggaccatacctcatcaagaacaagtctaggatgggatcctttcgactggcgacactggaaggagaagagttcgaccattcctggaacgctgcctctcttaaacgtttctatgtctagaacaggtggcacccaaatcgccaatttgtaaaaacgtatatatcgttatgtaagcccttcggcactatgtaagcctttcggcaaagaaaaaaaagaaaaaaaaagaggaaaatgaaaaaagacaaaaaaaatggatgtagggctattatccatcacggaggcccgaaccagtataaaacctctgtgtcctccgccttctttttatttacttgtgtgattgataatttgtggaaaaactccaaggcaaacgcctgatcagcgaaaaaggccagggggcgaaacgaatcggccgaagcatcgctcgccgaatgttgaaaccgcaacagcttgtttcgggaaacaactaaccgaacaccgttacactcgatcaaaaggaaagcaccaacgcttcctacaacatagaacaaaacggatcgaaatcggaagccgaaagctgaaaagtcaaaacctatttcgctaatatacgcaaaggggccgacacgttccgacccaacgaaagcacgcgaagtgacaatgcaaaaatagcgaaaaggagataaaacacatctttattgattttaaagaaaaatatatcaaagagtacaaacccatcaacatggtgcaagtaaaaggagcaatggcttcacagcccaacttacagataaattacatctccgtccccacaatcactctctctctaaggaatgatcaggcgaactaggttcgtcatcactactaatatcatacacgaccctaagaggagaagggggcgaaacacagactagactataacgacgctggaagattaactcccgccgatcagttctttgatgatttcgccaaaagcgaaccatatcctccagacgtcttgtacgaacaagatcgtagtcttctagggttcgcctggggtgcgctcttagccagccggcaaccttaaaaaccttatagctgcggccgtttatcaccatttcgcgataaacaggccgaaatgggcattgcaccctcggcaaacccttcaacgccacgaacttctcgttgttgtttcgccatttttcagcgggaggtcgaacacatacctttcggccgcaagcctgctagcaaagcacaaaaaaaaggagaagtgcaaaaaaggagggaaatatagacgaagatcagttccgctttcaaacagaacaattaaataagcgaaagggttatactttgccagtagaacaaagactatattgaatacaaggcgaaggcggcttaaagctgaacaaacaaaaagcttatatacaaaaacttaggctacaagaaagcccgaaagggccgaaggaaaaaataaaataaaaagacacgagggcgaagggtctcacacctcagggtggtcttggcctccgtcaccttcgtcctcgtgcccgagggaccgttccgacggcccgggatcctttttggagttgacagcggcggcctcctcgttcctcgctatcctttcaaggttctcgcggagtcgaatcttcgcacagtcccggccgccatcctcccaaaaccgtcccggccgccatcctcccaaaaccccttccgaaaggcccttagcgcagccccggagcactgcgtattgctaggccattcctccttcacgaaatcaggaaaattcccgatgtggtcgcagccgtgtgtgtgcaagaggctgagaacgaatcccgccgaaacacgagcgcaacagtccccataggcgcctgccacttcgacaaccgagccggccgcctcctgcgtccattcggaaaaatcgagcacagtcccgccttcgcccggagcaccttttgcccgagccccaaggtcgttaagggccagctggagagtgtaacaggcctccttggcagactccgtggctggtaccagggtcgcggcggcatctttggcggacacaagacgggcttcgaggcatttaatattctccttagccgaagcaagttgtcggtcctgttcggcgtcctgcttgcgtgctgcttcaaggtcagagcggagagacctattttcagcattcgccttcttcaaagtctccgccacaacgcgtctttcgtcttccttgtggcgaagatcttcttcggatttgcgaaggcgaaggcggtacccatccagtcgctctaaggcggacttcttggcacttaggtgcgcggcaaggccctggtaaaaaaaattacgtcagggaactggcgaaagagcaaaattcgacgcttaacaataaaaatcatacccgcacaaataggctttccacagccgcgcagctttcgctgaactcgttcagtttggtgaagagcccaaggccttcggttggggctatgacctggcacacaccgtccacgaacggagtgatctctggccgcgtggcgaagtcagcggggacaaaatgtggggcggtaagcgtcacgtccgaaacgctcgcttcaaccgccggggcctttccctctcgttgacgaacaggtgaaggaactgcatcaacccgttcgtccttagcaacatttgccccagcggccggggctgagacactcccacccgtcgccgcttcggcatcgctagcaggtggcggagacatgcgcctaccacgggaagctgcgcgccgtaaaaccggcgaagtaggagtcccgtcggacccctcgttgtccgaaaagccattgccgacctgcacaaccttccctttcttcttccttctagcggtcatcaccggtttcgcggctgtgctggagatcgccaagagggtgttcgccacgacaatatcttgcggccgtgtaggcgcaacatgagagcccgccctagatttcgcaggagtaggactggggtataaccatgagagccgtcatccttagaaccagcctccacatcttcctcttcctcctcatccccatcactttcgacggcaaccttcacgctgcggcgagttcgaacttggtcgcctttcacgaccgcacgcttgtgcttcttcgaagtgccaacttcatcatcaccggcccgagagggtttcgattggcttggaaattcgccggtataaacatggttcacccggccgtcggcttggcgctgtagcaagcgggcgaactcggccgtggttagagctctgatcatcttcgatgcctctatttcggcgtcttccaaagcccgcactgcgaaaagataggaacacaaccgtttagtctaaaaagcgcctccataaaggaaatatgcggcctagagcaaaaacaaaaatcttactttcaaccccggcagggagaacaaggcggggaagcccaagaacttcttcgccctcgatcacggaaacgtcccacacacgagcgagaggggaaatccgaagcagacaaaactcctcacaaaggtcccgggtgcttagccgccgggcaaccttacgaaggagtatgagccgggactcgagagtcccattgatttccatgtttggcttcgcgttgatggaaacggcagaacgctaaaaaaggagccagttcgcctgggcatcttctgcgaagtagggactgctgacgtagaaccatttctgcatccagttcctgtcccacttcgccatcgatgcaggtactagccaagcatctgaacgctccggccgcagcatgaaattcacacagccgaaaacggttttcctcggacccgccggcgtctgcacgtctttggtcgaggcgcatgcagtaaacagagcggcaaatagctcagcggtagggacgaacccacaggttcggcacatccaagcgaaaaccgccagcttcaggaacaccgacgggctaagctggggaagcctaacctcatacgtcgagagcatcgaaggcaagaagttgtcgcatgtgaggcgaagcccagcggcgaagaatgcgcgcgaagacaaccgttcgcccatccccaagcgagggaacaacggcttcgcccccgcatgatccttggccctccgtgagagaaccggatgataccagttcgcccaagtcggcctctttgacaagtgatttgccaaggaagcacgaccatccttcgccaaggttgccaggatcttcgccagttgacccggccttggtaggcttgcgaggagccatcgggctcgtagctcaggaaagaaagggaaagagccgataggctaggggcacgatgatggcgaaaagctaaaaagcaagagaatgaagagagcacgaagcgtgtcaaacggtaaaaaagggagaacgtggggggagtgaaaaaatagcaggccagcttgggggtatatataaccccgtcgcgagaccgttcgcctgccaaccaatcgagccctgacacgtgtccaaggacagacgaaacggtaaattcccattgggacggagccaaacagtaaaaagcccgattacggagaaggaaaagtccatggggcccattactattcatagtaataaaagagactaaatagcccccttcgacgctttgcaacggatgcgaagaggagattttctcaagaaatttttctaagcataaaaacaaaacaaactttactagcaggaacaatataggtttcggcaggagcaccgatcgaaagggggcgccacataccataccacatagtttgcacggtctcggccgaagctcctatcttactcttgctcgtgaggggcttgttggcgatatggcatgaggcccttcgaccaaacttgccgaatccagtaagaatttatgcccgaaacgtcaaggttagtcagggcgaagatccctccctccctagcgaagactaggaagcaaggatggcgagaggcagggaatcgtgcgggtacctcgccaagccagaggcctcctgggcgaaggatgtagggcgaagagtatatgccgaagggggacgacttcgccatagcaagattcggccccgggaggaccgtagaagccatcctggcccatcaagtctaagggctaattgggtcgacaatcgcctgacggcccgttaagggcccatgaaccacaattacactgtgtacccatgtaaatgtccctttcataagggcaaccatgtaaattcccttgtataaccaaaaccctagtagtaaaaacctgtaatggggctataaatagccccatagggccatgtaatagggggatcccaagaaaaattctcaatttaatacactttacttctttcccaactactgttgagtgaccacgtctttcgacgtatgcggttgtcgttttgacaacaaccggtttaaccgggttggatccaacctgtgaacaacctgagttcaagtaccaaactcgtttgtactcatatatgatttccacccctttttttctacttggctaagaactagcgcaatcgctaaaaagcgatcagtcgcgcgcctcccctcccgcacggcgcggccacgtggcacgcgcggagaggggggccgcagtggaatggcgcgggagcgccacgtgcacacgtttctccttttttctttcccttttttcctttcggtttttcttttcggtttttctggttttttttccctgatttggcgtttctctttttttttttctttcagtttttttctttttttctggttttttccctggtttctttcggttttaaacttatatgtatataaattttgttttcgtacgtatataaagtttgtatacatacgaatacaaagtttgtatatgtggtgtttttttgttttttttcttggttttcggttttttaaatatgtatgtatttacgtatacaaagtttgtatgcacgtatataaagtttgtatatgtggtgtttttttttcttggtttttggttttttcaatatgtatgtatttacgtatataaagtttttatacgcatatacaaacacaaagttcgtatacaacagtgtagtagtagtactagtagtatagtactagggcctgtttggtacagctccaactcctaaatttagctccaggagttgagtctggagtggagttgtggagctgactaaacccaactccacaactctagttcattttgtgagatagctccacccaactccactcccagttttggtggagctgaaactgtttggctgagcttcagcttcaggagggctggaggtgtgccaaacaggctcatagtaacagtgtagtcgtactactagtagtagtatatgagcagcagtagtagtagtaggtggtatatgagtagtagtagtaggtggtactagtagtatatatagtactgaccgtgcggacggcgggtgcccaatcgtccattagcagtccccaagatctagccctcaagacagaacccactagcaaaacgttttatacttaacctcaatttaccaatatttttgtaccgtgtaaggtattcccgtttggactcggatcgtcacagaacggaaagtctattttcgccttaaaagaaaagaaattgatgtctatttgggcctcaggatactgggcctacatggcccatatactaaaaacatccagcacgcggaaaaagtacactgaaggtccctcaacttgtcatcgagttacaaaatcgtcctccaaccacagaaccagatatccggcgtcccttaactaaccaaaaccagtcacaatagatccttcggtggttttaaccctggttttatcctacgtgacgactgagtcagcatgggacccacatgtcagaccgccacgtcatttctctccccacctcttctctccctttctcggttcctcctctctctcagtctaaatgcctgtaggccggtcggcgggagagaaggagggcggcaccacgacggcggctgctccgcccgcggagacgacgcggtggtcgtccctggcagccacgaccgcgagcctcgtggcgatcggcctcggcggcgccgcgctgctggtgtggtgggtgctcgcgttccacccggcgaacgcacgcctctggatggtgcctgcggggctcgtcctcctcggcacgcccatcctcgcatggctctccctttgcctgtacgccggcccgtgcactgccgtccgcgacgcgccggtgcacgtgtaggatcccccgcgcgagtctcgcgcgcgcgcattttttgctgcttccagctgctccatttcgggatcagatgtacatacatgttcagtgttcactgctaactagtcatactatacttctttctttgatttcttgctgattcatttcgggatcagatgcacctgcacatacatgttcactactattttgatttctttgtgaattcagctgcgagctgcagcgtgttgatgctagagggagagggacatgttgcattgatatggacatatggtatatatgacctggtgtacacagttgctttccaagattacttcctccgtgtgtgtgatatggtgaatgcgaacttggccacctcctgcgcgaagtgctccgcctcgtgcgccgctagcgccggcgggctccatgagccgcactcgaacctctccagcgacgccagccgtgacacgctgctccgccgcggccaccggtgtgtgacacgctgctccaccgctgcatcgccctcgtcgtcgtgcggcaccatggacctcccctcggcgcaggatgcgctacgtgccagcgcgggggcggcagcgcccggcgcggcgacgtagtgggcaagcgcgaccgagtgttgccgcgcgagggcgcgcatcgcctccatggctttggcggtgggctcttccctttcctcgtcaaggatgggaggctagcgctgacgaagttgggctgccggagtggcggcagcatcggcgacgaccgcaccaccacctccctgcgtgcaaataccggcgaggcggacgacgaggcgaacccccggcggcggcgaattgagagagagagagaggaggaagggagagaagaggggaaagagagaggatgtcgtatcgtcgccgccatgtcgcctgcctcctcctcctctcccgccttgcccagcggcctcctccccagccgcacgctgctcctcgccgcctgcgcgccgtccctcgccgtcgcccgccctgcagctccttcccccaccgccgccacgttgcccgccatcaccgccgccatgtcgcccgtcgccggccgccgacgccttcctcctcccgccggctaagtcagagaagggaaagtgagacgaggaagggagagaagagggggagagagagagagaggaggctgacgtgacagcacaacgctgactcagccgccacgtaagataaaaccgacgtaaaaactaccaaaggatttattgtgaccggttttagttagttaagggacgtcggatatctggttttacggttgggggacgattttgtaactcgatgacaagttgagggaccttcggtgtactttttcctccagcacgctgatgaaaattcataactgaacatccataattggacctcctgaccgtcctgggcttcagtctcgccttctgtccaccaccaatcaacaggcataaaggcctactcgtgtgagctgcagttaattttgaattctaaaacttaatttgaaggtttcattttgacgttctcttttttaaccttagattttgaattactgtacaaaaaagaataactctaaaattgccttttgttactttggtcaagtatcctccgtttacagcatataaaaaatgcatcccaagccggctgataaagtggcgccccacctggcgagcgaactaatcgaacatcacacccttcgctcgtagtagtagaaactacggaatacgtatcgatgcctgtcgtgttgaacgagctaattaattaaccaatggcacttaccgttattggaccgcgttgacatacgtacgtactcctacaggagtaatattgtagtgtgcgcccctgctaacttgtccttttcgttgttttgttactacggtcgggcttgccacgatcacgtgccggtgggataatgaccatgtgatagttaaaagttaatccatcaagtggtgaacgataattaataactgtatcgaatcatctccggtctaactaaacaataaattcccttaatttacttccgatagaaattaacatggtatttttgcctatggtctgaaaaagaatgatatgtactcccttaatatgttacatcgttgatattttagatacgtttgatcatttattttattcaaaatattttatacaattatctattgtgacttgatttgtagttagctattctttaaacatgacttaattttttctgtttataaaaataattaaataaaataaatgctgtcatatattagaaacggagatggtatttgttaaccgttaatctggacgaatacgtacactgtagttaagtgcaaaattacttgaacgggaatgagtaaactacgtgtgacaaggtattttaatttgcacagaggatgcaacggattccatgtaatttgcttaattacaatagaaacaacgcatttttgcaattgatctatatatatatatatatatatatatatatatatatatatatatgtgtgtgtgtgtgtgtgtgtgtgtgtgtgtgttaataagtatagccgtggatatccatgcccaacgtttgaccgtccgtcttatttgaaaaagttgtgaaaaaattaaaaatatttagtcacatataaagtactatccatgttttattatctaatagtaatagaaatactaatcataaaaaaagttcaaataagacgaacggtcaaacgttgaatgtgaatagtgcaaaactgcactaaaatctccccactaattttaggacggagggagtagactaaatgtgacgacgcagtacataggagacatcggacattctgatgctcatgatgtatacaatctgataagactaagtacaatgacacactacatactccatccgttccaaaaaaaaggcaaactgtgagttcccgtaccaacgtttgactgcccgtcttatataaatttttttataattagtattttcattgttgttatatgataaaacatgattaatactttatgcgtgacttatcattttaatttttttatcattttttcaaataagacgcacggccaaacgttggacacggtaaccaggatttgtcttttttagggacggagggagtaagaggcaacggcaatcccatgagacaacgtgcaatgacgcaatgcaatccgacgttaatctggttagttttaacaaggtactaccatattttaatgtatgacgccgttgactttttacccaacgtttgaccattcgtcttattcaaaaaattatgtaactattatttattttattgtgacttgattcattatcaaatattctttaagcatgacataaatatttttatatttgtacaaaattttttgaataaaacgaatggtcaaacgttggtcgaaaagttaacggtgtcatacattaaaatacggagggagtacaatctaatgagactgggtacaatggcacaatataatccattgaacgtgacaacagtaacccaatgagttctaataacaactcgcccatgcttgacaaggtaaaaggctactttcactctcaggggcggatccagcgtaggtgctgggaggactaggtctcctctaccctactggatcaccattcatagaaggagagagtataaaactcaggtgtatgcaggaaagcgtcacggtggacgcagggtttcgtgttgattcacaatacgcaaaaacgtgctgagtttacagatatatatgcatgcagatgtgttggttcggtgatcctaattacaagggattagagtcctatcctctatctatccgaaccaacatgtatccgtgcatatccatacagagaatgataagatatgataagatctaacactcctcctcagtcctaactctttctaggttaaaattgttcttgaacatctccatttgtcttactggtatagcttttgtaaaaccatctgcaacctgatctttagtagatatatatgcaatttcaagcaactttctagctaccctttctctcacaaaatgaaagtcaacttctatatgctttgtacgagcatgaaagattggattagcagaaagatacttagctccaagattatcacaccatagcttggctgctcgaggcgattctactcccagttcttgcaacaaaatctgtacccacataatttctgctgttgcattagccagagctttatactcagcttcagtactagaccttgatactgtagcttgttttctagcactccatgatacaagatttgggcctaaaaacactgcaaaacctcctgttgatcttctgtcatctggagatcctgcctaatctgcatctgaaaaaccactaacaagcagagagggattcctacagaacttaagacctgtatcaactgtatatttaacatatcttaagatcctttttacagctgcccaatgagttgtagttggagcatgtaagaactgacacaccttatttatcgaaaaagaaatatctggtcttgtcaaagttaaatactgtaaagcaccaactacactcttatactgagtagaatcctgaggtccaagcaatgttccctcatttactgataatttttctgaggttgacagaggagtactgaccggtttacactcatacataccaacccgtcgtagaagatccgatgcatacttctcttgactaagcatgagaccatccttcactttatggacctcgattcccaacaagtagtgcagatcaccaaggtccttaagagcaaagtccttgcttagttcctgcagaagtgttgaagttgcatctggtacagaactggccacaataatatcatcaacatatatcagaagaaatatagaaacctgtcctttcttatagaagaacagtgatgtgtctgcctttgaaggtacaaagcctaactcacttaacttagtacttaacctggagtaccaagctcgaggcgcctgtttaagtccataaagagctttatctaatttacagacatagttaggcatagacttcttttcataccctggtggttgcttcatatagacctcttcttctaggactccatgtaggaaggcatttttaacatccaattgtctaagactccaacctctagagacagcaagagacaaaactattctgatagtagcagctttaacaaccggactaaaagtatcctcataatcaatgccatacctttgcttgaatccttttgcaaccaaccgtgctttatacctgtctagactgccatctgctttccttttgaccttatacacccatttacaatctatgacatttcttcctttctgaggaggaaccaaatgccatgtcttgttttctatcagtgccatgtattcagcatccatggcctccttccagtgtttattattcactgcttcttccagactctgtggttcaccagaagaagtaaaatttagccatttaacagttccatcagtatataccttttctttcctgatcccgctttggagacgtgtttttggtctgatcggtgcaacagctgcttctggcatggcctgatcagtttgatcagactgatcagtagtcacatcatcatgcacgccagccgatgatgcaacagatggcgatgtggacgacgctgtttgtggggacgcttgcaccaggtgctcctcctggattggattgccatgctgctcagctgccgacgccgtcgcatcatctgtcacaggcgaagagtgctccggcgacgcatcatatgccacaccatgcacgtcgttctgtgcaccaccatttgctgctgctgctgcattttcatctgctgctgctggtgcatttttttcaccgtttgctacaatttcttcaccgatttctgcattttcttcaccaaactgatcagtaacattaggcggataattaagcacatggttatctgtttctccccctaatgaaagaaagatgcggaaccaaggatggtgaaaggaaagatatttccgctctaaggcgtgcgccggcatttgagtggagttcggagaaaggaaaaatgctttcatcaaaggttacatccctggagacatagactctgcctgtggcaatttctagacacttgaaccctttatgtaggttactatagcctagaaaaacacatctcttggaacggaaagctaatttgtgtttattgtaaggccgaaggttgggccaaacagcacacccgaatattctcaatgctgtatagtttggtttttccttgaacaattgttctaaaggacatgcaaagttgataaccttgctaggagtgcggttaataaggtatgccgcagcaagaacagcttcgtcccaaaatttaattggcatagatgcatgtgctagtaatgtgagtgcaacctcaatgagatgtctatgttttcgttcagctgaaccattctgttggtgagcataaggacaggaaacatgatgagagatacctatcttagcaaagaaggtgttgagtttttgatactctccccccccccccaatctgtttgaacagcaagaattttgtgaccaaaaaatctctcaacaagagtttgaaactcctgaaacttttggaatacttccgacttatgcttaagaaggtaaacccaagtaaatttactataatcatcaataaaactgacataaaacttctttccaccaacagaaataggagcagggccccagacatcagaaaaaataagttctagaggttgacttgacacacttgaagacttaggatagggaagctgatgactcttgcccttttgacaggcatcacaaattgagtctttatttgctacggtagaacaaggtaaattattcttgctaagaactctagtgactatgggcacggctgggtgtcccaaacgactatgccatcgggagaaggaaggagttgtggcggcatggacttgcttggcaggtgatgtaggaagggagtagaggcgacggcggcatctccccttaagaatcgtgttcctcgtgactcgatcctttatcaaaaaataattggaatgaacctcaaggaaagcaaaattatccatagctaaacgatgagcagagataaggttctttttcgcttgaggaacatgtaaaatatttttgagatgtaattcacgagtaggggtatgaatgacagaatcaccaatgtgcttaatttccatacctgcaccgcttgcggtgtgaatcttgtctcctcccttgtacttctcccgaacatctaacttgtcgagttcgttggtgatgtggtcggttgcccctgtgtcgaggtaccaattggtgtcgatgccatatgcagctgctgcagccgcactcctttcatcagggacataggtctcatcgtacctatgccaacactctgcagcgacgtgccccctcttcaggcacacttggcagatggggcggtcattaccaccccgagtctgatttcctccagtgccgcgcccacgtcctggagcagcaggattgctgcgcccacgtgtgccacggccgccgccgcgaccacgctgaaaaacaccacggcagcgtgcggccgcgttcaccgaagcatgagcttgccgaagagcttgcctgttctcaaagttaagaagctgagagtacacttccgccattgtggtcgactcattgcgtgccacaatagcagatacaacaggttcaaaatcatcatctagcccattcagaacataagcgactaaatcttcctcatcaaggggtttccctgaactagcgatttcatttgctagtgctttcatcttgccacaatactcagatatactcatgttacctttctgggtattggtgagagtaagccggacgttgagcgaccgggctttggtttgtgcagtgaacatggcgcacacctgctgccatgcctgcgccgccgtggatgccgtcgccacttgggtgagaatgtctcttgacagcgtggagagaaggaagcctaggacctgttggtccgaggcaaaccactcctggtaggcggggttgacgatcttctccgtcgtcttgtcgctcgccgtcttctcgatctccatggatggagcggcggtggcgccggtgatgtggccatcaagacgggcgccgcgtatcgcggccagaacttgcgccgaccagagcgcatagtttcctttggtcagtttctttgaaacttgaacgccaaagagaggattggtggaggcagtgcttgacgaggaacctgccatcacgccggacttgcagatcacgccggactttgaggctctgataccatataaaactcaggtgtatgcaggaaagcgtcacggtggacgcagggtttcgtgttgattcacaatacgcaaaaacgtgctgagtttacagatatatatatgcatgcagatgtgttggttcggtgatcctaattacaagggattagagtcctatcctctatctatccgaaccaacatgcatccgtgcatatccatacagagaatgataagatatgataagatctaacagagagaagggaaaaaaaaggaggggaggggaggggaggggagggggggagtgaaggaggaagaaggagattagttcccatataatgttttttctggaactgtccctattcacatcaattgctcaactggctaggtgagcacttatctttttaaagtagctcactcttttagaactagcaaaggtgttattaaaagtttgcatgcatgtatctcatgggttgggattttaatattctcatagaaattattctctacataggtcttggatcacataataattaattccaccagttaagcctctaatcgttttagactgcacggacccccggccggactcgacgcgcgtgccaaagtgcgtactacggcgacacgttcgagctgttgagcaccgcgaggagatcgatcgattgatgctcctctccgaagtgaagtactgacgttgatatatcgatcactctcgatacatacgtatatgatcaccgcacacaaaactaaacgtgcgcgcgctagctcgatcgtttcagtgagtgtggtacgcgtactgtcaatcaattatgcatgcatggcgcgccgatcccacatccccgaaggccgtacgcaagtcggtacgtggtcaagttgcccacctgagatcaaatcgcatctcatcccatcgcatcccatcgcatggtgccctgctgccgaaggcaaagccatgcaacttcatcccaagcccccaccccccgcgcgcgcgcgcgtgcccgcgcacatttacctcgccaccgcgtctgatcgatctcgcgcgcgcggttgccggagaaatccggcgtgtgtgcgcgcacatgcatgcggtcgacgggcaggtaggattttccttggcgtgtgggaacaccgcgcactgtatcgtggcgcctgaacctactgagatgtggagaggcacatacgagagtattctgcagctcgattgctactccctcctactagtactagataggtataggcgctattagccaaagctagtggctgagaccgcgaggaggccggctgggctcgtgacttccgcgcgcgccaagctaaggccgtaagctaagctaggcgtcgtcgttggcatgtggaacccagccgaaccggagcctcaaattcccatggaagcatccacgaaccttctcatcgcacacctcgctcgatctcatatccccgaaagacagtatgtgtgatgcgtgctttggggcactttgggcttacgcgagggatcacgagctagtacagtggtccatcaccatcgatcacatgcgtggtggtcgtcacgctaaggtagtttgtagtgtaagactgccggtgccagttgacaagtatactcctatgtcaaccacaattgcatatcgtgccgtctttaggcaaatatcgaagttggatttatgctgatatgggagagaaaatgggcaaaaagatagctttataagtattgaccatcgtgcattatcgaagaaataagatgggagggacgacgatctttctctgcagatgttcgataaaattgaaatggtacatactgatatatgtctaaaactgaagggatgacgtgcacaggtcgaaaaatagtcttttttttacccggcgaaaaattcttgcctagatcgagaagatacaacaagctcatcattataaagcatatagtacatatcgatctcttcatgaattaattagtaatatttcaactaatagtctctgctattattttcatcaaaagaaatattatcctctgttatatgcatgtgtttattgtatttgtaattatatttgcacaatattaattggtgttatttgacaagcaagctgctgctacgcaacccgctgattaccatattgtttgtgctggctgcggcgcagccacaacccatgcagtcgaacaactccatcgctagcaagccttaaaaagatagcacatgctatgctatcctttattgtatgacatggcacatatatatgataaaacaaaaccaattaattaagcatggttaagcagctaactgtgacaacccgcaatgcatggtagctagactttttttttctttttaagtgacaccttactatttacagacgataattaagagaccgctactccctccatcttagaaaacccaactttcccagaagttgtttttttcctaggacggggtgaatacaaatctacaactgcacaatctatgttgaatgcaaaaccgacgatttgatatgtggatgcgtatagctatgaatctatatatttatatacatctggataattgcgtacaatcagttttgctcacctgcccgaggagacaaaaactataaaagtacgtatcaccattcaagggaggcaaaataattccaaaataaacagaaaaacggtggggttttggttgttatcagctgatgatttatccatagtctgactagctatctatagctatagtaactggaatacttaaaaaagctttcacgttgatcagaaaaatctgatgttggttagatatgttgtgttaccaaaaatccatagatcacataaaaatcagtgttaaataaaatatactgttgaaaatagcaaagactcattagtttcgttcctataatttagtaatttataaatttgaaatttataaatatgaagtttctttgtattcattttaaagtctcggcttagtttttcgttgtttagtctcaaattaaaaaatactaattattaagttgtagtaattgatatggactcatttttaatgaccacaaaatagttcctaaaacaactaatgtattcaaatacattaaaattttaattaataattaaattttcttatgttcacaatctggcacaccaacaatattgtccttgcaaaaataagatccaactctcacgagtttacgagtagtactgttaaacacatacatagtatacctataactacttttctttctttttttttttgggggggggggtacctagctagctacttttctcatgttcaacctggcacacacgaaagaaaagggcatatagtacatatatatctggccaatggataaatggataataccatacatccataaggcaattttaaggtaagcgatatgcgcgagtacaacgtgccactttgactagttgcagcagcttctgggctctagctgtggcaacgaaagagaaattcgtgatcaggagatccacaacgacgcaataaggtgcaacttgccccatgaattgtcgatttcacaacctcacagcgactttgcactgattcgttgcggacaagcattggactttccgtttcctgcgcctttctgaagtcttttagtttgagggggtacggggtggagaccccctttctcttgataggcataatgcacttttttgttggtggaaattgatgatgcccatagttgctcaggcacagagagatagagaagaaagaactcagctataggtaggatgacccagcccaattcagagaaaatctaatctagatgattgtgaaatgtatggtgcgaaaacactagccctattgacatgtaagttcatacatatcgggtgctagcttaggtctcagttagttcatttatattaattagcagcacaaataacaccgagtgacagcgattagatggataagatcatgcatgctctttatttagtgctttacatgattggaatggctgaaaaattgagagatctccgcgttcttttaacccacaataatatcaggtagtacactttctgctctcctgatgtcattaattagcaatttactaggtaacacgcgctagtgacagtgagtagtggctaatgtaatgtgtgcaccactaaagtgaacaagctaggcaaacagcgatttcctaattaattaatcagcacattcttcttggctcattttaatcacctgtcagcgcactagcaacggggtgaaatgcataagctaggccagaaagattgatgccctggcatggcctgttttgacttttaacttccctagatgaacaaaaagtctaaacaaagagatttgtctccaaatcttgcctacaacaatctccccctctttttctataaaggggcaggagacctacgcataatctacagcaatctcctgtggtatttgattagggctaatgcgatagctttcgtttcctttctttattactgttagagttgtatggcaaagatctgattcttatgctatggtataggattgtttgaaattgagtaatttgtgctgatcacctattcctaccaaagttttaatttaggcccatcttaaaagtattattttcactttgggctaagtaattctgacaaaagttgaagtttataccaagtaacctacatgtcatgcattgtgattaaccatatatgttactgtccatgtatcaattacatgtggaccacttggttcaaagcgcaacatttactaacaatacctaatcaaagtgaaaaaaaaacacgtcaaagataatccaaagtaaaactttgaaaaatatatagtaaaaaacgtaatttattcaaacatcatctctatgattatttgagatcagtcaaccagtcgaatatttgtgaaactctcaatacaattattttgtgtactattacagttgtctactctctccatccctaaatataagagattttggtttgatatgacacatcctagtacaacgtatctagacatctaaatctagatgagacaaatagtatttcttgatcgtcgaaaatatgtacaagcaccggtgattatagcaacagagcctacacaaccacctgactagctttggagttacctccttcattgtttatggtaccaatcgaccttcccttatgtagactctagacaccttaagttatattcgtaagtacgtttttcaaactattaaatgatacatttaattaagaaacttcaaataaatatatttaattatgaagttataattgttaatacataataattatgtactaatcacccacgtcgtgttattcgtggcatagttaagctaaacctagcatggtgctgagttattatctctactttcccaactaacttcactcgttttttgcacgtacgttttttaaactgctaaacgatgcattttttataaaaattttctatacaaaagttactttgaaaaatcatattaatctatttttcaaatttattttagctaatacttaattaatcatacactaaacactgtttcattttgcgtgctgggacacccgagacactgcattgctcaaaacgtttcgaaatggacgatgtcgtacatatatgcgtctccaaagtccaaacccaatcccatctctattcaagaaacagtaccacagtacagtacaatggtacgggtgctagtgctagtgctagactgcccctagccagccgctgcgcgtgcagaagcagaacagaacggacatgtgcagcttgcgacttccgtcgtcgacgaaacggacagacagagtgctagacgggcagtgtcccagtaggaactagaaaagcaaagccaaacccagggaaaaaggtagaggaaaaccctcggctcggtcggccgctctactgctactgggtgtgaagcctcgcaagcggaaaagcgcgcgcggcgagggagatcggcagcacgagcacgaggaggattgaaccgaactacgtctcgctctcgcgcgccgagtcgagtccgcccgcgttgacccgtccgaacccgcccttgacctgctgacgtgtgtggcgcgggcgctggcaccgccgccgcgtctcgttgctcgccagactgtctttaatttgccgggggccacaccgccccccgcggcggcggcggtgcatcgcgttgcgtcgcgtcgcgcggatcttctgctccgcccacgacgatctccgcatgctccgactgcgtctgcgtgtgctccctaaaccgcacgcaccgtgtgaattgtgatagtctgattagtgatttagatagctcgatcagtgagcatccaacttggcacttggtaatcttacaataataattctccttccagaatgaaaagaaaaaaaaatgaaggggtcattttatacgatttgcgaaaattgacttgctggtactgacacgtcaggctcaggccccacatgcctgaaattccacgtcgctggggccagtgacaatgtccacattggtactacgtggtacgtgattatgcgggaagaaatttccatgcaacgcttccatatttgtctgtcaacaattggctcgccgctcgctgtcttgtgcttgggagttcacagtgagcgtgagagcatgcaaaatgcaacacctactcatgccggcccggcgcctgcgttgagtgcaatcacgcatagcgcggttagtaccgtctagttacagcaacaatctactactcgctatacgtacctgcatgatcactggtcttttgtgaaaaaagaactccatgatcactgatcactagttaagcagtcaggaaagttctaatatgtactctccgttccaaaataattaacttttatacgcaaatttagacacagactatatctagattcatgtgtaaaagttgactttgtttttgatagagggagtacttacataaatattttcaaagaaattatatatacacatgttgatattttaataagggcatctttggagaaaactttaacaagtgtagctagacattttctcgctcccctgaatagtctagatatttcgacttctgagtagatagctacataatccattaaatgattggtgatctaaagttggccaacttatctaggttctcatcaattgtgtattcgctgagtgcttctcgcggaatccagctctccaaatttgagtaaatgaatgtctagatgacatgatttctcaatttaagtactactccttatatctctcaaaatataaggacttttgtcaattttatgaccaattaagcagtgagataaaagttcattatgtcccttattaaacaattaggaattggtggctgaatgttgggactaatccatcctggagtataaattaggggtttaaatctgattgcacatgttatataaattatatccaaatactactatatatatcactaagattgtaggacccaaggtataagttaattatttaagggcggggcttgttgaatttccaaagttcttttataagtaacataaatgatcagtccctaaacttgtgggggtggtgtcatttaggtccgtgaaattgaaaattatacatttagatccgtgaactttgtttaatttaccactcccggtccaatcgctctttgacacagctaactgcttaggtgacgtgccacgcaggcaatacttttgcgcttagacccctccgcatcacagtgcgccacatataccctctttagctacaatgacacccgaatccccctaaaaatatccccaaatccttcctccctctcattcctctccttgcacatacagaaaatgatgccctaattaataatcgtcattgttgtgcactccacaatggtcctcttcttgcacaacgagcactttatcaacggtaccttcttctggcgactataagacgaggacgagtttggagaagccatggggatggcaagtgtgcaagcggcactaccccgcctccccccactaattgatccacactgcgctacctcccgttgctaacctcgtcgtcaaaaccctagccgattcagagatatttgggaggttctgtttggaatgcactgataagggcaaattatgtaagaaaatatatacaaagggggataaagtgcaaaaatgttgtctacgtagcgcgtcatgctggcggtcagccgcggtcaaaaggcgattgaaccgagggtgatacactaaaccaatttcatggatctacacgcgtaatttttaagctcatggatctaagtgacaccactccacacgtttagggaccagtcatgtattttgacatgaagagagtaaaaaaacgatgcaaacaactttgaatttttcaaggttttgttagaaattaattcaattcccgccaaactcctctgaaaattctccattccaaagaactgcttagtcggcagatgaggcacacacttcgccatcaaaattgggttacagccatcattccgttgctggcccaatgataatcatttcccgttccgttttaccagttcaacaatcagcgactagtgtgcttcctttttcttttttggaccaattggcgtgctaattcagagatagatagagaaagagaggagaaaaatatcagcgaatcaacaccgagaaaaccttctcatggaagctgacagttcgcgagtggtgcttaggtcggcccagccacgacaatcgcgcgggggctcttttctcaggttttccacttttccttttccgcttcttaattaatacaagtgtgaaactacgaagaggaaaatgtggctagcttccatgatttattttaaaatattttggttcttttttaaacattttttaggtatacccttagaaaaaattattgtagtaatggatcacttctgacgctagtcaggttagtgccatggaagtggatcagtgatgaatctagaatgaaatttaagtatgtgctcatatttatgtaaattattttagcggcaaagtaaatatatatatgcctatcattttttaaactcaattaattaatacataaacaaaacaaagaaaataatgaattgtataataaaatcatgattcgaaactgttggtgtggtccatggccatgtcaatagtttaactgtatggccaaattactttattggtttttgaaacattaaaaataattcaaccaaaattgacaaattggtattctcaacgtttactaattggcacatcaggtacaatctcagaatctgctcatcaattatgtgataaggattaacaagctaacaagaaatttggttgattaatctcacaacttttaagttttcaccattctcattggctcttagtaatcagtattgcattcttgcttgcagtggctgataggttggagggcagatctggcccttaagccccaactatgaatccgcccgttgagagggccagggggggaggggggttgggttcgatataatgccgttggcggagccattggatctcggtgctaatgaggttggtacctaaaaatgattcatttgttaatacgttttttccctacaatctattcataaaaaggtttttaaaaagatcaagatgtaaacaattcacgctagctccccttttattcttttagagaacacacactctcgctctccattttcactcccttttaattcccttttccttatctgtgttttgaggtgatgcatgcaacgccgcttggctggctgggcccacagctcagtcgcatgcaagagtgtcgtagtgagcgtagtagcagcaagcagtagcagtagagctcactcgctcgccatgcgcgtgccgtgcggatggtttttagnnnnnnnnnnnnnnnnnnnnnnnngctcgacatccacttgggtttcagggctttcagagctgatcactcctgctctgctaatgctaacgttaatcgtcactctcacccctcccctcgtctcgtctaaattatctgaacctgacgaggtgatgagttgcgaaaacaacgtgtgtagtgtcacgcagaaggccacgcggatcatcacatctggggagagcgagccgtgtcgatcgatcgatccgatgtaacagcgcacgcgatcgatctgcaccgaattctcgcggtagaaaacatccgtgtcggcataaacaaatcgaagcgatctctcgcaaaacgctcgctcgcggtcgcgatcagcgtaatgataaccaagccagccactgcaacaaaaaacacagaaaaaaagggagaaggatcgagtgcgcgaggatcacaattagcggcgagaaatgggccggggatattgtgtactagtgtaccactcggctcgacactggagcatgcaaagtgtagtaattaatcaagacttgacgtcggagctttgcttttattaccggtttctagaagtgtacagtaatcctgtcaatcctacagagttcagctcgtacatacagtagtggcagtactgtatttactcaaaaagaatgagtaaaatttaacggacaaactttagtaacagcagcatcaacactagtataacggctacactttaacttctttttttttaccctaggaagtaaaaaaggagaaagaaacggaaaagaactggagttagaatagtctgggagctaggagtccaaaaatggcatcgtgaggcgattaatcttgttctaatcccccagatagcttctctccttcttctaatccgcttctccgctccgctacgcgtccccggcggttgtgcacccgcgggtgtcgcgcgcgcgcgcgctcgctcgccgcggcggattcccatggcggccgtgctgacttttcacacggcggcctgggtggggcaccacagctggtcgtcctccatgctcgtccagaagctatcgacgtcgaagccgccgatctcgaagtccgcgacggcgaggtcggggaaggtgaggccaggcagcgacgactcggacgtcgtccacgtctgcccgccctggcacggcggctgggccagctccagctccgtgtcgcgcatggccacgccgccggtggcgctggaggcgtcgcaggcggtggtgaaccactcggcgccgtcggcctgcgtgggccagctgggctgcgccccggcgccggagtccgtggacagcgacgacgacccggccgtggtgctcgacagctccggtgcaggcgtgccgcccgactgcgcgccgccggccgccgcgcagtactcggctggccagcagctggcatcgggcgccgggagctccggcgactcgtagagcccgtcggagccgccgtgctgccacgacaggggcggcgtgtcggtgccgccttcctgctgctgctgctgcccggcggcggcggcctggatgcgctcgacgaggcggggcatccagaggtagcgcatgacgtccttgaactgctggctgttgacgtcgcacttgagctgcttggcgtgcttctgcacccgcgtgcgccagtagttcttgatctcgttgtcggtgcgtcccgggaggtgctgcgcgatcttggaccagcggtttccccaccgcgagtgcagctccaggatgagcagctgctcctgcggcgtgatgttgcctcgccggaggtcggggcggaggtagttcagccaccggagccggcagctcttgcctgtgcgtttcagccctgcatgacaacaaccaaaaaccaagattaatttttctcttcacgtcacatcaaaatattcacatgtagtacaccattgctaaaacatagtatgcagcaactaatcaattatatactaatgcagttatacgcatacgacgacggcaggatggatgatgtaacgggggagggatgagcaactaaaaatatccctatgaacaatgctagctacgctgctaaccactaaaaattctctcccctttccctctcactcactatagcttctagcttagctggttggctgctagagaactcagggtagactcgtagctatctgtgtttccagaaatcagcatgtagatgcaagagcgactggtactttgcgtcctataattgctcatcaggctaagcatgtacggacactcagctcatggaattgatcgatgtgtgcgtgcatgtaatttatggtggaattgggagctcgatcgatcgagatcgcgatcctacctgctgatcgggcgagcgagttccagcggccctcgccgtgcgcggcgatgtagttgacgagcaggaggtcctcctccaccgtccacggcccgcgacgcaggtcgccgcccatcacctcctcctcgctgctcgcgtccctctcgtgcgccatgtccatcgtcgaccgatccggatcaaaatccctccctttcgagtctcgatcgatcctcgcgggccagtcgattgatcggatagatcaagctagtagctagatcgagctcaggagattctggttgttgtgctttggtagaggggtactatatatgcgccgttgctgtgctctctggatagatggatggatggatggatgtgtgctgcgatgaaactggcgggagacggggagggaggtgtcggggtttatatagacgggaggagcgcgaggaggaagaagaagaaagaagaaagaggcgggtaggctgggctggacgacttggaaagaaaggaccatgtgggggagaacgccgcaaccggggagattagtttacgccttttttgaagtttttttttcccttcttcttctttaaaagccaaaagtttaggcgattaacccccatcgtggttaattagggataatcatgcgattaggattaattaaccacgccgctaatttaatcgcccgcgtacgtacgtacacgggttggagagactcgggggacttttgcggtgggtttgacccgttgactcgtccagctgtacaggcgtacagctcactcgcgcgcgctacacgcgctcgcgccgtctgcctacgcgggcctctgccgctggggcccacctgggtccatttctgtcagccagttgggagctacctcagcttctagttccggtgggaaaagagatacggagtaactacgtataccttatagccatggaatacacaactgatgatggtacagatatactgccactagcgtatactactacttactactactagcagtattggagcatctgtggcaaatgggcacaataattgctgctgcacaaatcacaaatactagtacgtatactatcggtagtgtagtacaccggtacggacaagtagtggtattatcgcaaacatgcgtgtacacctctagtacagtgcgtctgtgcatcaccatggttctacactccagtcgtaggtggtagctggagtatattataaaatatcagggcatccacaatagttatctatagactctctataagatatccatatcagtatattttcctacttgaaagagattaaatgaagagagagagagtaaaactatctaataacttggagatagtctatagagaaaaacgaggtaatggatgagagagctatagatatccatgtagacatactattgggatgatttactattagtctagtctattgttgagatgtatatattttatagagagcaccttactttaccattgcgggtgctctcaggttatatatagggttcacataaccgcttgtgaaacttggaggtttcaaagatggatagagttgatgatccgcttagtaagccaacagaagttaataaaattaaaccaaaatttaaactatctgacaattttttgaatttatgtggttttgaaaggactccgtgtgcgaaagggcttgtagcctaatggttacaagagcctcagtagcacctgaggtcctgggttcgactctccatgagagcgaattttccaggattcaacagcgttgtgctttcagtggtaggcgatgtttgtaaacctggttataagtcctatcctatccgaggtgtttggagctagcacataaacttcagctgacaccataagaggtgtatgagattatgtactattttcagtcaagaatatttgatgttaacgttgttatattagtggcactactgtcaaattttatcgactaaataaattactatcttattaaaaatatcgtattaattggataaagaatttgttggattatagtgagtcatgattaaattaattgtgttacatacgtacatctctctaagagttatataccaaatcggattctacacttaaatttagcatagctcaatattgcacacaaaaacaagctacttacttcctccgtaaaaaaaaaagacaaaccatgaattcccgtgtcaacgtttgactgtccgtcttatatgaaatttttttataattagtattttcattgttgttagatgataaaacatgattaatactttatgtgtgacttatctttttaatttttttcatattttttccaaataagacggacggtcaaacgttagacatggaaaccagagtttgtctttttttttttttatgggacggagggattatgtgtgatgtctgaaagaagccagaaacttcagctgccaacccagtagatgagattgcttgtacatattgagcagcaaaattgacttgatcagtctcagaatttcgactattccaaccaggagatcattgttggtggccgaaacgttcggcaaatgttcatctcagagccaccgcctcttcgccgagctttccccgtatgagctccccaggtcccctctgcgccgcgccgccgccttatctatccatcaggaagaagaatatcccgaaagatcttcgcatgatttgcgacgatcgagacgaacaagatcgcctcacctctccagacgcgtgcagctgcagcaaaagcctagctggctggctatagccgctgcatgctacggctaaactgatcgatcgatatcgacagcgatctgtaattcccctgcacacacacacaacaccccctcacgcgtcaattaatacacatcgtccagacgacgttacgtacgtacatatacgcgtttgtcacactagggcggcagcaatgcatttccgctcgatcgatcgatcgatcgattcaactttcgcggtgcaacagtgtgaaaattgctgtacaacagcaggcagcagctaaagttgatatacacagcgccccccgctgcactgtttccaccgtacatcgcgcgcgcgaggaggaggatttttgacccattttgctcggattttagctccgacaaaccgatcgatcgattgacaccgcgagcgatgcgagaaccagcggttttttttgtcaagacgtggaagacaaactccacacatgcggtttgttttttcaaaacaagataattgaaaggtactagtaaatcggtacaagtgttctagtattaattgggcggagtcgtccttgactatttaggctgcgttcgttgtgatgagttatgggggattgggtgagaaaaggacatcgtattccgcgtgcacgcttcccaaactactaaacggtgtattttttgcaaaaattttctataggaaagttgctttaaaaaatcatattaatccatttttaaaatttaaaatagttaatactcaattaatcatgtgctaatggctcacctcgttttgcgtatcttcccaatcttctcaatccccctctcctcaaactcacccttagtactactagtatagagatgatgggagagtcaaccccaactggcaagagtcatattctctcattgatctgccggggtctgtgtgaaacaaatttaaaagtcccaagttgcagctttgtatacgcaggaaaaaaacggatgctgagaagaagagatcggtgtggtcggattccacaccggggttgaaaactttggcagcttgaattggattcttatgtgccgttttttcaacacatggaggtgctgtttttttaaatttattttccaactctctgtttctattttatcccctgttttttcaacacaaatcagtttcaggatggtacacttgctcacttgcttgagaatccggtttgttttttaagctttgacaggctgctgcagcggtagagtagtatagtattgtttttatttcgaacggtcagcagtatagtattgttggtttggattttgtccatgcacttggcgacttgtaaatttgtaattttaaacgagaaaccggaccaaatctgccaatcagatggcgtccacggtttgattcccctgccagcttggcctagtctgttttgtatttgcagagctatgctgattgctgtagttctagtagttgtagtagctcgcaaataaaggtcaaagtgtttgctgagttggactggcgtgctcgttgacccccaactacggccaaggcaaagccacttgtggttaatatattcataatatttctgttcttatgcgagaggtcgatcgatctaatctatgtcgatcactgtcttcatgtgacctgcagcaacgcatatgcgtacaacagttcgtgtccgtgatggtcagtacatcgaacattgctctcgttttggctcttcacgcacattctcatgtgcgtttttttttaaatgttggagtgtacaagtaaatactcgtcctatcttaaaataaaggaaaaaaagttcggataatcttctagaataatcgtggaagtatgaattatccttctcaatttttcatacaggacgaattacccctcctctcactctacagtggttttgattctacatggcacacacacacatagtagtccagtcaacataaaaataaaaaatggtgaggcccacttatcggttatgtcttttctctcgatcaccacatgtgggtcctaccttttttatattttcatattgactggactgctacgtgtcactattacaaaaacagtcaaataaggtgttggttgggaaccggctataggtgtcggttttccaaccgttacctattggccggcatctatgcgaatcatatagttgccggtttaaaggtgccggttctttattttttaaactgtgggaggtcggaaaaggttaataggcgtcggttttaaataaatcgacacctataaaccagtccctatgagggtttttgtagtagtgtgtgtcacgtagaatcaaaactgctctggagtttgttgaggattaatacatctggtataaaaaaaaattcgagagtaaagaatgatttttttaattgaggggggtaattcgtattgccacaatagttgaggggtaattcagaattttttaaaaatataagaatcaagatgtatagattcgtatataaaagttgatttttttccataacaaaggaagtagggcagtttagtagatacggtcaagttgtgtaatgcaacgagatttcaaactttttgttgcacggaattggactctaccttgaaattttctagtattccaaatatagacaaaatatccacactaccgaaccctatggatttattttactgtagcttatattggataatatacaacttttgggattgatattgtgatcatagtgagaaggcttgttgcttagggtaaaaaaaatatttaaaaaggatattacccaggtgtacagcataaccacttctgaccatgatttttccttccaagaacttctagatctgtagtacctccggttcctaaccaaaaaacaaacaaacaaatttgtagccacttgatcagagtttataaacaaatttgtaaccgcaaaattaattaatatcgatcacatcgtacttgccttgaactctcaatctaataattttctaaagttaaaatagtaataaccagcaaattataaactcaaagtggactcactattaataaacataaaatttaatatggtgtgaggtcttaattttattttatttcttaataaaatgatttctatattaaaaatattaaatataaaattgcacttggcttgagtcttgattttagtttaaatttggtaatttcaaaagtcagaatctattatatgaaattgtacatttcttggactataattttagtatgatagtaccaatttaattccaaaattcagtattaatgggcaaactgtaattgagatgattaaattattcttcttttattctaactgtatattttcgaaggtacaaaagccagcgacgaatccttaaccttactgaatccctgctaaatacgcaccctcatcaagtcatctgtgcattgtttgtaccaaccaggatttaatccatcttatataaatgaggtttgtcatgcatatgcatcctttataaatgatccaattaaaatggatgttcaaatttattttctgtttctccgatcaatatgtgattgtgctcgagatttccagttgatatacttcctccatccaactgtccatcttttattatgtatttttataatattttaaaagatgatatattaattaccaaagtgctttgcatgccacatataaccatccttacttttactggataaaaaaacaaatttatttcaactaaaaagatacgcggcgagatttttttagttgatcttatcaagtcgtttcctttcaactttcttttttgcagatgggaaaatgacgagtcgcctgagttgaggaggataagctgctgtggcagcctggcaggaggccggcatcacgtatacaggcacgaccacatgcagaggacaacagtggaacgttgattccgaccacccattttgatgacacgtggaaaatctgcatgcatggggactaataaaaaataaaataatgcatagatatgcactgggggcgatctcagccacaataatcttttcggtgcctaaattatgtaaaaccccccgtttttctcatcaatatcgtttcgcttttcggcgcccagtgcttctttatggactatggtacttgtgatcattgatcgaccactcgccgttagaagaatgttgatgaagtggaaatccggtccatttccccctttttatatatatcgtaatgttttatccactaatgcggcgcattccaacggaaattaaagaaaaaaaattcatagttaccattcttaatattaatctaagaattcatatccatgttggaattttatatcttctcctcatgctactgtagttgaaataaatattcaccgtttgatggttatatgtaggagatagtggtggtagctagctatggtaggagatgataattcatcattcaccattaccacttatctctcccttcgaaaatataatcatttttagatttcgacacggtcttcgagatactactttgaccaataatatgtatagaagtaaaatattttaaataaaaagagttgcatattatgataatttgtttaataataaatctagtaatatcaattttacatgatagatcttttctatttttttacttttaatagtcaaagttaaaaatatttgacttggcactatactaaaatacttatattttgggacggagagagtaagtcttttcaaggagtacaaatttttctagtttatgctttatcgtccatcaaatatttacagaagtggttaaaaaataatgtatatgtagcaatgataatcgaaattcctatctctcaacgctgataaagtgaaggatgatgtaatgtagggtgaaatttatttattttttcttttgtagaggtggggaggacaacgacgacatgggtgagctcgtgatctacctcttctcgaacgtggtatggtcgtgggaaggagaagataagacgataacgttactatttatgcacaaatcttgatgcagtttacaaaatcaagtgaaaatttgcggtatttttgggtgaaactagacagtaaaaaaaaaaaaacttatactgctacgcgctactacctacaggatgattccaagtttgtcgccccattttaatgatcaataacacacagtgagtccgctagtttcttagccttaaactaaggaaagtatcatgtatggcctgtcttttgtgcaacctatagctagctcgtgtgttccattggcaaggcgacagctccggtctcaaaagagccctccaaggacaaggagagccggccgcaatggcgatcgaatagtaccgtccattattgtagagtatacatgtactatctcctaaactactattgctacttccatagctgaagttaaagtgaagccacaattagtttttttttttcatggcaatcgtaacccacgttttcgaatcccagaactaaaaaaaaagtacaatataatctcgctgaaaaactaatcgtcgtggcctcatataaatcaggcacgattgcgtcggcgacgagtaaattaaaataaagagtgcagagacagagagagagagatgcatggctagctcgtgcttagctttttcgtcagtgttatgttgcagctagctataatatatatatatatatatatatatatatatatatatatatatatatatatatatatatatatatatatatagacatacacaagtatgtaacggctaatggcttagtgggagacacataagattagcagcgtgttgttagtggaaaagcgatcgagagctcatgcataattaattagtgacaaacgtgttaatgttcgatccaggaagcactagtttgtgggtcagtatttgtaggcttcaaagggctcaggggtacaaaagctgcaagtataataacctgtttcaggtagtttcggccgagcactttacgtgttccaatccaggaggcggctgcacatcatcgacaaagtcgtagtagaattaacctgggaagtgttctgttgatcagcttataatatagatcacatgcatatctctactggttttaattttgtcttaatatacgcatgacaagttattgccagttctggtgctagcaaaacagcatatatatatatatatatatatatatatatatatatatatatatatatatggtgaaatgttcgtttagaatctcaattcatgggcgttaactaggagatatggaacgaaaggaaccggagaactttccaacacaaggagttgccggcgctaactctgctagccaagataaaggaggaagcaaaaacatgggggttggcgggcgcaaaaaatctcgccgcctggttgacaatgtaactgcctatagttagggccacggccctaggttttttgttttctgtactttatccttgtttgtacagttttcgtctcctctattcaatgaaattgacggcctcgtcgattcgttcaaaaaaaaattcatgggtagatgctacaaattaaacaaaataaaatgcaacagatagtgtcccaaaaggggcactacatgtataggagccattttatatatagatgctgaaaataaggtgttaaaaaatgaaaagaaatccgggatgaaaggaacatccctaagcttaagaacaggctcaagaatatgtcccttaaagcaagcaccacttgtttgatatgcttagcatcaagtaggacaacaattttttttataaaaagtttctatgtaggcacatcatcttggctagctattccttccattttttttctcctactgatgtactgaaacaccaacaaattaaagttgctcatatccttttccaacccttttcctttttcttgtttttgttttcttgcttactccttgattcgagcattttatatcattgcattgaaactaaccaaccgcgtcctacgcgtctgcttgctagtatatgcaaaaaaaaaaaactttgatgaaatctagaagttgcgtttcaaattaagccacagagaacatattccaaactttacacacttctgctttaatgatgtggaaactaaataacaacttgagctctgttttggaccctgcctgagcatatataatcatctgtgtagaacttgacttcttaatgcaatgtgtcagtatcagcacagcatcagctaaaaaaattactaatcagaatgaagaataaaaacatggtgcactgacttttatgcttgcttgcctactcaatgctccatgaagccaacttttttaactattggtgtacaaagctgaagggaactttgcatttgcattgtacatactggtcctccttttcagcaccagtactcctaccactgttggttccaatggtaaagcaagcatataaactggtgcctcccatgatgactaagtttagataaaacatgaaaagctttttacaacatgtgattggatttgtctaaatactctggatgaagcatctgatctgaggatgttctgagggccgggactcctatttcggagttaaaaagcttccaggagagtacaataattggggattctgttttaaccttatcaacattaacatcaaaaagaaaagttttggaggtatacaaaatattatcattattttagctggtactaataatgtggatgatcttttaataaaaatttgtatgtaaaggtctacgaattgcggcagatttagaaagtatatgggacattcttatgctgcaagttagcaagtatgcgcaaaaaaaaaaggtagtatgattaaagaagcccaattgggacaaaactttgtgtcattaggctccatcaagaccgtacattacaatacttgtatatttgcatgaactacgatcgatatggcaacatatgcgtacatgcgaaaatatatttatagacgcaatgacaagtgtctgcacacaatagaatacttggattagaggagtggccactagcatagtgacaaaaagctttagaaagttcttccaaattaaataaatgttgtgtgaactattaattagtttacattatcatgtagatgagagcatacatattcaaaaactggcggaatgccatctacttatcattctgaaaataaaatgcaccaaaacgattttacatcattacggtgcaacggaattcttgcaagcatcattgctgaaagatcagcgagcaaatgcacggtaaatttctttattatgctatagctatatatgtgggattcccctaacctggtgaattaaaatggatcagagagccctcgtagccatatgccataggaaaaggatatcaccaagataaaggacacttatccacacgacatgaagctttcattcataatgatgattctggctgcaaatatatatgacaaattgcagccgttcgtgtatgacagtaaccaacgatatttgcatccttctccctccaattgcacatggatatgtatatttttaggagtcgacgtcgacgtaattagctcagcaaagactcctacatggtagtttttaccaacctactcgagatctcctatcatgagtcgccattaatctagctgatgatcatgactagctccctttgcattttaaaggatgctctctctcaaatctctctctgccaatgctaatggctgccacggcattaaccagcagttcagctgctacttagcacaccttttttcctccttatattactggctctatatatctgatcacacattcacaccaagtgttcgctaatggctagtgttatatggacatatggtccccctcctgccttaattatccattcttttcgagtgattaagcagcaactggaagtaagttaattaagctatataattgcgcaacgagaagagaagaggtctatgtgcgttctagaaccgcactattctcatggtgcgcgcgcgtgcgcgaggcggacagcgacgatcacgcgcgcgcgtcgaacgcgtgagcgcgcactgctcgctctcgccggtgtccggacccgccgggccgtctggccgccgcctccgcctccgccggcggcccgtatgaacgctccggcctttacatttatcgtgttgaacctgtcaaacttgcattcacgcctcccgcaaggcggcgaggcagtcgtagcaacctactgtcccgtcttaaaatagaagtatttttagcatagtgtcaaattaaatatttttaactattaatataaaaaactcaatcatgtaaaattggtgttactagatttgtcattgaacaaactatcataatatgtaactttttttaaaacatattacttttaataaatattattggttaaaatagcatctcgaagactgtgtcggagttaaaaatatttatattttgaggccccacatgtcagcctcctttaggtcgtctctttttatatcctatacgtgttggaaccggccggctacggatgcgatgcacgactgttccactagtataatctagcgtttgtattagtgcatagttaacggtggctagtgactaatgtactgtacagtacgtgtggtctgctaattgctcatcgctaagctagctcgaccctgacacgattatattgagccgaattagcgtctttgactcgaactgctttcttctacagttctgctgctacacgtatacgtactggtgctggctgccagtctgccacgatcggacgtacactacatttgttttatctgcaaaccattaaaaaatgcgtacaaagtcagtacaagtcgccagcttaattagtttagcttaaccgtagtttaatacttactccggccgtcacgtgccgacctgacgttagtagcttttggactggagatgggtcccacacgtttgactgacggacccgacccgggtcgagtcgatgcgtggcgtcagatttctttactccaagcgacctctggtcaaaatgctgagtagtattatccaaacgtgcaggataattaattagggtgtcaaaactaattgttccatgtttggaagcttttgcccatggcgacaaatggttagggctgcaaagagtgtgcaagtggggatcaagtgacgatcatgcattttggtacaggacaatgcctttgaccttctggggcgttaggtgccaactgatgatgatgcatcctgcaaaaaaaaaaagggagggggactttagtttgttcgatcgatcgtagtgtgccgaattatatttatttagggtttttaagttgtgttgatgtcaatgcaaggtggttacaaaaatgaggacttgttgggagcactcatttggcttctagaagagattttggtagggttagttggtgattttctgatcaaatttgtgcagaaaaggaattaaactgatcgatcgtccgatttaattagttttttttgtgaggattcaactagttagtttgaagcttgaaaatgttcacatctttcgaataaaagaaactagtctgagaattaattatttatgtttacacactgctatatattgatatatatcgacggcactgattaaatatgcagccacaaattttcctcaaaacaagtatgctgccacaagttaagtatatatacttccttttgaaacctcacaagttaatactaaatccactcagaacatgtagtgcttacccattactgatgttcctgtgaatgtatatgttgatctacagactggtcactgtaactgctgaagaaattagatgtactgggattgcatatatgccagccgagaagcgagaatgtattgatcacacgcagcatttcttttgtcaggtagggttacatatataaggctcattggttcgagttgctcaagagtaatgaagaatttttgtgtgtgccactataggacatatagtacatatgtaatatccggagataacaccatttctcttgtttaaactttgaataaaccaagcgtgcaatgaatatactactacagaagtcaaatagtgttgagtatgcaaagaaggatgccactagattgaactggtttgactcaaaacaaattttgttattttatttttacttaaggacaaaattgagtaggtgcatcagggagggagtactaaagttgtgtgatgtggacgaagtaaagtgtgtgcatgattctcccacttagattaaaatcttgtttgtcacagttacacacataaatgtagtatctttagaattttagtgagacctacggaaattatttttcggctccaatcttaagtgtgtgttaaaagtaacatattcatgcatatgctccgtgtgcattttttaatgtgatcgaaaaaaaaaaggtatagcagtttaaaaatatatagtccctccatttagactcatcactattatgatttgattttcttttctttcattgagggggacggagagagtaggggaaaaggtataaacattcttttttttagaactggtataaacattctagaatgttccttatcagcaagcaggtcctagaaaattatagtaccatattttctttggagaatatagttctgtgtttagttgtttaggaaaaaaaatttgacgtatacggacacatgtttaaagtattaagcgtagactaataacaaaataaattatagattgcacctgtaaactgcgagacgaatctattaagtctaactaatccgtcattagcaattatttactgtagcagcacattgtcaaattatggcataattaggctcaaaagatttgtgtcgcaatttacatgcaaactgtgtaattggtttttttattcacatttaatgcttcatatatgtatacgaatatttgatgtgacggaaaagttgaaactttaaagggaactaaacgctccagtactattggttgcaaactttgataaatttagtggtttagagagaaggctagaggagatcctttgactggagcatcgtcatcgtggtcaaactcgacaatgcatacaacaagctatagtaactgattagctagctactactatatatagtacgtactgataggcaatatcagaagttaacaagattatcatggagataagaactaagggattttctttgaccgcatataagtaaacagactgttgggatgcatttggaatgttggatcgatttccatacggttaccatgagaatttcaccccaaaaaaaatcggtttttgctatatatgtgtcgacaaattattttgccaaaatctattgaattttcagccaataatttggcgtggagattagtgtgtgtgactgattagcttggtagtattagtactggattttttttcttgctaactgctgcatgcagtttctcattgtcttagactgtgtttagttccacgctaaaattaaaagtttgaagaaattaaaacgataagacggaaaagttgaaagtctgtgtgtgtaggaaaattcgatgtgacggagaagtttgaaattcgaagaaaaaaagttgaaatctaagcatggccttagcgtaaatttattagactttgtatgtggatttgatcccgtacactcacatcacgtgcacacgcctctccccctaaattttaggtgtttttatgtatttacatgatacttgcatactaattacatatgcaattttgaaacttatatcgtaaatacactaaaattcaataagtaaattagtaacttacagtgtaaatatatcctgactattttcatgaaaaatatgccgtcataaatattggtagtcccaacaaaatctccaattcaaacagaaggttagttcaaagagtgtttttcggtccttgaggagattataccacattttatactaaaagtttttatctctctcaaagaccataaagttcctcatataggattgaatagggatttgagcattttctgtttcgatgatacatggagaaagattagcaaagtcgattaggaccacaaatttaacagtagaagatatgattcgttctttctaatacatgtaaaatacattaattattattttgtgatgagacgtttgtatattggttttgatatttggttagatttaatcgcgaagtgatgctctctggatgcggttggtcagatcggtttgtacactatagtcagatcggacaaatgacgtgaatagtgttttttgttttttcagtgaactagagtttggttgtgcgatcagaccgagctgagtgcgccggtcagaccggccacctgacggtctgactggctagcttctgattggaatcggttttgagttgtttctttgattctcaggattactttatgtttattacctctagataatttatgtatatatgttatactgttggtgtgctaatgttgagttaattaagttgaaaaagaacttgtgctcgagtatggtttctcatctatttatgtatagatgtattttaatgcctcgggagagtgttgcctgtgatggattaggagtcgacttagaaaaagttgatgtccgaatgataagaagattatacgagatgcttaggctaaagagaaaacgcatgattttgaaggttccatatggcatacaagagggattttgtgcatatgggatgagaagtcaaatttggaaggagtccaaattttgggaaattatagtttgtattgtaaaggaacaagttgtatactatttattcaagatggattatggcttttgtgtagccaccttagggtacaaatagaagagtggttaaaacctctcggtattgattttgagagagaatagttttgagaaaagtataaacttaacctacagttcgagtttagtcaaaaattgagaggggagtgtcgttggtgtactttgtaaacataattagaaacaataaagttgttatacttccaaagagttattcgatttgtatttttctttgtttcggcgatcaaactagcaaaggtacggtcgtcagaccggtgactacacgatggtcagaccgatgacacctgggcagttagatcagtgacatctggcaattacggctagaaggacaattgaccagagctacaccttcggtcaaacatcgacatcgacactattaggcccgacgtatacacatcggtcaaaccgatttccatctggtttaaatgtatcatttattttgtgaaaacatttgttttttttggtgttatgccattcaacctcatattccaaccctcttaatatttggggaatgctaggggacgtgataccgttccccaacaggatgctcctcctccgcaaacgcgattctcacccatgcgacgtggccgaagccatcaatgcgcgcccgtcccccaccgtcaccacgcccgtcccccaccgccgccgtcaacgtccctcgccgccgcgcccgtcccccgccgccgccatccccatcccctgccgccgccaccacacccgcacccaccgccgccgtcgccgtccctcgccaccgccgccgcgcccgtcccctgccgccgccgttgccgtcgccgtcctcatctacaggggacggctgcaggtggccggccgcgcgtcgggatgctcctcccccaacgggatgcacagttatatctactaggaatcacctgatacctcgtaagtatcatctgatacctcgtaagtatcacgcgatacatagtagaaattgtctgatacctaacatgatacctcgcgagtatcacgcgatacgtggtagaaatcgtctgataccttacaggtatcacatgatactttgcaagtatcacctgaaacgtgtgtagaatcgtctgatacctgataggtatcacacctgatacctactcgggatcatcccgttcgaaaacgggattccgttatataacaaccccctaatatatagtcatacttatactaattggacactctgagagagctgctacgttaattagaaatatttagccgttgatttgatcgaccatgtacgttgagagttgacggtaaataaatcacgcagttgaaaacataatggactttgatttaataattctgaaattcctatttaataaatgtgatattgcatccatcttacattctcaatttattgttatttatttatgctcaaattcaaaatcagtaattaacatattgtaattggtgtggactcttcatttaataagcatctatataatttcaaaaggtaaccaacatgtttatcataacattagaatttcaatatttataccaccattaataatatatagctcgtgtaacacttagagattggctactagtagtaatagtaaaaatggctaaaaatttgaagctgtacattatttttcctatatacgcggacctagcctgcgattatggaagagatcgaactgtcagtttaactgatgcaaattgcataaaggatgttaattgttatccctatttcagtattattaggaggccaatcatctcttatgctagtgcccaaggttaggctgaacaaatatttttcagaatccattaagagactgacttaaggaagcatcccatcagacacgccactagcgtcgtggatcgtatacgttccatgatgagtttactccgatattatccggccccgtacagagctagatcctccgaattaatcaaaagcacgtcatttgagatgtctaattgatcactgcattggaagacgacgaacgatcattgacaggcccttcaatgatcagccacacgagccactagctagcaaccgctagtgtcacccgatcgaacaagctaatgcgatatcttattatgggtattatacagttacggtcactaatcgagatattttggcttgcgctttacgaacagttgctcctgccggatacgcttggatcccttcaaatctatccttgctcgatcgactgaaacgcatcatattgcagaaatatctgaatccttacgaagtggcggcacagtaggacgacgggcaactgaacactaagctagctgctactactatatatgatcatcatcatcgatccgatcggtttgccggcactcatgcatgacaccatagtaaattcatttctcacaaacaagcagctattaagatgaatgaataccaatggcatcggtccatgcagatgagagacaagggacctatatctatcgatctatcagtgtactatctacctatctacctactaaaatggcgatcgagctgaagccactgatggatcgatcgatcgatacatatgatcaatccacattaagaagcagtgtgcgagaagaagtagaaaggggggaaggaacgaacaataatgcgtgcatgcagggagagaggaaagggaggcaatggtgcgtagcaccattgggcgcggctgcgtgtgcccggccgacgcaggcatcgccatggacagcgctgatccgagacggatccggccgcgcgcggacttagccatccgtcccactcggacaggacgcgcgcgcgcgtgtcgtgctcgccgctgtcgcgccacgcgctaggcgagtagcagctagctaggcgtgtgtggctataggccttttgtgccagagcgaggcgtgacggcttggggctccggcaccggctagctgggctgggcgctgggcatggccgcgtcgtggagcagtgcacttaggcgtcactcgcagcgctttccgggggcagaaaagtggcaggggcacctcgccctgtccatcgttcctgcccatatcttgctgcaccaccactaagccgtctccgtccatgatcacgcactgtgtcgtctcggagtcggatcatcatgcaagccgtgcctggagctgtcaaagactagctactgctatgttggatatagctaggcgagtagctagctagctagctgctagtatacgaactattggtctatggctataagccgtttaatttggacgcatgctcgtacgcacgcacgcaacgagaatggtggcgagcgatcatgcatcagtgcgcgggtgcacgcacccacgtacgcaagcaagcaagcacggcacggacgacgggcagggcaccgtgtcctcctccgttttgctcgtgtcactctcgtgcgccatgcactatagtgcgaggcgcgcgagcactaactagcagctggggtagtaacgcgcgcttggctagcgctaattaagctgccgggttcgctcgccgatcgatcgaatctttttggcgcggatcgcccacgacgaggcgagccaatccatctcgtcgatcgacgacgacgacccaacgtacactgaactttcgtcgcgcgcccgtgttgcgccgcgcggcgcggcgcggcgcccatcgatcgatcgtacgtacgcccgcagctctcacgatcaacgtacgatccggccgtgtggtggcccgtgcgcgcgcgcggtgcatggtggcgcgtggcgcgatcgagatcgtgcgtgctgatcgggaaagccacggattggttgctgcgcgcgcgcgcctcgcgctcgcgctggggacgactcaactcgatctcggacggaggtcaacgcgatcgggttagatagaaaggagcaacatggcggcattgttggtgctctcgacgtacgtgcttgctgtttcaatttgatcgtcatcgatctcatcacactagctcaccggaaatggtttgcagaatacggataccccggcccgtttttgcttcagattatgatagctaagtctagcaactaagtttaaaagaagcggttaaactcttttttgaggacgttcagaatttctatttctgtaccgagttcgcctgcatatatactcttgttaatgttttaaaatcctgatcagatcttatcataaacattaaatatctataaccgaaaagatgacatggcgtctacttgtttcctccgtcttgaaatataaagaattatacccttcaaatttatcgtataatataaaagattttataattttgagacaatactttataccttatcaaccattttttactagtttattccccactcactatcttttatactggtttattttttcatctatcattttttactactttattcttctaaccatcatatttattattttactattttctgaaattttataaaaaaatataaacccttatatctgtggacaggactggaggagaacggcactatatcaccgcatattgatacggccagaaataccgagagacgaattgaccggctgtccggcctcgatcgtggtgctcatctcggggcgaaatgtgttaccgtatattcgcgcatatatgtacgcctctgcacctgtactgatctgtacctgttagtgggggcagaaagccatggacgccttcgacggcgacccgtccatccgtcgggcccgggcctcgctgtctgtagcgtgcgctcgctgtttgacattcgagttcaaaagtgtgacacaaaattttcccccggaaagaaattcttgcaggtcgatcgacgactcgtacgtcggcgcctccctctcgacacgaacacgtactggtactggattagtactcctaattgtctaggtgcacgctgtgctgtacaattcggcagctggactgactcctgcgtccccaaatcctgcagcctttgcctttttgaactcctgatcgacgatctacttacgcagcaggcaagctagctagctagcattagcgtgcatgctgaaatggagagaggaaaaacaatactctctccgtttcaaaatgtttgataccgttgactttttagcacatgtcgttcgtcttattaaaaaaatttgtgaaatatgtaaaactatatgtgtacatgaaaacatatttaacaatgaaacaaatgatatgaaaaaaataaataattacttaaaatttttaataagacgaatggttaaacacatacttaaaaaatcaaaaaattaacggtgttaaacattttgaaacggagggagtataagattggtgagaagaaagtgatcaaatagcaactgaaaagtgtgtgcctttcttttttattgttttctgaggagtaaaaaagtctgcggctgattacttgcatagactgtatgacccgtatcgttctctgtatgcgtatgttgtgcaatgggacctaatccctcttcggttcctggatgatcaacgtactcaccgtttgtctaatgctaattatcgagcaggctatcatgcaggcaagcagagcagtggcctagctaagctaagctaaactatagctacactgtgcgtggtcaaactaaacaccagccaaagccaagccaattagccatcgctagtgagtagtgacccctggggatgcacagggccgagccaatagcttagctttgtgactgatcgacacggccaggcaagtacacacttgcacggcggctttgagctgacagctactacgatccacacgacgacattgccacgcacggagaaagccccgggccggcctcgtctctccgttgctgcctgcatgatctcgtcgccgtcgccgtcgatcggcctcatcttgcgcggcaagttgcaggcgagagaaggtggtacgtggcttatcctgaattccaacccccactcacgcacgggccggcggatgcgcgccggggggggggggggggggcggcggagacgtacgactgatcggtcgatcgacgacgcgtcggcgggcgacggacggaccgacgacgtgagagcgagcgtgcgtgaacagtaggtccacctgaagatgccattaccggggggaaagcacttgatcagaatcagagagctcaaaactggattgattaatctgcagtggagacaagggcttagaaaaaacgcgccttgggaaagtgactgacaccaccagcagcggctagctcatccatgcttgctgctactggattttttttttatgttttggttttttgaaaatttatttccctacgacaaaacttattttaaaaatggatcctgttttctcaacatcaaggtccaatatcttagcaccgataccctagctctctggatatctaagtcgctaatgtgatgggtgttggaaccgaggacttatttgtaaaaaaagttttcaaaaaggttcaaatgtaaatatttttatagtctctctgtactagcttttttacgtcgagaacctaattataataaaagtatttatgttttgaccattttaaaagatcattgtacaaataggttcacaacactaaagagattagtgttatcccctatatcttggctatagggggcgagggtgttgacaccagcgtcattggtgtcgaggcattggaccactggcgtcaaaaaaggattaatttctaaaataagtttctcatagggccgtatgtaaaataagttttaaaaaagagccaaaacataaaaagttcagcttgctgctatctgtttcagagtttggtagctctcctggtttggtttggttcaggacgcgtgattgagcgtaattgacacaatgacggtatgacacacaccgtacccaagttgatcaaaccggatagatcagtactactgagcatggaggcgaagacgtacgtcaaatcccttttttgagaaagcggatggttaagcagagttgacatgcattttctgtgtggctggccggcttgatagatagctatgctgctgctgtgaggagaagaaaaaacaatttgatgtttggtacgtgagagtgaaaatagtggatggcgctttcagtgaaacttgtcaggtttggcagcttgatatgtttgaacaaattaaagggcgagggtttgcacacacaagcaaacggtttttaagcggttttaaatagtttctgttcctgtgccatgaaaaggaagggtttatccaatgtcaacctgcgaagttacaaaagcgatcgagtttggttctctctttgctttaatttatggtcctctctttggtgaaacagcattgcccttttgtggacacctgggatgacaacgtgctgctgggattgtagccaactaaaacaagtctcctatccctttttcacctgtagggattaacaccagaccgtcttctacaaccaggcgtagcaggcaaacttggcttgtgttgatggcttccgtgaactacttgctgtttgaactttacacaggttacctacccgaaaactggtctacgttgcaaatctctccactgtttgctctccattttgagcagaaatagacgcctaatccagaaaaggctatagtgcaggaaatagagatgctgaactgaaagtccaactacaattgggcctttgggaggcctttctgcaagtgttggacaactttacaacagggaagcaacatccatttctttcagtaactttactttcatacacattgattgatacaagcacagatcgaagatgggaaatggttggaatacaataggtcttcttcatgccttttagatcgtgggaaaatgagttgatgagctaccatcacagctttctactcagacgtaatcttcctattgaagctattcatctgtggtttgcccttctcccgagccctcagaaggtgtgtctgatgataatggccctaagatgccctctgaactgagagttaatccactctgtgaagagatacagggagaaacaatttaattcagccaaatgttactgcagtggcttatgaataatgtcagataaatttcattttgcagcctcaataaaatgatgatggcagtacctcaggctggaatcttaacatatcagcacgagccattgcctctgcttgagctatcctctgcctgaatatctgagccatctcatcagcctgttttgagacagagaaaacagtatgtcagtttgtatacattccagatggaccagatcaaggaatattgctttcaaacttaccttctcaaaaacaagctttggattgcgaatcatgtcaccaggtgtcggctcaagctttttagtagaaagactaacacggcctctttcacggtcatggcttagaatcataacctaatagcatttaaaaaaaatactctggccttagctctataaactttagatagtatacttttctcaagtacgaatgcaaaaaataccttgagcgtatctcctggttgcagaactgtcgagatgtccgcaacacggtcatgactaatctggctgacatggagaaggccattgattccaccaatgtcgataaatgcaccataaggtttcaggctctcgacagttcccaagacaactgaaccaataccaagctgagcttgactatctgccattgccttgcggttactgaggacaagcctgccttgttcctcatcgacctccacaaacttcagaggtagttctttgtcaagcagttcttcagcagttgatttctgatcaaggtcaagaagtggtttgtaaaatagtgggcagctagtgtttacaatgtgattgagaactaagcattggaaactaggatcaaatgttcagttatctgcataacaactttgacctgcagatgaaaggcagctcatgccatgcacatgcacatacacctaaaaccataggatgcaagaaagttttgtagtaactaataagattgagaaccaaccgatgacacttgtgaaaatggaacaaatcccttaaggccctccacaagagctaccacacctcctttgtttccaccaattacctgcggggcaacattgccaaatgaacaagtcaggtaaccgcagactaatacattacagcaaattcatcccaataaaactaagcatacaatcatataagctcttgcaaaaggattttttgatatgttgttacaaagtgactggtctagacttcaggagttcattgctagttgcacaggaacaaaccaacaaaatcacaatagtccaataaaaacaaaaaatttctggtcattgtcgcatctatagacgatctcagtacctgatcagtaagctctaccaagtaaacagcagcacaaatatagaaattatgaaatcatgggttggatgtcataaagtatgtacaccataaattaccacttgaataatttcttttcattaaaggacaatggctgctgctgtgagggatagattcaaggacaaagcctgattgttagaaccgaaacggtgggcaagaagaagtagtgcttaacaaacatttggttacaagtttaacaacagcaagctattaaaggagtagtgaagaacaatagtaatagcacagaaatatttccttctgcaagtatttttactcactttacccgtgacaacaacatcttctgcttgaagctgtctgcacctttcccaggcaaggtcttgctgaattgcttgtaagctcaaaatcaaagtttcatcaccaggattctcgtcaataatcatgaactcttctaccaaacctgcacggatccctgcctcttctatatggttgacatcgagaaggcatgcctcatccaaaggcaagaaagcagtagacttcgattggatatcaacatatgcaccatttgaagtggtcatgaacactgttcctttaatctgtagagattgcaagaacatgatagtttttagatgttaaggatagagtaatacatcgtttcaaaaaaaaaggatagaataatacaatatatgagaaactatacaaaatttgcaatatgaacagtatcttataataccaacatagcacaaaatattgcagcaaagataacagtactgcatgcccaaaaggagatactaacagcagaatcattgctaacagagcaaaattctaaggatcaatgcaaatctggcagctggacaaaatgagtttttgtgtccatgtgcatttgtaacgtataagagatgtatagctgattattgagtataatattggttgataaatagtaagcaattcttatttaaatagacataaataattacagtcaagacaagcagcaatcggtcagtaactgaaatctcatcgagtttggggttaccatggtcagctagttactacagggaatggatcaatggatcaactccagcttactttaactatcatttaatgtgaatttggctttgttttttttttaaaaaaaaggagaaaataactatataaagaagaaaaacagaccccacctgtatgacatttcaaggacatttctatcttttgaaggggaaacccctttttgatggaaattacatgtacatgaacatcctacatgtgctttggaccttatgcatattcatgcttcaaagaaatatctatgccctgatggattggtgaccggtgtgaggccatgagggtgaggtaggcatatgtatgatgttcgtataacttggtacacgtgcggaagcaatcaaagagaggatgtagcaaacacaaataaaaaccacacgcttttggtagatcaaactcttgctccaagcctccaataaggtatcatccccaaggaggtaaaaaagggaattcgccgttcaagtctaattcaccagaattgaatcaaaagtcaagcttaatttaaagtacatcaaattaatatgaactactctagcttacactgaatacatagctatcgtataaatctccagcctatagaggaatatgatatggccatgtattgctcttatttgaagtatcagacctacatatatatttttttagtaaacattattgaaaaaacaactaaattatttagatgaagccacacaattgcgtgagttctagcgttcaactagtttcacaaaaggcaaaacataacaggtaagggctaatgaaactactattcctgattatcactatacctgctaccactatgagcaggtcagaaaatggaagaggtacttgtagtaaactgaacattctttcgcttgtaccttaggggagtaacacattatagacgaatcatgatgcgcagagcacattccaagcaagcaaacaatagaattctagttgggtaactttcagtaaccaatcaccttgttgttgatagcctaaaacaactagcaaaccgaaatgtaacaactagtgacatatacagggcaagtgactccaatctcccgcaagccgtatccaattgagcacaaggtaagactcaagtgacttgcaggaaaacgaggcatcacctactgaaagttaagcctgtttttaagcaccaattgctactatctgtttcacatcatacgagcgagcaaggacgattgagaagaacaggaggaaggttgcggggggtggattacgagtgagccgatatcggtgtcgatgtcggtggactcgacggcggagtcgaggtcctcgggcgagaaggagacgccctccatgggcgcggtgcggcagcgctcggaggcctcgtcgaacagctggcacatccgctcccgctcccgctcctccttggtgagcgcgtacgtcccgcacaccagcgccgacggccgcgtgggcgccgcggggcggcgccgcggcgcgccggagagcggcgggctcgccagccccgcgacgtgctgcgccagggacgccattcgcgctctcggcctacccgctgtggtgtgttgtggttgtggtgtggtgcttcggggcgacgagacgaggcgacggcagcttttcgggttgagggagggtggctgtgttatccggtggccgtgggggtttagccgtttaggataggcgatgggtggttttgggccagcccaggtaagaattccctcgcaaactgtgtgtgttagtattccgtctcggttaattcagctattaatgaggaaaggaccggtctagggtgtgttaggataatagaaaatagaagtaggattgagattagaaaataaacgaagggttaggattaaatagaaaagagggaatgaatggttagaacttaacgatgtcttttagtaggtgaaaaattatttcctattcctattagccaaacactgcctagggagtgacggattcggattaatagaatttgcgcatggccacttaataataacgagaggaaactactgatcaagtggtttcatcgaggatagttataactctaatatattgtaatcatatgaattaagaaaaagcgattatcagtgtttcaaggatgtaggcttcgactagacgccgttcataaatatcatgcttagtgtcttttatgctatatcataaagtagtcgatgaacagtacgaagtatatattcaactgttgtgacggtgtatggacggatgttttatcagtaacaacagaaaaaaaattgcattggtagtatataaactttttcaatgggtgttatctagtgcataaacttgcgaaacgcttgttttggtacacaatatttcttatgcgtgcaaacaaaggttaaaaggacacaaatggcggaatgggtgatcttactgatttaagtgttaattaggatgctatgtaataaacatataggtgagaaggatttgtttttttaataatggattttcattaatccggcctatgtatccacaaaggatacacagccaaaaagatacaagaggacttagactcacgccttaaaaagaggagagcacaaaaccaaaagaaaaacaaacgacctcggcacatcattgcttcctggcattctatcctgaaacatcgagattcggcaagtggaattcgtctagtcaccgccgcccttagtgcttcatcgtggcgagcctccaatgatgccatctccaagcgcttcaaatgagttgatgccacacgtcgccggtttagcccaccttcatccgtcgatgttcagcaagaactagccgaccaaacatgagctaacaagatccacttccactcgcttcgtggattcctagacctttgccgcccctagagccgctgtcatcttcaggatcttcttgcccctcctggactcctagctcaccaccgcccctagggccgtcagctccgccagagtcctctgcagtcacagtcgaggaaatcctctttcacccgaattcccaggcatctgccgctcctaggtccgccgccgccgaggggatccgccttctcctcaccttgaaccttgcaccagcactcaagccaccgccgtctcgggccgcctctgcccctagggttgccactgccgccactagagaagtcttccgccggacttataagccattgctgctagtcaccgctgcgaacaagaccaccttcaccaaatcctgccatgtccttgccaaggatacgccgacgatgcttaggccgccgccatcctctgcccgaagggatgccgccgacgacacctagtcgctacccgccgccctcccaaccacctccactgctgacactaggtcgcgcagctagacgtgggcttggtcgccaccgcaacgcctctgcctctcccagctttcggccgcctcctacgccgccaaaacaagggcgagaaccctagccccaacgcccccccccccccccccctccattcaatagggagccaggcccccgccgaggaagccccgccgcctccttcctcgcggcctgctcgggcaacgacaaggcactggagaagacgaaaggtcgggagtggagggcttcggatggagaagacgaagggtcgggagccatataggtgagaaggatgtcacgtaaacatatatatactagataataccccacgcgttgcagcgggatatttgaataactttcagtgattagtacatttgcatggaagttgtaagttatatatagtcttccagaaacactacatactgaaaagagaacgcaagtaatgattattgaagaactgatttagctaaggaacactcttgttaaccgctcatggtaatgaaaatgcgatgtgaaatactatgatagaagtacttgatcacatatgggtataacatgcaaagagccatagcatatacatttcgttacttatagggatagtagcttcagttgtgctatgtaaaagtccaaccgtttctacgttgactactgaagctagctaagagcaggtatagactattagctagctataaacatattttaataagataaacgataagagagaagagcatacgggctacagatctgtagccagctgcagcacggactcccaaacacgatgtgtgtatgacatgtgggaccatatattaatagtatagtaagcggctattatatgaattggctattagattgattataaatgaattggagccggtagtgacctatactattaaacttgctctaattagttttctccaccaatcaatgcatcatgattgaggatagaaaaaattgaacatcgattaacttgtttgtagctactggccaagtgagtgtgttccattttccatttaatagtctactctgttcacagcaacaatgagcatgcatgcgaacaaaacgaaatctgcattttcagtacaacacaaatgtcaatgcaggtaatactcgaaagaatgaattaattgtgttatgcacagaaaaaacaggaagctgaaccttgaaattctagattttatatattcctaggatgagtggaagaccccagtgcttttacgaacttagaaatcagctttctgtgattccggcaacaaatgcactgggggcttagaaaccaaacaaaagtaatgtatatgaggtacgaagtacctgcgaggttaaaagatgaactacctggaacaaccattttaattcttcgttttcagttgctccgttctataacagcttagcaacgaatcttcagatgaagtctgggtttctatttgcaacaacctttgattggaactaattaaaatgataatacgcccagaaattaagatatgctaccatgatttattaggcaccatccaaagaaaaacaatagggaggattaaaaatgggcaagtgaaatatttttcaatacacgaaatagatcaaaaccctatagagcataaacagaacataaatacagatacatcacatgatagagttcccacatagtgaggcacatagtaaatcttgcccatggagtcagaatagcacggagaaaaggcatgagctgaaacaataaaacttaaggccaatttaagcactaatatcgagcaagataaatcggtggaaccttgttttgtttccaatgacttccaaatcggacttgctggaataatgggcaaggagttcacttgcaaggtgaaagaactggtcaatgtagttgccatgagacagcgagaatgcccgatattgctttgttcagactttagagggtcttgtatagaattaaggtgagaaatgaacagactcaataagatggaaagccagtagaagataagtcggtcattacaaaggagaaagaacgtcaaggaagtgaaggaactgctgaggaggaggtcgaacgacaatggcagcaggaatctcaggggacaacatgcagatggaaggaaaactgatctgacggctctccttttgaaagtgacgtggtgcaccaggaagcaggaaaataacttagtggggatgaattgtataggtatatataggatatgtttaatacaaggtataataagacatgtgaatatgtgattgcacaaagaaagaaagaaaaataattgagtacgatgcaagggtggaaaaaagatgggtaaagcaaaagcaagtttacaaatatagcatatctcatacccacttcaggtgtgcaattcacgtcaaatacgtccagattaataaaattggtcttgccatgtcattttggttttagttcacacacgtcaaataaatctgtgtataaaaatgtatgttttataagtttattcactaagtcacacctattagataaatttatacaccaccaatacctattagaactataatataatgtcattattgtttttcctagcaaccaaagtctgcgattcagagaacaataatagaatactattatgtacatacttctatcgtcttttggttggttgaaggatgaataataccaaatatctttttttggttgaaggatgaattatatcaaatattgccgtaatgttagtacgggtatattactagttttgttaaggtgctcacgatctgttgtccaagtaaagatcgttgttgtatttgatctgcttcggaatataacgctgcagtccaacaaggcaacacattcctggcacggccggcccaaattggtgcagcccaataagccctcgcgtccggccctactcgaggcagcgtgttcttggacttaatccgaagtattgccagcccaactcagatttgtggacttgatccaaagttttgccctctcaagcagtggtgccctcggcctcggcgagccccgaaatcgatttctccttgcacgcgcggcaatactgcgaaagtgcgaatagttcagatcgttattaacttaccacgaaatcacaatcatggtctggaaccacgaaaagaatgtccgagtttacctcgcgacccgcgttgcgataaagatcaaggaaaaacttccgtgagcccatccaaatttccgatctgccgcggacgtcgatggatcgctccgtcattgttgccgcttgtaaggtgacacgtcccgatccccagacagacggacgcgcctacgtagtagtagtacgaggcgaccgaccacaaactccggggccttacatcggtcgccacgaagcacacggccacgtcgccgtgagagcaaaaaatcgcgccggccatacggggtcacagctagcatctccccgtggagtcgtacgtggcggcacgtacgtaccggcgggactcccccgcccccgcgcggccgacacgggctcgccattcgccgagtgctgccagccaagcaggcggtgctgcgcgtacgcgtacagtaccggtacacgtcgcctcggcccggtcgcgagctcacgattcggcgcgactcgagacgaggccatgacgccatgtacgtacgccccgtcgcctcgtagtcgtagcacggtagcagcgagcggccccggcacgagagagatcgtcaggttcagtggatcaccgaccaaccgccaacgggatatttcgcgcggatgaaccgttgcccgccgcgaatttcggtcacggatttgttggggttcggttgcaatttgcaagcacggtaatgcactcgtggtgaccgcctatgaccttttggtccccgttactgaaaatctgaaggtaagtattatcgtatgataatctaattaagtattattatgcttatttattatgttatataggagtacttgcctatgtcaaatacacaaataaaattgtctaaaaatgtgaactttatttcttaaaaagtataaattagcagagtgaatgcagctcaattggttaatttccttatagtgaaaccaaccaatccaagtaaatcgtagaattgatatggtgctcttatttatggtaaattattcttttaatgttagattataaagttacatcaacaacaaggcacctatgcgtcagcctaatattttggaggtcttagcaagaatatgatattggggaaatatcatgtgaaaatgaattaagtgtttaaaactcgtgaaaattatacctaaaatttttgtaaattcatgaaaaaaaattactagagatatgtgtagatatgaaatatattctcaccaaataacaagtcatcaacttcatttgagaggaaaagaaaaaaaagaaaaaattcaggtgaatagtaacatttagccaattttcaccacatatgtcctctatggtattataagcccacctcggtattagaagcccacctcttggttgtcatcgttcgatcacttccttttccactaagtgattgcttagggaccttagcgtacgatctgtgctgtttccctcatgatcaaattagactagtttcatttcgtggattcaaacatgagggagtatattgtatccactttggtccaatgagttctaggcttccaactgaggcctcacattggctcatttcaaagtaagttgagaccacctgattcttacctagataatatttagagcatgtttggtcaatcctcgtgagggagatattagaaggaatttatttcacacctattggggtgtaaaattattctctcgatcccctctaatcctcttcaatctcctccaaaccgaacaagatcttatctaacttaaaacattctcaattggacttttacaaattcaactagataaaataatatgtttttctttccaattggaaaaatgagggaggtggtacactattagtattatgttacatttgaatcttaaggtcacacttgacttagatggtggtcaattggttatggttgaaaatgagcttgtaataattatttgaaagtacaaatgaatgaccgttaggagattgggaaataaacatattataattcctcagacaactaagtaaacctctcaaaacttggtttatttgaacaagagagatgtatttgtgcgctttgtttctttctgttaatttgagtagaaactttgaaagtttgaagtcacaagtcaaaagtttttttagttttatttgagagttttagactttgaattgaaaggtttactgtataagtttcttaagttctagttggatgttttagatttttaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24276 - DNA, 555 bp, Oryza sativa
gttcacgaaaaggaaactttttggtgtcacattggacgtttgaccgaatgttagaagaggtttttagacacgaataaaaaagctaatttcataactcgcatggaaaccgcgagacgaatcttttgagcctaattaatctgtcattagtacatgtgagttactgtagcacttatggctaatcatggactaattaggctcaaaagattcatctcacgatttcccctataactgtgcaattagtttttttaaaaatcaatatattaatgctccatgcatgtatccaaatattcgatgtgatgtttttgggaactaaacatgccccaagataagaatcctatgcgcattgatgtgaactggaatgcattgaatttaatgagatataaagctaagatgaaaggtgcatacattcactgtcctctggatgactttggctctcttcttgggcctctgaggaagcttggatcctttgaacacccagaagtcctcttctttctctttgttcgtcagggcgactgcaaatttgggccagatcgacccctcgctccctgacgacga

SEQ ID NO: 24277 - DNA, 250 bp, Oryza sativa
ccagtgtagtagccatggtgcaacaggttgccgttgccattgccattccctagggtttccagcgcctcgagctgcgacttgaggaacttgaggtagctggcggcctcgtcgagcatggtggccgtgtccatcttgctgccgccggggaccagccgctgcagcacgcgcaggcgctcgctcacccgctcccgccgcagccgcgccgccaccgtctgcgggtcgctggagatgcgcacgttcttgcgccgcg

SEQ ID NO: 24278 - DNA, 1398 bp, Oryza sativa
  unsure (1)..(1398): unsure at all n locations
tcaaactttcccttgatttaagtagtttgcctaagacccgcgcatgcaatgaaaaacaaattaagtctctagcttattgaatcaatcaataaacatcttatttacgtctaangtaanttactatgattctttcttaattggaacaagctagcatanagttttgataattctggcgggggagtccatatagttcgtatatggaggggagggatcttgtctgtaaagggtggctgcagatagctatacgatctgtaggggtcccaaaattttagctggctacggggtacggtgtgtggaatagtacatcctaccatctaccatactattttcaatctacgtattagtatcatagtaacaatctttagattcagtaatcctagttacattatgtagttattatggaattggataatctaacaatatgtcttatttatatacttgtcttatgttggcttctttatagtcttacttacatcatttgtatctagttctgccagtcgctgtctatatagcagtatgtatgtatatgactcctattgcttcctgtatactgattgggttttgcagtgtaatttggaagaaatacattttggtttgctttcttcttgcctcttcaatcttatcagggactacttatacttttttttgtttcatgttacctcaggtgagagagcaggcaagcgggaccacaagcggaaggtttgttctttctcatcctctctgtgatgatgttcttaatatagtttcatctttaatgtgtgtctgtgggacatcctgctgaccttctaaatatctagtttgaggggagacaaaattgaattgagacatagttcaactgctctgattttctgaaatctatccatttgtactttaccatcctgataggacatgcagacaggaactatatgttgattttacttatgtgtggcaataccatttaaaacatcaaacaagatgcttcagtgtgttggatcatccagtatcaaaatgaagtgcaatctctattgttaatggccattttggttgaagttgacagtcatattcttgctgtcctaaaatgtttgcattctggaatgctccatattttagaattcaatcagggacttgttttcttctataaaactatatgattacttttacttggttttatcatttacatctgtaacattttcgccagaccactggaagatttatagatgcacctccctcaccaccccagtccaagaggcctcggaagttgaaagcatctgattgatgagtttcagattgagctgcatagaatttcaacaagccaaaacccctggtatgccttactggcttgaattgaacttgcacttgaatacttgatcatttgttgctcgcttcatggttgacgactggaccttgtgtttcagatag

SEQ ID NO: 24279 - DNA, 865 bp, Oryza sativa
  unsure (1)..(865): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcaagtacattccgaattttgtcatggcattggcatgcacagcacactgacctgtggagatgaggttgtccatgatctgggcatgggtggtgtcgttgaggtggatcccgtcggtgttcgggctgctctccggcgccacgacgcggaggaagcttgccttgacgtccgtgcaccgggtgaacatcaggtggaactgcggcccgttctgcatcgtgatcccctgcacgctcacccgcctgcactcctcgaactgcagcgcctgcaattcaatgcaatgcaatcgcagagagaagaatcagtcacggtcgccgccggcgaccgtactccggcggccggaatggaggagcgttcgctctcgctcaccttgggagcagacaccgtgctgcaaggctgcaagaacgcaagaagagcaaacgttcagatgatgctttgatggttaacaatggcgaattggttgttgttgttaccttggtcttcttgcgcttgcaggagcgcgcccaccactcggcgcccatgccgtcgatggtgccgccgccggagacggacaggtcgtcgacgcggaagacgtagagccacttcgtcgggtcgcgccccgcccactcgtcggggctcgccgg

SEQ ID NO: 24280 - DNA, 3023 bp, Oryza sativa
ccgacggcgccgaagtcgtcgagggtgaggagcacgcgcgcctcgccggcgccggagaagaagagaacaccagctgcaacagccatggccgcaacaaccagccgcatcacggacacacgaagaatcgccattgcttcctgcaccaaagaaccgaacaaggagacgacacgacacgattgaaggagaagaagaagaggaagattagaggaagcagggcaacaaaatagcaggacacctagcagctgctactaatagcagcgcatgtgctgccttgtactaactaggttgcttttgcggttgaatcatccatccatggcgatggatagcgagatttaagcatgcaaagcgagggggggggggaattttgcatggccgtctgtggattgggcaattgcacatttgcacaccctgattgcgacttttgctgattgatttggtgactaaaagattccaacttttgtgcttgtgtacgtactttgtgtaggttggtaagtaactgaatgtgatggctaataaatcagctgcataagtcatttcctttgtgctatttattagagatttttttcaaggtaattaaatagacataaaggtagtaagaatttctccaaatgggggaaggaatcagggccatttggtggcaactggcaaggttgcatgcatgacatgaggcatgtagtaataatttatgcactgttatggtaaaatgttaatattatttttttttgcatttcaaacggtagcagagcaagagttgcattccatatttccatgcctgctatgctgcttagctgtttagagctcttgcgtcaaggaactgaaagcgctggaagctgaaagaccgatcggctcttcttcagtttcacctcttatttcactttttcttttctgaagtttataaaacaatgatgaaagcatttacctgttatgacctgacctaaccaaacagctagttacagcgtgaatttactgtaattttgttctgttgtttgtcaactgtctgtaccttttgttctattatctatcaatcagtttgttgctttaaatcctaactaccaaactttgccctctccagaatcccattctgatttgtccttgctaagcattattccactactaatgcaccgattagacacctgcccttttcctccctctgaatcaagtagccacttttctagctctcgttttctcagggacacttttctagctcttgaaaagcatcaaatgataaaaacatccacatgagaacattatcctgcttctggcaccttaaatgagtggctcaagcgaatctaagcactcagttgcttttgtcagataatctaggtgtaggtgacgtcttgcataatttctaatcggagtatttgagatgcatttgtctgattctagttttgatccactgaactcagttaaaatgttattagtgagctgaagccttcgtttacaatatgagaagcagaagcatcaggtaaagaaaattcagtacgtacttgctactgtacggttttgcatttacagacataaaccaaacacacgctcaaaagtccaccttcaactaccaaacagtgcagtactgttctatgtgctaagaacacagaattatttggccggcatccatcttcatgctgtcaaaatgcatccatcttcatgctgtcaggactgagagtaactctgttactaggaacagaatcatttctgcattgaaaacactagctgataaagagccgcatagatatccagggttggcattgctaaatgctctcctcttttgcgaattatttggccggcaagtttgaacacgatctgtccttgtgcaaatggcaaattctgaacaaaaacgttcagctttctgactcctgaatcttcaaaggaagcagctcaccatcatcgcaggtgccgtgcttcagaagggtgctggaggatgattaatgccacgcgtaacaggaaagaaagaaagaagaaaaagacgaagaaatgccattcattattaatccaaattacagaaaaggccaaacaagtttcagagaattcagaaaacaaaaaagttgattcacaccagctgaggagcaacttgggtagcttcaggtttcagctctccttcgtcagaaagaaaaaatgagtttcagtttcaagcagcacaggcataacgcctgccaaattctgcactagcacatgaggttccaaaaaaaaaaaactatacaaaaagtggaggaaaaggatattgcagagcaatttttttcccagataacacaacatttagcacgtcgttgcatatgaaaaagaaaatctgatatcgtccgaatagattaattacaagaaataagattatcaagctctgcagatgatactccacggacacattcactgttcacatgaaaaatacttaatagttcatagttgcttgcacgtcatagttttctagtgctaatcacctacttgacatgaaacaatttacaagataagcaaagaaactatatgaaaaaataaaaaggctacgaaatggactaatggattggagcatgatccgatcagatggggaattgcatgtatgtacagatgatgagacgatgagtcgctctagctctcgacggatcacgacgacgagtggcgcctagccttggccttgccgccggcgacggcggcggcggcgccgccgccgctcctcccgcccttgccgctgccgccgaagaacctgcagaagccgcacacggcgacgcgcggcgacggcgggtcgagcgccggctggacgcgccccgccgccctgtacccgccgtgcccggccgaccggctgcgctccaccctcgccgccgcgccgccgccgccgccgtccgccggcttgatctccccggacaggtgcctgtcgtcccacacgagccccgacgagcccgaccgccggaacgtctcgctcgaccgctgcagccccgccatggatcgatcgatcgatcacaaaaattcccgaaattcacaggatcagagacccagaagatccgctatatacgaagaaaacacggggggtggttcaccga

SEQ ID NO: 24281 - DNA, 2321 bp, Oryza sativa
tgtctcgatcgattttgctttccaattcgatcattccgggggcgatgtcaaagaacaggggcaacctggcccatgtgatgcttgaagtgtgaaccttggaactgatagcttctgccggcttccattccaaggtgggacattcagtttcgttcacggaaaagctccaaatacatttccatgccatggcaccaccactgaaacgaatccgtcatctgtcgaaactgcaggtcgacagcatgttgtcgtcactggacaaagaccccattgaataccatggttcaagtacagtggataattgcagatatactgatcataacagaagtctccatgcattgtatacacaaaatactccctccgtcccataatataaaagattttaagtttttacttgcaacgtttgaccactcgtcttatttaattttttttaaaattattatttattttatttgtgacttattttattatctaccgtactttaagtataacttttcgttttttatatttgcaaaacaaatttgaataaaacgaatggtcaaacattgcaatcaaaaacttaaaatctcttatattgtgggacggagggagtacttcctatccagtcaatgtcgcccacttgacactttggcagcaagtgtgcctgagcatttcagcttttggattggtaatagtacatgatctgttccaacagcaaagcaaaaacaagcttcgtctttgcctgcacgggaaatgcattgcatcttaattagcaatagctcaaagaaagcaaccaccccagcacaaactacaagctcatggaataagccctcggaagggaaagggatttggcgcaaattaagcagcagcgcgaggaacagcagtacaaagccaagggaggccgcagtaacttttacaacagcactggtgctgaggagttgaggtatgtacaaagccactgtacacaccttcatacaccggaaaaatggggattgcagatagcaaggggtggaaccgcagctcacgatattcaccatgtcaagtgaacaagattgaaatcaggaagcctttctccggccggtgccgctaggacttctggggctcatttgcttatcctgtgccatcagagaactggtgccactagtcccatgatacatcaagcgacgaggagaatcatttctcatgctctggttctctgcctcaagttgtttagcctcctccattagcatagataactgttcacagaaccaagtagccattagtggcaactccctttaagagcagtgtaataagatgcaggctccactcacccgaagttcattttccttcagacgatcctgaagtacagttatagcagggctcaaactagaatagcagaatgcaagataagttagcagagggctgcacataaataaacatatcagccaattaacagacagagattgtgctactaaccaatattccattaatttgcagagagatgagttgtatgtagatgcatggtgaatagatgtaagtgggtggatcttcccatcactgcaaaagaaccatacaagatgtgcattttaccacataataaacacgtagtactatataaggcaaagtaagtaactttagttaccgaatattttgatgcatggcttgattatatgctgatttttcctcttcgaaaacgacatgttgcatatcacagtaagaagttaatgtggtgtccagctttagcagatgcctggtcggaaatacataaagtggcacctcctttcttacatattctgcaccactattggcaacacattctagttagaagttaatatatgattatattgcaccacactagctaaactgtttggcatgtacaattttgatatataaaaaaagacaataatccaaatacgcccttctggtgtgatatatcatacactatttagaaaatgcagaaaactacagctgttcttttatagtagaacatgcttagaatttagacaagaagtaaaataaagcacagtctattagatagcatcttagggattgccatgctttgctcaggaaaaagaaaaaggacactgccatttggcaaacttaagagaccatagatcagtcatgctacaattggtttgtttcaaaacagaacatatgtgacgtggatatagctccatgagaaagaagtgtcactggaattgtgtttattaaatgtatgtttctagctgatagggacttagagatcctatagaagcaggtgtcacagaaagtaagtcagcctgatcattcaactgacatttctacagcataaaaaggataaatgcattttacgggaataacaagttttcaactataatacctaatgtcca

SEQ ID NO: 24282 - DNA, 12502 bp, Oryza sativa
ttgctgagtgattggcgtcaaaagaggatagaaatccacatcagaagattttgcccacacctagataataagcacaagcacagtaagtttaccaatattaatatacttgcaggaaggcacacagacaaattgtattgcataaatagacatctaaacaaaattatcatctcccattttaacatacatagtatagaaatttccatgcttcacacctgtcgcatcacaataaggaattatcattaaatgatacctaaaagctacgtagattcaacaaagctgtgtaattttcagacaacaattacagtagaggtaaaatgtgtctccaattgatatggatcagtggacagggttgcccaaacaatgtagtgcatgctatctgttaatatctgatgtacattggttcatgtaaaaccatatcaggacatgtataatccatcagaagaattggtcatagtcataaatgtcagcagtcatcctgtggatgttatatatcaggctggtgtatattcaagaatgaaaaagcatctgccagatactactgagcataacaatcataactgttatggggcttggctgatttattggtgtcaatacttaagatacaaaacccatatacaatatctttattacataatgtttatcacttataagagacagtatcatatcccaatgtaaaatcagatggatattttatgactacaaatatatatcatgagcttatttcagtttgttttcaaaatgttctacatcatgtcatgatgttcatacctaaaaaagaatagaaattctatgttttccattgacaagtgatcgcttttagaattgccatcaacgaacataagttacacagaataccatcggtgtcagttgaccattagtttaactccattaaccctgtgcaaacagtccattttacccctagaatatactccctccatctcaagatatagctacttttggaattcaaattttgtctcaaaatataggtacttctccacctaccccctcacattgaccaatcaaaaccatcccccattcaatctctccacctcatttcaaccaatcacaatcatcccctattcaattccacctactttcttaatattcccgcaaaaacctgaaggtagcaatattttgagatggatggagtccaaagggtaaaatggactttttgtatggggttcatggatgtcaactaacggtgatggcaatagggaaggaaatctcttgtgcgatggtatttcatagaactcacgttcgtcgatggcaattcgtaggattgatcacttgtcaatgacaaaacatagaatttctcaaaaaatcaaactaggttgctattaataaatggcaaagcccaaatggatttggatctttgcacatttcctatttagctaactgtttcatctttattcattcattaattagatgttttatttaatccaaaaaatgtaacaatgccacttaggtatccttgcatactatgctatgacagtgcaacgactaacattgccacatgatcaggtagttgtagaacattgctagtgtggtttaaatgttgcccatcaaaagggaaggcatgggaggcttctagaaggacacatatcactgctatgtaagagaaaaggtcattcttggtctatatatattgcccaaacagatggaactgttaagtttcataaacataatttctatagcgccacaaagagccagatctaaaatccacttttcactcttattgcttacttttttagtacagaaattgcggttgtggaatcctatcttagagaccagccctatattttcttaataaaattgaaaagaaatttcatgacatgagagtacaacgaatacaagaataaaccttgctatttcttgaagatttagaatcccccgtgtcttgttcaatgccttcaatcaatgccggatgtgaggtatcatccaacgaactccaagatgattcaaggttaatgactggatcattaacaggaacaacagattgctgatttccaccaagtgactgaaaagcaatcacttggatttttccaacctgtgggaaccaaaaaagaaatcaattcagcagggctaattaaatgtcatgggtgccccaaactagaagtaaacatgatgtgcatatgaagtacaagaatcataccttttgagcatcttcgctaaaacaagagaatatcagacccacaaaacctggctccatcaactgaaacattgcctgggtccgaacatctgcagtatatgactcatgtaagtcagatataacaagcaaagtccagccctcactgcaaacgggcagcatctcataagagacaaataaagcataaaagcagatgcactagcgaattccctagatctacattgtcatcgtcaatttgtcctgatatggaccctctactgccttcgtactcagggaagtataagttggtgccataacggaaaaaatggagtaaacccacatgcctaaatatagcattcccaaatacaaaaaaagcatacattaccaccaacaaaaaggaaatgggctctagcataattaacattcgttttccaaacatcagataggataacgaaaggtttcacatcacttcaaattcaaaatggcattagtacaataacacaattgcaatcaaatttcaaaaccgtgcaaagttccatatcatctcacgacatcacaaatacggaatgcgacaaagtactgcacaccaagggggttatcagaaggcgctccagccttagtgaagcacagcaaattggaggtaacttgaaccacctacctacatgggaaggcagaacggtgatatgcgggtgcgagtggtaccatccaatcaccctcgttttctcgccgatggtggccgacaagctgtgcgaacagagttaagtccaactccaactcccgaaaccccaacattaggcttctcaacacaaaaccaaacacacaaaatcacagaaatggaggggaaaaaggatatctcggcctgcgccgtcgccgccgcgagcagctcggggttgacctccaccctgtccttcttccgctcgcacctcatctgcggcgacgccccccatatcagagcagtcaccccgcccctgctcgaatgctgcgaagcaggcaaaaaacccccatgatctcgacaccagccagcgccacgcattcgcgctggaggaggagcaggagaacggggagagaggagaagcaggtgaccttgatgtcgccgaagaggaggcccatgacctcctccgtctcggtggtgagggcgtgggagaggcaggtgagccacacctcctccccgatcctgacctccgtcagcgacatctcctccgcccgccggcctcctgccgccgccgccgccgccgatccggtggggtttcgggccgcggcggaggaggggttgggtttggtttggtttgcctcttcgatttggcttgtagcgctgcgcctctttgaagctcggtttttttttttccttttctttttctttctcgtgcgaaatgggctctctcgctcgcctctcggtcggatgacggctgcgccgctggctccctggccttctgttacgtgtttcgctgcaaagtggggccctggtctgatgtagccggcagatactgcaggtggggcctacctcaaagtagattttgctacggcttgtttggtaactcgacgtaaagggattaggagtttacacaagggaattaatgatgagattaagatgggaatttgatttttaatcccaatatcttgtttgacaggggagatggaaattgatagggagtttagttggagattaggtcattaataaaaacatatgtctgatatttgcttagacaaaataaaggaggaattccctcctaattacctgcccctacccagttattgaaaatgaggtagttcctttctcaattccccatccctatcccaccaaaattttcatgtctcccaaccaaataaaacacttaatagcccatccctctaaactcccaatccctccttaaaaactcactccaaccaaacgggccgctatagtcgtgacacttcgatttggcacgtcagcagcaatcccgcttattaggccccacccctatgttggagaaggctaatccacgaccagttccccactgtgagcctgcctgtttaggtctttaggggagtttaagattttgagaaactattgttgaaaaactaacttgtgggaatctgaagaagctagaaaacctagtttctcgcttttttttctcgcttctagttcatttttcagattttataactacaaattctcaaaatttgggaaccttgagaatttaggtaaaaaactggactgtttgagagagctgttagcacctaaaaattttaggagaagctgcaggcgctaagttcgtttggagaagttcccgacctttccctatgcacaaacaacggaagttcaggcccaaactacatgggccacacgtcagcagcgatcccgttacggcctagtacatatgggcctcacatgagccgcaatcccgttacagcccaatatatatggaccggaatccccgttccaggcccgactgagaagagctgcaagtgtgttacggcccaattaaccgatgcaccgttgtggtcgtggcagtgccaagcgtggtgaagtgctggcttgctctcggccgtccatggtcgatccaacggctgactaggggaatcacctgatccccttaggagggcctcatcgtttggcttttttttttaataagccaaaacggtttattagagaataaaaataaatttgttggttaaacttttatatatgttctcgttgacttaaataccaatgctgaaaaaaatacattaaaaatatctcaaaatcaatgttacaatgtcaaaattaagtttgaaattttaaattttagctttctcttaaaatttaaattttaaattttagctttttcgttggcttaataaatagggcatctagggcatccgatgagagcctcttatggtcgagtgtataaaaatatgaatgatccaaagtattttttaaaaaaattctgtgatcacgagtacaagggaagatgatacggtgaatgtaaacacatcgaaatgataaaccacaaatgcgggctttaggcccaaacttttattattgttacgccataataaacagaacacagacgagaaactctgacgaaaacaactgaacatcatcagtacacatcacccacacccgtcagaaatcctcccctgcgacgaccaccacttcatacagcatcgatacagactcaaaacgacacaaaaacaaattcaaacttgcaccgaatttgaagtgaaaacatacataaatagacccaaagggaaatcattcacggcgtctagtgatccctcgccgtcgtctccgtggcggcggcggtggcagaggtgtccttgttggcgccgtcgtcggtgccggcctcgtcttcggtcatccccagcgtgctcatcaccgcgtccttggcgccgaccaccgtgctcttcacctgctcactcgcctgaaacacaaacaattctcctcaagatccacaacaatggtgttcgacgaggagaaactaatcaaagagcaattttacagtgcttaagaaggtactactttttctattgtaaatttaataactggtaccgtatttttttatctcacggtacctctgctccccgcaaaaaaaaaaaaaaaggaggtagaattgcttttaatcctgtgtgtacctgttggaggacgctgccggtcttgtccttgccggcgatggcagagtccttggtgtactgcgccgtctcggcggtcttctgcttggcggcgccagcggtctcggcggccttctgcttggcctgctcggtcttctcgccagaagccgccggtctggtccttgctctcggcggctttgtccctcgccgcctgcgacgtgctggaggtcttgtccttcgccgcctgcgccgtctccgacgccctctccttcgccgcctgcgccttctccttcgtcgcctccttggtatcctgccccttgccggcggcgtgccccgccgcctccgacgccctgtccttcgcctcgctcgccttgtccttgctcgcccccatcacctgccccgccttctcctgcacaccaagaacaatcaagtgatcaacaaattaactggaagctcgccggagctggagaagatggccggccggtggtggctgacgctgacctcggtgtgggccttggtctcgccggcgcggtagctagcctggtcctggtgggaagccattgatcctaagcttcaaaaattaacctcgaaattcacgcgcgaatgttagaactctgatggattttgctcgattatcttgatcgatcagatttgcactggctgtggcgatgggattggaatggaacagtatttataagggttggcatcgagacatcctccgggacacgtagcatggcgagacgcctacacgatggccacgtagaaaggacacgcgttgtgtaaggttccgtaccttcgcgaagccctctcatgcgatccatccatccatccatcgatgcaagctaaaagccaaacaggagaggactactatagtatactgttgctactaaacaagtgtatttatgagcggctgagagctcaggcacgtgccgatctctcgacacgtgggcacagcgagttgaaactgatcatgatcagatcgatcagtgtgtcgatacaggcgatcgaaacgtcgatcgatcggtggctgtttggcgagtacaagttggatgcggctttagtttttacacttggtgatcgatcgggtgtcgttgccatgtgcggcgcctgatgtcgccgatcaacgtgttcaggtctgattgtaaatggtgttgttgttaatttggatgcctgatgtgttctgctacctttcgcttttgagtgtacttctgccacaaaagtttggagtgtgtagtaaccactttggcggcaaagggagtaaacaatgttaaggggacacatgttaggaaggtctcgcactcaaatgagtaggcacagaagcttcgggagatgcatggcattgttaacgattgttatcattacatgggtggcagatgtttgcggtttaattacgagtatctgctcatcttttcgagatcgagagaaaaagagaaagacaaggtcaatcatggggaatggatgccatgggctcaccatgggccagtaattcggcctgacgctgtgacgaagtgggcttctcaaaccaaaattactgggccaaattcagcctggccctgacctcaaaccatgggctgggccttgccgattaactcaagtcgatcaccacagatcaacaaaggatgagtggtgtgtcaccgtacgatgacacattgagcggccattattgatcgcacacaagcatcctttggtcatagtggcaatcctgacctgcactgcactgcacacaccggctaggctacatcgatcgtcgccgtcgcagcgtagcacgcactaacccatgcagatgcaggatgggcacgcactgtgccatccatcgtgctagggctaggcgtaggttatggaggccctttcgtgctgctagcctcggtgcagcatcgaccatacgtacatattgtggcatcggtacacgcgcgtatctcacctgacacgtccaacttcggggctcatgggtaagccccataggtcggtcagtcggtgcgccgtagtgctccctcctccctaaatataagggattttggttagatatgataaatcctaatacgataaatctagatatgaaatatatcacatcaaaccaaaatctcttatatttagggacatagggaatacttactttgcacgagtgcgattaaaactagggtgaatagttaatatggtccttgaagtttcgttttgagctcagtttagttcttgagatttcaaatcgtccaaacaagtcctctaaattatcatttgggttaatatagtccttagaccaaaaaaaatgccacgtgagcatgccaagtcatcctcaatgaaatgactattctaccattatataccatatagaaaagaaagaaaagacaaacaggaaaaataaacaggccagcccatgcccaatattattgcggagggtggccgacaaaagaatttatacgatcagtgcttggttgtagcaatcataagtgacaattgtaaaacgatcatacacgcgtgaaaacatttgttttctttttttattcttttctatatggtatataagggtagaatggtcatttcattcatatcgctgcatgtgaggatgacttgatatgctcacatggcactttttgtgagtccaagaactacattaacccaaatgtttaatttagaggacttgtttcgatgatttgaaatttcaagtactaaactgaacccgaaacaaaacttcagggaccatattagctattcacccttaaaactataaattccttaccactgcactattaagtgcatctgatattctgataagtgacgtaactacaacctacacaaagttagaggattgtattttctggctggctaccttacgtacgttgcacttgtagtcggtagtccccttccatttgggtcgacgactagcaccatagcatcgattctaggtactgctatacagatacaacgtaggagtactgctatacagatacaatgcatgcaactatatatgttttacgttggcctgccatgtgtaagtgcaactgcaaccaacaggaccagctccactatagaaagcactatgtagacgaagacacttatattatagatgatgaaaatataatggtggcgaaaatttcaggccgttttttattttatctatataaaaaagtaacttttacaatttctatcacagacgtatggcagtcatcattaaatagttaaattgacaaaataaaaaatccttgaccgactgactatcatttctatagagatgatattgatacaaactgttttcatacatatatgaactgcgtccatctttgaacctctcataatatataacagagggaatatgatattaaataaatacacattttaatatatctgaagggaaagtattctaaaccctcaagggatgtcctctcgtcttttgcatatcacctaaatagttattaaaaaaataaaagcttggcgagatacactaaaatgtgatatgtcatttcacaaatatgtgagtttaaatggcttcttacaagttgtaacaaaaaaaataactataaatatacacgtacaggtaagagtttaatttgtctttttttgttacaactcgtagaacatatttaaacttgtatatttgtggagtgacatatcacacacacacacacacacacacacacacacacacacacacacacacacacacacacacacacacacacacacacacacacacacacacacacacacacacacacacacacacacacacacacatatatatatatatatatatatatatatatatatctaagttactatttttttacaactattttcatgacatgcaagagacaaggggtaatcaccttgaaagttagaatcctcttttcatggtgaattcgaatgaaaataatttagtgatgtactatgtgaaagggcatgtagcctagtggttgcagtgacctaagtaacaccacatggtcctaagttcaaatcttcataagagcgaatttcagatagagttatttgagggctaagttcctaatttaaaaaggctgcatatatccggttggatgtagaggccaagtaaaaaaaatacccttctctaaaaaaataattttcttttagctaaaacagtactctacaatctacattctaaaacgttgaatttgtggaaaactgcctaactattatcagcaaatttccatacaactgatcagcgatcagcgatgacctgcagcaaaacagggtatagtggacttacactcgccaccagcagcgttcaccaccgaaagcctggttgtactcgtacttgccatgatccaaagaccttagaagaatgctgatacctgatagctacccaatgctagctatcagattcccccatatatagcgctcccactagaatgtgcattgtgcaaacgacagtacactacactacaccttacaagacagcaacaagcacgaacttaaactgccccttaattaattgcagctaattaatcaccagttctctgaaagaagttagctcaagattaatcctgtcagtattactctttactcttttcgtcctaggttagtgaaaaagttgagcacttgcataagcaataagtggctaagtgacttcttcttctggtagtagtttctgaagatcgagtcgatctggtatctttctgcaggtaaatcatgcaaatgcatgtatgatagttgaccctgcatttgggccggctaggtagcgcatacatgtggattgtggagttgtggacttcgctatcatcgctatctcgtagagcaaaatcattgttggtatgcaccattgcaccattgacaaaaggctgctgctgttcacttgtcctttccagctgtagatcatgcaaattcatcggatggccatcggtagtatataagcaagggcaatggcactgcagctcctcaaccaacagtgcagtcacactctcgcacactatctgcataagaaggggataagctacctgattcatgccatcagtttcagttgcatccagcatgagcaagctcaagttcttggtcactgtcgtcctcgtgatcctgctactgttcgattcatcgtcttcaggcatgttgtttatcatgttcttgttcttttgtgtgttggtctgtcgggctgtgtaatactgatcagtgattttttttcttttttgcttggtccgtaactgattaatggacagttttaatttatctgtcgtctaaatgcagggcaagctgagacagcatataccaattatgaagtgacttctaaagtgaaagaggtatgtacttaattatccatcaatctttgtagtgaccatcagagagatgttagggtaatatatatttcagatctatcttggtgcttttcacgattccggtcttaatcaataactccgtatgctagctgactttaatttttgaaggacccaacatgattcatgacagctgacttagtattaacgagaagaaaactgtataacttgccctgttgtgcatgctaaatgtgcagaggcgtgttagctgataaaaaaaatgactctgaaactatctaatgttcgctgataaatacatgtgctggctgctgttggacacaataatcatcagaactgtgctatgatcagtgatgttttctttacagaaactacagttttcagtcaagtatgtatgtactaattaagtttcatatgtccttaccacctcagagaattcagaaacatagcaggagggttctgacagatgttcaggactatgactatggaggacccaaccctagacatgaaccacgtaagaagcctggaaatggacactaatcgcctcttctccacactgaaaccttgacaaagataagtcagatactcagatgatcccaaatgctacaatcaccagaccactatcttactgtaatgtactagaattaagcagaactgttaggtactattgtgtcgttaattaccttgtaatatgttggtcaggtgcatggagttcaggtcattttagacagtacctgcgtgtattcaggtgtgtgcttatataactagcaactggtaaaatacaactactgaggacattttgtaagttgagacttcagatatgtgagctatcttgtttgcaaatcttcggttgtgttttgaataaaacgagcattttggctccgtataaagtttgaatgttcagagtactcgtcaagttgagagcgttgctcgtaaaattcagttaagctgtatgtattaccctccacagccagcgaagatgtaagaatatcagtagcaaaaaatctgaaacacatcttctctcttaacaaatgtgcccttcttatatctgataaaaaaacaagataatatttcacgtgtaacagacatccttagctgctgaattcagaaccgagcagtcatactcatctgcagtagttcagcagcagcagatcctctcgtcctcttctgaaacacaaaacagacaagcttctctcgttactccaccctacaccatccatttatttcttcattcacctcgtcattaggaagccatgcaatcctaactagtttagaccaattcatacatccaaagaaaacgctccaatatatataatatattcaggaagcatcttagtacttgcgacaaactctgaagactgttagctaggtctgaatctatttgatggcgtgctgaattttgcctgtctcttgatttttcatttttgcataaatccgtcattacacacaaggcaatcatcatcaccatactaggacaagtttctatccgttctcgttcttatccgtgatcgaagcagtcgtgcagcaattgactctgcttccagaagttcagatacctgaactctcgaaaatg

SEQ ID NO: 24283 - DNA, 4073 bp, Oryza sativa
agtggatccccctttttatagtgctataagctagacaagcatacgcttttttatttcagatggtggtttgcattggtctattctccaacaactccatgtttttggtggcggcaggtcagctcatccttttcctcatgttgcgtaactgcatagcttcatccacaaatatgctccgtacctgaggtttggaggatggcaagaacattcatcgcaaacatggttcggattcgctgtaattttgcaaacctgtggttttgcctgacaaaatctgacacatttttcgacgcgatcgatcccggcaagttgaatcgttctcttcgtataggcatatgagttcagattccttccttgccaaccctgaaaccggaggagatcgaatctctcaaatctgaacgtgcaaccgttgcagtaacagcgtacgcaagagagagatccccttggagaagacacacgattcagctcaccagttggtggttgacatgaaccgctgatgcagagatcactccacacgcgaaacacaagcgactctgactgacgtacacacggcgatgcgatgcaagtgcatcttaagaaataccgcctcaatttcgaaatgcacgacactacttacttttcgcataatattacactattcatcttattaatttttttaaaatacataaaagtataagttaagattatattttctttggtaataaaacaagttcaaataaaataaataatactccctccgtttttaatatatgatgtcattgaatattttagatacgtttgatcattcgttttattaaaaaaaataattatcatttattttattgtgacttgatttatcataaaatatttttatacatgtaatttttttgaataagacaaatgattaaatatttaaaaaaagttaatggtatttcctccgtttcacaatgtaactcattctagcatttttcatatttatattgatattaatgaatatatatatatatatatatatatatatatatatatatatatatatatattgcgcgagagaaagagagaggattctggtagcatcagcgagacgtgagcatgcatggcactagcggggagggagcggcacagcgcggcgcggggtcccagctgagggcgcagcggacgacagggacggtgcgcgctggggcgagggggcggtggcggcgagtggtggacggcgacgcccaacccgatcgccacagcctcgtcagcgcacacgcgcttcacatgaatttttatgtcgcgcccgcggcccgcccagccaccgcaccgcatcactgagcccgaggcaaggagcagccgctgccggccacacgtggaaagaaataggtgataagagcaaaattaattggatagccaactacttgctctaattcatctatagccaatttaataattcatttatataatagttacatactatactattaatacctggtcccgcctgttatacacatactgtgtcttagagtccgtgctatagccgactacaaatttgtagcccgttgctcttctctcttcttatttatctccttaaaatatgtttgcagctggtttatagcctgttattgtacctgctctaatcctcctgagtggttgggaatttgggtttgtttggtttagtgtggtatattttgaagggtagtattttaagtgggtgtgtttagattatcaaaatttatgttatggtggagaaaattttagaatggtgccaaattaaccataggcattaccattcacttggctctaaactaaaccattacatttactactccatccgtcccattttaaatgcaaccattagtttctgtgcccatctttgatcgtcctgtcttatttgaattttttttataattagtatttttgttgttataagatgataaaacatgaataatattttatgcgtgacttatgttctatttttttaaaaaaaaatttcaaataagacggacgatcaaagttgggtacggaaaatcatgggtacacttataatgagacggagagagcactattaaaaaaaaagggttgttcaaattgtagccaaaataagacttaccaaatttttacattttggcaatattgtcaaattttgtatttcttatatatttaacaaagtttggtaaaaaaaaataaatggatgcaattttttagaattttactaaaaattagtatatgatttaaaatgacattaatctgaacaacctctaaagaaaatggtaagacataatttgacaacaatccaaaataacattttttttcctttgaattgacaatctttttcaccggtccggtgattatcttccaatggttactccttgacttattacttcttagaatttactgtgggctaagatgttgtggatattttagctaattttctgtggaaggtgaaaaagggccggtctttgtcattgctttgtcatctgaggacgaagaaaattgtatccgtttggactgcttttgataactaaaaaaggcgaactttcttttctcagcaggggacagaggtgataaaaaaaatcgaagaacaactccacttggagtgataatgaaactgatcttcatataagaatatgaaccttttcttttcaagtaaaacatgaactgaacttgtttcaacttcatgcagctcagctctacagtaaatcaaacagtaatcacactccaaacaaaaacaaagtgtttcttgggtgcccatctcaaaacaaaatgaacgtctatcgccgggccgaaacaaaatcaactttggaacgagcaacttcgcagatcctaccagtttactccagcttcttaacttcttgatactgactcacaatctgttcgaacaaactctctgtcctccaaacgtggtccaaaaccaaatgccctccttttctcctgatcaagtattccaaccaacacgatcaaggaaaacctcataaaaatgcaagctttctcctcttccttcaattaaaaacgcacaaactttctccaggtcagtacgtaagccacttgatccatccaatcaatctccagtagtattgtactaatctctcacactattacaggcttacagcacggtcctgaaactccgaaattcgccgaaaattctggacctcaagctcacgactctcaagtactccgaattatctcatccttcttctccctcctcccgtccgcgccgcgacgatgcgagcgcaaccacgtttgactcagccgacggcgaccggccgcgtagtacgcgtgtcatcgtcgagctcgagcccatccatccacgtgttcctcctccttcctcgcggcgacgccgacgacggctataaataacccgcgcccccatcccgaccaccgctcctccgcctccgcctctcatatttttcccatttttcacctgccttaattcgccctcctcccataaccgtagtagtaatcgtactcctccattctcgccggaatccagagcgaagctgtaggaaattgttgggaggaggagcaatgccttactgcgaggtggacaggtaccagaacggcgacgagtgggacggcgtccgcctcttctaccgccgcttcggccgcggcgccaccaaggtgctcctcgtcatcggtatgtccgtacgccgtcgatgaacccatcgcctttgccggcgatcgaaaattttctgcgttttttttttgcctttttgttttcttggttctgatttgagaaatggtgggtgtggttgggggcgtgaaggattggcggggacgcacgactcgtggggcccgcagatcaaggggctgaccgggtcgctggagccggccgccgacgacgaggagtccggcgacgccgcggcggcggagggggacgacggcgatggcatcgaggtctgctgcttcgacaaccgcggcgtcggccggagctccgtgctcccgcacaaatcctactactcgtgagtttctctacttcctcctctcatcgtcgtcttctagatccaaatctccaccttgtctcatgatcgaggaggcaaaatcgttcgtcgtgaggtgtagaagcatcgcgcccaatcttgagagagatctggaggagggtaaagattggcgtctcatgt

SEQ ID NO: 24284 - DNA, 1288 bp, Oryza sativa
aatatgacaactaaagaactagatacaattcggtctgccggttttctagtttcagttattcatgggaggttagtggcgacttgagaaaagcacacatcccttccccacagttcgcaagcacactgtgtgtttgtttctcatcacttggtttaaaaatgatgcaggtctgacattattgcgcaattatgtcatgcgagacgacttgcagaaaggcttattcctgttgctagaatggtcgaacttcatggtgcgcatctagtaagccatgaaagaccagaggaggtaagcatggactttgacaaaatgctatattgttaggcagctgaaattatgctggaatgctgaaaatattcctaaatagctgaccgagcgaggcaatattagaaatcatggttccctgcaagcatcaaactctaacatagatgcactaatgggcatgtaacttttgagcccaaacttggaagaatgcttttgcttataccagttagaacgttactagatgcttgtgctgttgcaacttgcacaaattcttccaaagttgccaaaccgaactaaaggcaggccgttctctgaaagcatcattcaccacctaaactgtacaagggaagatgctacttttgaagaaaattgtttggccaactctgaaactgctttttaggcaccaatgaaatggttatcccaaacctgagatggaatcataaacatgtaacttacagagttattttaaggcttataccttctccaaatcgctgttcttttctctcattatttcatcacgcttacagagttgcaggaaattgtaagttgactcatctgagtatttctctattgcaggtcaacaatgcactaatggaattaataaaagccacaaaatctatgatgaaacctgaggaatggtcatcccagccagagaattcatcaggtgagcttagaaaggccaaacacccccgaaatctctttcgaaggctatgttccaaggcacacttcttacgctacgtctttatcagaaaccggggctcttatttctgcaagacctgtttccgtcacaatacgaacagatgatgggggaaatgccgcaatagcagtctataacttacttgccaagctgcaactaagctttctttatgtcataggagtgatactgatggggtttgagcatatgaggaacattgtaaaagtaatgaagccagtaagggtcgcagcaatcgaatcataaggtaggtttcaagaactacatcaaaataccatccagagtgtttctgaaattgtagcaaacacttaaccgggc

SEQ ID NO: 24285 - DNA, 1226 bp, Oryza sativa
atttttatcagcaatttgtttctccggtttatgtaggccatagagaagattaaatttgccaagaaacataatcttcccaaggaaggtgagacgtgagcattgtggtacatttttatactttggttctaagagtgttgcatgcctatatcatttgttaaaccataccaactcttgaattaatgtgaccaggctcgaatccttcttcaagccagttgttagcacatcagtgcctctgaaaagaaaggtaccttaacctgaatgccatcaatcttgtcgtgcttaaatttagaacttttagccttctccaggttcatccattgtagcatgatatacaaccaattcatgtcattgaattgcgtactttatctgtccattcaactaacaatgttgaatcacgtggtttgatgttttgattgtccaatgtacctgccaaataacagatcacagatgaatgataaaaatatgtccattagaccagtactcaacaatatatttgcaagcagccagaagtaggcagatacaatagccaaagctgaatcttgtaagccatgctaaaatccttctactatgagaaggttatagccttgtttggcatgattttctcgcagatcttgtactgttccatgtaaaactgcaaccatagtgctatactatatgtaggcttgcaaatgttgtggccataattatatttttgtagcaatattatgtctcatgatttgtttctatgatataatggcaggacacttcagaaaaaccaaccaaagcagtcgctaacaagaaaacaaagggagccggcggaaagaagaaataagttcgattgtgccattcatcaacaagacctcctgcacgtgtcatttcaattttaactcccatgtttgtaactcatcctccatctgatgttttctatgttcctagtaaaccagaagtccagaacttcgtctaatactagttcatctatgtagtacgtctctcttctctactagggatttgtagtgttggtttggttgctgcgtagtgtatgaagaaccaacaaaattggctttgccgcgcaaaattaactggttccgattcgcataatcagcgatctcccggacgatgtgctcctcgaaatcttgtgcctcgttaacttctgcgccgcgctgggcaagcgctgggccggcctcgcgcgcgagctgcccatgctcgatctgagggtcgccgacatcctgccgcgcgactactaccta

SEQ ID NO: 24286 - DNA, 1862 bp, Oryza sativa
ggcggcgacatgagcgtacgcttcctcccacggactccccagcctcgagacgctcgtcgctgtccagaacagcgtggagctgtaccgccccgacgccgacgccgcgccgcgcctcgcgcgcgccaccgtcgcgttccgcgtcggccagatggaaggggatcccccggactgcagccattgcaggagaggatcaagcgcgacgccgcgctgtccgcgctcggctacctctgcagggccgccattaacgtgacggatctcgcgctgcgtctcacggggcctcagatgtgggtcgtcccggagagcgggggatcctggagatgcccagcctgaggaggctgctggtcgccgacgtgccgccgcgctgggacgcgacgtggatccgcgccgtcgtcgaggcggcggcgccgtcgcttgagcgcctccacgtccacttctcccaacactatcgccaagacgacgacgacccggcggcggatcgtcggagattggagatagtgtgggagaatgagccgtcaagaacacagcattgtgacaatctggaggagcttgtggtcattggtttccagagcaagaaagagaggcaggttcagtttgtgaggtacgtcatggaggaagcatccatggcgttgcgccgtgttgtgctgatcaagcatggacacgtcgaggatagaggcccaggtgaatgggagatggtgagccagaaatgtacttggagcgatgaggagaagctcgccgtgaaggagcagatcatggagggggtttgctgttcgatggaccaagttgaattggtcctagaataatgaaaccaaactatgtgttgattgtacattagttaaacattcataaaggttatacaatacatcgaacagttataattcccagagtgctaataaaacaggaaggattgaatccatgcagttttgacgcttcactcacaaagaaaactgcattgaatttggctattttaacatgttcatcaaaagctacagagaatcatccactttgaacagatcatgatttacaaggttcttggcttctacccaaattacatcactaaacaagtcacttctaccaaaaaggaagttgtaggaacaaaaatattcaacaatttgcatgtgttggctgtctattccgccttgtcgagactatttgtcccagccatcctctctcatgccaaatagccatttctgggggagagggccatatatggaggcgaacttcgccaagcatttcgttctgatgtcatagtgcttctgcgtgtctcggctaatagcaactgaagaaagcttggaagtgtcgatagcccaagcagggtgaacatactccacagtcctcgaagagcttgcatttgcatacagaaaattcatgagcaagtcctcgcagttgaagttcttgtggacatagtctctgccttccttagcttcttgactccagtatttactgaaagcgaactcactgtccatgaaagcagcacctgtgaggatcaaattgtagcccttcttgccccgagcatatcgctcattcctgtactgcaaaggatcaccgtctatcattcgagggtaaaagcccaccatcctctcagggtgttctctccataccttgaatcctttctctacatcactgcaagtcatcatgatatcatcatccagttccaggacagcccttgtctttatcaaagggtcacccctaaatcggttgttaagggagttgatttcttccacacgtattctgacagggactgttgaatcaaaggcgtcgctggtaggatggttgcctttgttccagacaacaactatctctctgactgactcacatctagagtagtgttcaacaaatagtttcaggttccagagtcgagcttc

SEQ ID NO: 24287 - DNA, 481 bp, Oryza sativa
taacatgattagagttaggactagggattgcttagccatgcttagttcaactagttcacaatggggaaaaaatcctattaatgtttagactattggttctaatggtttgttggattagtaacaccgctttggtgttggttaattaaaataaatcacatggtgggctgtgggtgcatggttttgctggtcgctcccatggcagttaaggaccggttcgcaggatgccctggaagaacttatcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgcctgcgaggagtgggggtgaaacctgaggtgtggtgtgcttggttagagggggttatgcgaatggtcctgtcacggcc

SEQ ID NO: 24288 - DNA, 706 bp, Oryza sativa
ttaacagttctaccttttttgtaagaataatatgactaattattatacttgttgtcacatttgccatttgaacttttgttaaacatatcaaatgcctaggaatgcatctcagtatatcaaattaggtacatatacatgtattgatatgatttttactcaatgacaactgtccagacattatgtttcttaataagtaaataagaatctggtaccaatttcattaatttacttggcaaattatgtagtagcttacagtaactgtttgtcacaacatcttcatcagcactgtaaatttttctatgtaaaatccatctaatggagcaacttttttgattgattatcgcaaaatgttaagagccatcatcagaacatatgcagtataatatccctatttaaatagattcttgtgtcaattttgacagtttacctttgaatcaagctgtagcgttgatgtgctgtataatcgcacatcactgaaaacgtggtagacattaacagccgctggttgtggagaggagcaagaggaaggggtcgtcgttgccgtggctgtcggttgaaatgctgtgcagtgaccagatttagttctccagacctctgaatggcgggatccagaggtgcacgccgacggggatgacgtcggggggtgcacgagaaggatagcttgttttaccctaaccatccatttggggggagggggggggatagg

SEQ ID NO: 24289 - DNA, 250 bp, Oryza sativa
cgatgatcgaagacccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctagagtagatgg

SEQ ID NO: 24290 - DNA, 636 bp, Oryza sativa
aagcgtaacaccctaccctgagagcccgaggggtgtgacgtggcaccccgagccccctcagccacctcagcgctatccgaggggcgggggaaggcgaggcgcatggctacgtgactaaacgggaaggatacttccctttactgtgtgtacccccgggcctatatcaccgacaattatagtcacacttttgtgcaaccacaaccgccatctatatttatattatttagcttgatttatatgttgtatatgataacaaatcacccaccataatatattgggaactttaaattcatatgataatttaagtttacataactttatcattatttttcactgtcttcaccgctgcaccagtcgccgccttttcaccacctccactgttacatgacccttattctccccttagtttccattggtgtctgttttatagcttaagcacatagatacatttcatcctgtatatttcaactaatacaatacatcaaatcattagtttgaaagtcatcctcaaaacagagcaatttgaatggtatttccaaacattggttctgctctttaaataccaagcaaatcaaactgactactaccaggcctagaataaagccaatcaaattggtgtcacaggctgtttgctat

SEQ ID NO: 24291 - DNA, 507 bp, Oryza sativa
cgatagaatcaattcaatgctgaattgcaataagcggagtctcacaactagagacgaaccgctagactacatagagtaatgaatccaacgattcaaaaaaaactaacagatggaggaaattgcacaagaaatcctggtctcaaagaaaaagaaaatggggatatggcgaaatcggtagacgctacggacttgattgtattgagccttggtatggaaacctgctaagtggcaatttccaaattcagagaaaccctggaattaaaaaaggggcaatcctgagccaatccatgttttgagaaaacaagtggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaatgattaatcacagaactcatatcataatatagg

SEQ ID NO: 24292 - DNA, 749 bp, Oryza sativa
tatgtttttagtacgatgggtccgctcagaccgccagaaatgttctttaggatttttaggttgggttagtttttgtttttcaaacttttgactgtctgactttctttgattttatctaacattcatcccttttagccgtttctttttttttcaactccaaacttcaacttttttttattttctgttagtatgtttttcaaatggttaaatggtttgttttttttttgcaaaaataatttttatatagtagtttcttgaaagaatcaaataaactttattttaagtttataataattaatacttaattatttatatgctaatagtttatcacgttttgcatgtcaccgaaaagctaaacaaagatagagatttacactacctttaataggcttctctgtattcgatcctacacgatcactttgaagaagaagctgaggacgtatggtacctgcatgcacttgatccttccgccgttggtgatgtcgccgaagcctgagttggtggagcggcggctcactgggaggccggcggtggacttgagcccctggaatggagccacggaggtggccaaggaggctatgacaatgggagccatagttacgtagctagggccttttagattgatgacattttcaaccatatcattatttggtaaaattaataattatgtgactgcgtttagcttgttactaaatattagtaatgtttatataattttggcaacattattaagccaatcttactaaaat

SEQ ID NO: 24293 - DNA, 390 bp, Oryza sativa
catcaactgttcatgaacaaatgttgtgcacataagcacaattggacctggatattaccatcctggactcctgatatcattttgttgtcatccttaccttattatatgttctccaatgtttcgatgtactttttgttccttaaaataacataagatggtagtacctattctcatctaataactatattgctcataggtgacttattttgagcagaacaagactgtaggagtagcaagcaaacctattttttgctatcaatacatagggaaaaatatagcttacagagaggacggcgtcgcgggagatgaccacccggaacatctcgagctgctccccgcacagtcgccggaagtccgtgctgggctccgtgaagcctccctctcctcgca

SEQ ID NO: 24294 - DNA, 503 bp, Oryza sativa
cctcaactatttctcgcgatatcttcttacgaagttttgttagggcatctataacagcctctggtttaggtgggcaactcggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaagggggccataaactagagagtgttgaccaatttgaaagatgcttttagtgtagttgaaataacggaattggaacttgtttggtcaagtaggggaaactcaatcaaactcataactgtcttaa

SEQ ID NO: 24295 - DNA, 505 bp, Oryza sativa
ataggaatgattttccaaccgttccaacatttcatcaatgaagggtagtgaaaaatgatcctttttcgtagccttgttgagtttcctgtaatctatgcacattctccatcctgtgatggttcgttgcgggataagctcatttttagcatttgcaacaaccgtcattcctcctttattaggcactacttggactgggctatcccactcgctgtattgcacaggatagataatccagacgtgcaggagtttcaggacctctttcttaacgacttccctcatcgcattattcagctgactttggggttctctggacggctgagctctcaggcacgatgggccttgcgatgagtatagcagcacgggattaatccatttcagatcctgaagggaatagccttgcaacagcgcgatgctttctcaaagacggctagaagacgactggttttgccatcagaaagcttgtcactgataatgactagagcttccttattaccatatacaaaag

SEQ ID NO: 24296 - DNA, 327 bp, Oryza sativa
ccgacaccggtctcaccttactgcggtgcagggggctcagctgggacgatccgggcacggacgtgcggtgagctactcacagttcacgactcctttgtcgagaggtacgaacagtgttttactataagttagttgcactgtaatattttttataatgacattaatttgttattgcaggctacgtgaggccggcctcctaccgatgtgtcggctggtggaggctgcggccggcgacgcggacccggccagacgatggactgtggacaggtccctcctagcagctttggtcgattgatggaggccagagacgcacacttttcacttgcc

SEQ ID NO: 24297 - DNA, 851 bp, Oryza sativa
gatttgctcgttggcgttgcttaatgttactggaggtggcttccagtgcttcccgaaggtaccggaatggagaattctgcttgtttatacctggaattttgcagaccttgcaggactgtcgactctaatttcctctgtagttctcatcaatgaagcttgtctgcatttgcagttagatgggcagatgctctcgcttgcattccgtttcttaagggcaagaactccagaagaaagagctctggtagatttggaaacccattatacaaaggtgaaaatgcatccatttgtcatatgccaattgatgtaatttttttcccttgacattttgagtgttaacatccaatgcaccatgctgcgatgcaggaatatcttgatgagaaagttggatcatgcacgaggagaacaatcctctatcaagtgagtttaaaagtgtttgttgttgatggtgtatcacctagatttaaatcttcatcataacttatgtagcaccaaagtccaaaattgtgggaggaggagcttcccaggatttaattttgggaggtggtgagtactaaggagaacagtatgttgttcagctggcaggagctgcaaggagcaagccgctggccagggtttgatccttggtactcattacctcccgacattaaattctgggcaggattaagtccaaaattgatttggacaaaattagttgcgtgtacacatagaatgattcctctatgtctgttcttttgaactgtataaactgtaaagtattacagtcacaagatcacagcattacaactaggcctttgtaccggaaaaaaaaacaaagctttacttatttcattgatgtaccaaatttcaattat
